United States Patent 11,098,302 (IDENTIFICATION OF POLYNUCLEOTIDES ASSOCIATED WITH A SAMPLE) - sequence listing, part 123

SEQ ID NO: 426411 - DNA, 583 bp, Homo sapiens
  misc_feature: GZ8MTXP02FSOJ6.3.17.B06.1.454.CMB.2.raw
  modified_base (259)..(259): a, c, t, g, unknown or other
  modified_base (305)..(305): a, c, t, g, unknown or other
  modified_base (370)..(370): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggagggtccctaagctctctgtgcagcctnggactcaccttcacgctcaatggccactacgtggactggggtcccnccaggcctcgagggagggctgggagtgggtgccgttcagacgacaccaactacagtgacacccgnacaatcgccgcgtctgtagaaagcagattcacatcacaagagatgattcagagaactcactttatctagactaaagtagaaacgagaccctagaacgaaaaccccggacgaaaccaaccgggggtcccgttacttaaagtttacgtttacggtggtttaccaaagttacggaacccttagggggaacttaaccgaaacggtacgggtttacgg

SEQ ID NO: 426412 - DNA, 562 bp, Homo sapiens
  misc_feature: GZ8MTXP02G2C8V.3.17.B06.1.454.CMB.2.raw
  modified_base (306)..(306): a, c, t, g, unknown or other
  modified_base (341)..(341): a, c, t, g, unknown or other
  modified_base (359)..(359): a, c, t, g, unknown or other
  modified_base (383)..(383): a, c, t, g, unknown or other
  modified_base (414)..(414): a, c, t, g, unknown or other
  modified_base (442)..(442): a, c, t, g, unknown or other
tcagagacgcactccacgaccggtgctcgatttagtcgatagtgaaggggagctctgagagcggagccccagccccagaattcccaggtgtttcatttggtgatcagcactgaacacagaggactcaccatggagtttgggctgagctgggttttccttgttgttattttacaaggtgtccagtgtgaggtgcacctggtggagtcgtgggggagcttggtccagcctgggaggtccctaagctctcctgtgcagcctctggactcaccttcacgctcaatggccactacgtggacctgggtcccncaggctccgagggagggctggagtgggtgccgttnagagacaaccaactaacngtgaccaccgcacaataccggccncgtctgagaaaggcagatcacatcacaaagnatgatcaagacgtaaactctaactttancctagaactaaagtgaacagcctagaaacgaacccgacgaccgaccgggtaccttacttaatttacttaggtcgtaccaagttacgaaccgtaggactaaacgaaccgtacgggttaccg

SEQ ID NO: 426413 - DNA, 591 bp, Homo sapiens
  misc_feature: GZ8MTXP02FF8MI.3.17.B06.1.454.CMB.2.raw
  modified_base (264)..(264): a, c, t, g, unknown or other
  modified_base (310)..(310): a, c, t, g, unknown or other
  modified_base (350)..(350): a, c, t, g, unknown or other
  modified_base (367)..(367): a, c, t, g, unknown or other
  modified_base (378)..(378): a, c, t, g, unknown or other
  modified_base (441)..(441): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttgggtccagcctgggagggtccctaagactctcctgtgcagcctntggactcaccttcacgctcaatggcccactacgtggactgggtccnccaggctccgaggggaagggctggagtggggtggccgttnagagacaccaactaacngtgacacccgnacaataccgccgcgtctgtagaaaggcaagattcaaccatcctacaaagagatgattcaaganaaactcactttatctagaccaaaatcgaaacagaccctagaacgaaaacccggacgaacgaccgggtacccgtacttaagtttaacttggtagttaccaagttaacggaacccttaagggactaaaccgaaaccggtacgggttaacggg

SEQ ID NO: 426414 - DNA, 572 bp, Homo sapiens
  misc_feature: GZ8MTXP02HBHHJ.3.17.B06.1.454.CMB.2.raw
  modified_base (254)..(254): a, c, t, g, unknown or other
  modified_base (302)..(302): a, c, t, g, unknown or other
  modified_base (335)..(335): a, c, t, g, unknown or other
  modified_base (351)..(351): a, c, t, g, unknown or other
  modified_base (428)..(428): a, c, t, g, unknown or other
  modified_base (461)..(461): a, c, t, g, unknown or other
  modified_base (508)..(508): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcactgggtggagtcgtgggggagcttggtccagcctggagggtccctaagactctctgtgcagcctntggactcaccttcacgctcaatcggaccactacgtggactgggtcccncaggctccgaggggaggctggagtggtgcgttnagagacaacaactaanagtcgacaccgcaacaataccgccgcgtctagtagaaaagcaagattccaaccatctacaagagatgattacaaganaactctaactttagctagacaaaatcgaaaacncgacctaggaacgaaaccgacaacgaccggtcccttacttaagtttnttagtcgtacatacgacctaaggaactaacgaaacgtacggtacgtacctggttaactccgggg

SEQ ID NO: 426415 - DNA, 572 bp, Homo sapiens
  misc_feature: GZ8MTXP02IPNL5.3.17.B06.1.454.CMB.2.raw
  modified_base (303)..(303): a, c, t, g, unknown or other
  modified_base (362)..(362): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtccctaagactctcctgtgcagcctctggactcaccttcacgctcaatggccactacgtggactggggtccnccaggcctccgaggggaagggctggaggtgggttggccgtttctagagacacaactaangtgaccaccgcaacaataccgccgcgttctggtacgaaaagggccaagacttccaccatctcaaagagatagattcgaagagtaaactctaactttatctagtacaaatgaaacagacctagaacgaaaccgacgaacgaccggcctactatttatcgttgtacactacgacctaggaactacgaacgtacggtgtacctggttatccgg

SEQ ID NO: 426416 - DNA, 789 bp, Homo sapiens
  misc_feature: GZ8MTXP02HYP61.3.17.B06.1.454.CMB.2.raw
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcaccgtggtggagtcgtgggggagcttggtccagcctggagggtccctaagactctcctgtgcagcctcgtggactcaccttcacgctcaatcggccacgtacggtggaccgtggggtccccgccgagggcctaccggagggggaacgggggccgttaggggagggtttggggtttcgggcccccggtttgtaaagggacggtaaccaaccccgtaaaacgttaaaccagggtacggaacccaccccgggacaccgaaaacgttaacccggccccggtacgttccgtaggtacggaaaacggggccaaggtacttacccaaccctaattcctaacgaaaaggtagaattgggtaaatttacccgaaagggtaaacgttaaaaccttctttaaacctttttaactaccgttagaaccctaaaaattcggaaaacccaggtaccccgtagaaaccggaaaaccccgtacggaaaacccggaccggggtacccctttaacttaacgttttaaacgtttggtaacgttactaaacgtaacggtaaaccttaacggggaaactttaaaacccgaaccggggttaaccggggtttaaccggg

SEQ ID NO: 426417 - DNA, 549 bp, Homo sapiens
  misc_feature: GZ8MTXP02GL1XC.3.17.B06.1.454.CMB.2.raw
  modified_base (306)..(306): a, c, t, g, unknown or other
  modified_base (341)..(341): a, c, t, g, unknown or other
  modified_base (358)..(358): a, c, t, g, unknown or other
  modified_base (383)..(383): a, c, t, g, unknown or other
  modified_base (414)..(414): a, c, t, g, unknown or other
  modified_base (443)..(443): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggagggtccctaagctctcctgtgcagcctctggactcaccttcacgctcaatcggccactacgtggactgggtccncaggctccgagggagggctggagtgggtgccgttnagagacaccaactaacngtgacaccgcacaatcgccgcgtcngtagaaaggcagacttcacatctacaaaganatgattcaaagacgtaaactactatttanctagactaaaatgaacagcctagaacaacccgacgaccgacggcccgttattattattcgtgtacaagttacgaacctaaggactaacgaacggtacgggttacgg

SEQ ID NO: 426418 - DNA, 610 bp, Homo sapiens
  misc_feature: GZ8MTXP02HELNF.3.17.B06.1.454.CMB.2.raw
  modified_base (453)..(453): a, c, t, g, unknown or other
  modified_base (465)..(465): a, c, t, g, unknown or other
  modified_base (469)..(469): a, c, t, g, unknown or other
  modified_base (477)..(477): a, c, t, g, unknown or other
  modified_base (493)..(493): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtgggggaggcttggtccagcctgggagggtccctaagactctcctgtgcagcctctggactcaccttcacgctacaatcggacccactacggtggacctggggtccccgccaggcctaccggaagggggaacggggctggggaggttgggggttcggcccgtttcgagagaccaacaaactaacgagtacgaccaccgacaacaagtaccgccgcgtctggtagaaaggcagacttcaaccatcacaagngatgatcaaganactntactttanctagacaaatgaaacngcctagaacgaaaccgacgaccgacggccgttattaatttagttcgtacgtactaagtaacgacctaaggaactaaccgaaacggtacgggttacgtaccgtgggttacttccgggg

SEQ ID NO: 426419 - DNA, 581 bp, Homo sapiens
  misc_feature: GZ8MTXP02HLTV6.3.17.B06.1.454.CMB.2.raw
  modified_base (345)..(345): a, c, t, g, unknown or other
  modified_base (349)..(349): a, c, t, g, unknown or other
  modified_base (361)..(361): a, c, t, g, unknown or other
  modified_base (364)..(364): a, c, t, g, unknown or other
  modified_base (367)..(367): a, c, t, g, unknown or other
  modified_base (371)..(371): a, c, t, g, unknown or other
  modified_base (383)..(383): a, c, t, g, unknown or other
  modified_base (466)..(466): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtccctaagctctcctgtgcagcctctggacctcaccttcacgctcaatggccactacgtggactgggtccgcaggcctcgaggggagggctggagtgggtggccgttntagngacacaactacngtnacnccgnacaatacgccgngtctggtagaaaggcagtaacttccaacatctacaagagatgattcaagaacgaactctatttagctagaccaaagtgaaacngacctagaacgaaacccggaacgacccgacgggtacccctattaacgttacgttggtaagtcctaaagtacggtaacccttaagggacttaacccgaaacgggtacggttacggg

SEQ ID NO: 426420 - DNA, 597 bp, Homo sapiens
  misc_feature: GZ8MTXP02IJK2F.3.17.B06.1.454.CMB.2.raw
  modified_base (363)..(363): a, c, t, g, unknown or other
  modified_base (371)..(371): a, c, t, g, unknown or other
  modified_base (423)..(423): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtctgggggagcttggtccagcctggaggtcctaagctctcctgtgcagcctctggactcaccttcacgctcaatcggccactacgtggacctgggtcccgcaggctaccgaggggaagggctgggagtggggttgccgttcagagacacaactaacngtcgaacnccgcacaatacgcccgcgtctgtacgaaaggcagattcaccatctacaaganaatgattcaagtagaaactctaactttatctagactaaatcgaaacacggcctaaggaacgtaaaacccggacgaaccgaaccgggtaccttacctaaacgtttgttacggttgtaccgtaagtaacgaacccgttaaggaaactttaaccgaaaacggtaccgggtttaacgg

SEQ ID NO: 426421 - DNA, 573 bp, Homo sapiens
  misc_feature: GZ8MTXP02GJUB9.3.17.B06.1.454.CMB.2.raw
  modified_base (303)..(303): a, c, t, g, unknown or other
  modified_base (349)..(349): a, c, t, g, unknown or other
  modified_base (428)..(428): a, c, t, g, unknown or other
  modified_base (455)..(455): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtgggggaggcttggtccagcctggagggtccctaagactctcctgtgcagcctctggactcaccttcacgctcaatggccactacgtggactgggtcccnccaggcctccgaggggaacggggctgggagtggggttggccgtttnagagacacaactaacagtcgaccaccgcaacaataccgccgcgtctgtagaaaaggcaagacttcaccatcctcaaagngatgattcaagagaactctaactttancctagacaaaatgaaacagcctaggaacgaaccgacgacgacggccgtactatttattgtagtacatacgacctaaggaactacgaaacggtcggtaggtacctggttacttccgggg

SEQ ID NO: 426422 - DNA, 570 bp, Homo sapiens
  misc_feature: GZ8MTXP02HCYPC.3.17.B06.1.454.CMB.2.raw
  modified_base (300)..(300): a, c, t, g, unknown or other
  modified_base (337)..(337): a, c, t, g, unknown or other
  modified_base (340)..(340): a, c, t, g, unknown or other
  modified_base (345)..(345): a, c, t, g, unknown or other
  modified_base (353)..(353): a, c, t, g, unknown or other
  modified_base (363)..(363): a, c, t, g, unknown or other
  modified_base (397)..(397): a, c, t, g, unknown or other
  modified_base (431)..(431): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggaggtccctaagactctcctgtgcagcctctggactcaccttcacgctcaatggccactacgtggactgggtccnccaggctccaggggaaggggctggagtgggtgcgttnagngacanaactaacngtgacaccgnacaatacgcgcgtctgtgaaagcagattcacctntctcaagagatgattcagaagactcaacttttanactagaactaaatacgaaacacgcctaggaacgaaaccgacgaaccggacggtaccgttacttagttagttcgtacgtactaagtaacgaccgttaaggaactaacgaacggtacgggtacgtacgtcggtacgttcgg

SEQ ID NO: 426423 - DNA, 591 bp, Homo sapiens
  misc_feature: GZ8MTXP02G99O0.3.17.B06.1.454.CMB.2.raw
  modified_base (304)..(304): a, c, t, g, unknown or other
  modified_base (432)..(432): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtgggggaggcttggtccagcctgggagggtccctaagactctcctgtgcagcctctggactcaccttcacgctcaatggccactacgtggactggggtccnccaggctccgaggggaaggggctgggagtggggttggccgtttcgagagacaacaaactaaacagtcgacaccgacaacaataccgccgcgtctggtagaaaaggcaagattcacctatctacaaganatagattacagaagaactctaacctttatcctagacaaaatgaaacagcctagaacgaaccgacgaacacgggccttagtacttagttcgtgtactaagtacgaccgttaaggaactaacgaaacggtacggtacggtaccttagggtactttccgggg

SEQ ID NO: 426424 - DNA, 556 bp, Homo sapiens
  misc_feature: GZ8MTXP02FXPXV.3.17.B06.1.454.CMB.2.raw
  modified_base (311)..(311): a, c, t, g, unknown or other
  modified_base (436)..(436): a, c, t, g, unknown or other
  modified_base (460)..(460): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggaggcttggtccagcctgggagggtccctaagactctcctgtgcagcctctggactcaccttcacgctcaatcggccactacgtggactgggtcccnccgaggcctccgaggggaaggggctgggagtggggtcggccgttcagagacaccaaactaacagtcgacaccgcacaataccgccgcgtctgtagaaacggcaagacttcaaccatctacaaganatgattcaagagaactctatttanctagacaaatgaaacagcctagaacgaacccgacgacgacggcctactattatgtgtacaagtacgaacgtaggataacgaacggtacggttacgg

SEQ ID NO: 426425 - DNA, 603 bp, Homo sapiens
  misc_feature: GZ8MTXP02HMCLT.3.17.B06.1.454.CMB.2.raw
  modified_base (259)..(259): a, c, t, g, unknown or other
  modified_base (306)..(306): a, c, t, g, unknown or other
  modified_base (344)..(344): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggacgggtccctaagacctctcctgtgcagcctntggacctcaccttcacgctcaatggccactacgtggactggggtccnccaggctccgaggggagggctggagtgggtggccgttntagagacacaactaacagtcgacaccgcacaataccgcgcgtctggtagaaacggcaagtattccaacctatcctcgaaagagtatcgaattcaaggtaacgaactactaacttttactcgtacgtaccaaaagttcgaaactacgacccgtaggaacgaacccggaacgaccgaaccgggccttactagttattcggtatacaatacgtacctaggaactaacgaacggtcggttacgtccgtggttaacgttcgggg

SEQ ID NO: 426426 - DNA, 594 bp, Homo sapiens
  misc_feature: GZ8MTXP02JNDFZ.3.17.B06.1.454.CMB.2.raw
  modified_base (298)..(298): a, c, t, g, unknown or other
  modified_base (339)..(339): a, c, t, g, unknown or other
  modified_base (366)..(366): a, c, t, g, unknown or other
  modified_base (422)..(422): a, c, t, g, unknown or other
  modified_base (542)..(542): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtgagtctggggagcttggtccagcctgggaggtccctaagactctcctgtgcagcctctggactcaccttcacgctcaatcggccactacgtggactgggtccncaggctccgaggggaagggctgggagtggggttgccgtttnagagacacaactaacagtccacaccgnaacaataccgcgtcgtctggtacgaaaagcaagacttcaacccattcctacaaagngtaatgattaccgaaggaactaaccttctaactttaactacgtagactaaaatcgaaaacctgaccctaggaaccgaaaccgacgaaaccgcgggacccttataatttagttgtccgtanactacgacccgtagaactaacgaacggacgggtcgtaccgttggtactcggg

SEQ ID NO: 426427 - DNA, 595 bp, Homo sapiens
  misc_feature: GZ8MTXP02IOV24.3.17.B06.1.454.CMB.2.raw
  modified_base (303)..(303): a, c, t, g, unknown or other
  modified_base (369)..(369): a, c, t, g, unknown or other
  modified_base (457)..(457): a, c, t, g, unknown or other
  modified_base (473)..(473): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtccctaagactctcctgtgcagcctctggactcaccttcacgctcaatggccactacgtggactggggtccnccaggctccgaggggaaggggctgggaggttggggttggccgtttctaggagacaacaactaaacngtcgaccaccgcaacaataccgccgcgtctgtaggaaagcagacttcaaccatctacaagagatgattcaagacgaactcaactttanctagacaaatgaaacngcctagacgaaaccgcgaacaccggtccgttactagtttacttggtactactagtaacgacccttaagggaattaacccgaaacggtacgggttacggtacccttggggttactttccgggg

SEQ ID NO: 426428 - DNA, 525 bp, Homo sapiens
  misc_feature: GZ8MTXP02JHBHV.3.17.B06.1.454.CMB.2.raw
  modified_base (308)..(308): a, c, t, g, unknown or other
  modified_base (343)..(343): a, c, t, g, unknown or other
  modified_base (438)..(438): a, c, t, g, unknown or other
  modified_base (455)..(455): a, c, t, g, unknown or other
  modified_base (492)..(492): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtccctaagactctcctgtgcagcctctggactcaccttcacgctcaatggccactacgtggactgggtccncaggctccgagggagggctggagtgggtgccgttnagagacacaactacagtgacaccgcacaatacgccgcgtctgtgaaaggcagattcacatctacaagagatgattcagagaaacctctactttanctagacaaatcgaaacngcctagacgaacccgacgacacggcctactattatgntcaagtacgacctaggactacgaacgacggtcg

SEQ ID NO: 426429 - DNA, 846 bp, Homo sapiens
  misc_feature: GZ8MTXP02GADMZ.3.17.B06.1.454.CMB.2.raw
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtggggggaggcttggtccagcctgggacgggtccctaagactctcctgtgcagcctctggactcaccttcacgctcaatggccacgtacggtggacgtcgggtcccgccaggcctaccggagggggaaggggctaggggaggttggggttcggcccgtttcgtaggagaccaacgaaactaaacgacggtacgaaccacccgacaaactaaactacccggccgtcgttactacgggtaagaaaacggggccaaaggtactttacccgaaaccctattaccccgtaacaaaaggagtaaagttaggaaacttttaccgaaaagggtaaaccgtaaaaccttccttaaaacccttttttaataccgtttaacggaaacctaaaaaagtttccgggaaaacctaaccgggtaccccgttaagggaaaaccggtaaaaacccccgggaccggtaaacccggaaccccgggggtacccctttaactttaaaagttttaccttttacggggtaaaccgttacctaaaggtttaaaaccggtaaacccccgtttaaaaggggtaaaaccttaaaacccggaaaaccggggttacgggggttaaaccggtttaccccggtttaggggtttaacccgtttaaccccgggggg

SEQ ID NO: 426430 - DNA, 602 bp, Homo sapiens
  misc_feature: GZ8MTXP02HM9XR.3.17.B06.1.454.CMB.2.raw
  modified_base (347)..(347): a, c, t, g, unknown or other
  modified_base (437)..(437): a, c, t, g, unknown or other
  modified_base (449)..(449): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtccctaagactctcctgtgcagcctctggacctcaccttcacgctcaatcggccactacggtggactcggggtccgccaggcctccgaggggaggggctggagtgggtggccgttntagagacacaaactaacagtacgaccaccgacaacaataccggcccgcgtctggtagaaaggcaagacttccacctatcctacaaagganatgattcaaganaactctactttatctagaactaaatcgaaactacgctaggaacgaacccgacgaccgacgggtccttacttaattagtcgtagttaccaatacggtaacctagggaactaacgaaacggtacgggtacgttaccgtgggttaactttccgggg

SEQ ID NO: 426431 - DNA, 610 bp, Homo sapiens
  misc_feature: GZ8MTXP02H0GWH.3.17.B06.1.454.CMB.2.raw
  modified_base (312)..(312): a, c, t, g, unknown or other
  modified_base (460)..(460): a, c, t, g, unknown or other
  modified_base (472)..(472): a, c, t, g, unknown or other
  modified_base (487)..(487): a, c, t, g, unknown or other
  modified_base (503)..(503): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagccgtgggagggtccctaagactctcctgtgcagcctctggactcaccttcacgctcaatcggccactacgtggactcggggtccnccgaggcctccggaggggacggggcgtggggtaggttggggtttcggccgtttgtaaggacggacaacccgaaactaaacagtacgacaccgcacaacgtaccgcccgcgttactggtagaaaggcagactcaaccatctacgaaagnatgattcaaganaacttactactttanctagacaaatgaaacngaccgtagaacgaacccgaacgaccgaaccggtcccgtattaaatttcgttaggtctaactaagtaacgtaccgtaggaactaaccggtaacggaacgggtttacgg

SEQ ID NO: 426432 - DNA, 599 bp, Homo sapiens
  misc_feature: GZ8MTXP02HK9YI.3.17.B06.1.454.CMB.2.raw
  modified_base (259)..(259): a, c, t, g, unknown or other
  modified_base (346)..(346): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggacgggtccctaatactctcctgtgcagccctntggactcaccttcacgctcaatcggccactacgtggactgggtcccgccaggctccgaggggagggctgggagtgggttggccgttntagagacacaactaacagtcgaccaccgacacaactaccgccgcgtctggtaggaaagcaagacttccaacctatcctacaaaggatatgtaacttcgaagaataaaccttctaacttttatcctagtactaaaatcgaaactcgacctagaacgaaacccgacgaacgacggtcccttacttagttattcgagttacagttacgaaccgtaggaactacgaaacggtcggtacgtaccgtggttactccggg

SEQ ID NO: 426433 - DNA, 567 bp, Homo sapiens
  misc_feature: GZ8MTXP02J3OYF.3.17.B06.1.454.CMB.2.raw
  modified_base (301)..(301): a, c, t, g, unknown or other
  modified_base (337)..(337): a, c, t, g, unknown or other
  modified_base (380)..(380): a, c, t, g, unknown or other
  modified_base (449)..(449): a, c, t, g, unknown or other
  modified_base (460)..(460): a, c, t, g, unknown or other
  modified_base (468)..(468): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctggggagcttggtccagcctggagggtccctaagactctcctgtgcagcctctggactcaccttcacgctcaatcggccaactacgtggactgggtcccncaggctccgaggggagggctggagtgggtgccgttntagagacaacaactaacagtcgaccaccgcaacaatacgccgngtcgtgtacgaaagcaagattccaacctatcctacaagtagatggattcaagaagacttcaccttttanctagactaaanacgaaccngaccgtagaacgaaccgacgacgaccggtctactattactgtatacacaacgtaccgtaaggaactaacgaacggtacggtacgtacgtaggtactcgg

SEQ ID NO: 426434 - DNA, 620 bp, Homo sapiens
  misc_feature: GZ8MTXP02JE2SQ.3.17.B06.1.454.CMB.2.raw
  modified_base (515)..(515): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcacctgggtggagtcgtgggggagtcttggtccagccgtgggacgggtccctaagactctcctgtgcagcctcgtggactcaccttcacgctcaatggcccactacggtggacgtgggtcccgcgaggctccgaggggaggggctgggagtgggttggccgttgtagagtacaaccaaactaacgagtacgaccaccgacaccgaaatacccggccgtacgtctagggtagaaaggcagtacttaccaccatcctacaaagagaactgacttacgaaggaactaacttactaacttttacgctagactaaaagtagaaacncgaccctaggaaacaacccggacgaccgacggaccgttacttatttacgtgttacgtactaagtaacgaccgttaagggactaacggaacggtacggtttaccgg

SEQ ID NO: 426435 - DNA, 580 bp, Homo sapiens
  misc_feature: GZ8MTXP02I9VIF.3.17.B06.1.454.CMB.2.raw
  modified_base (431)..(431): a, c, t, g, unknown or other
  modified_base (464)..(464): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtccctaagactctcctgtgcagcctctggactcaccttcacgctcaatggcccatacgtggactgggtcccgccaggcctccgaggggaacggggctgggaggtggggttggccgtttcgtagagaccacaactaacagtcgaccaccacacaataccgccgcgtctgtagaaaggcagtattcaccattccacgaaagngatgtattacaagaagtaaactctaacttttanctagaacaaatcgaaaacacggcctaggaacgaacccgagaccgacggcccgtatatttatcgtgtacatacgacctaggaactaacgaacggcggtaggtacctggttactcggg

SEQ ID NO: 426436 - DNA, 568 bp, Homo sapiens
  misc_feature: GZ8MTXP02HQQ7L.3.17.B06.1.454.CMB.2.raw
  modified_base (303)..(303): a, c, t, g, unknown or other
  modified_base (389)..(389): a, c, t, g, unknown or other
  modified_base (406)..(406): a, c, t, g, unknown or other
  modified_base (414)..(414): a, c, t, g, unknown or other
  modified_base (437)..(437): a, c, t, g, unknown or other
  modified_base (454)..(454): a, c, t, g, unknown or other
  modified_base (498)..(498): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggagggtccctaagactctcctgtgcagcctctggactcacccttcacgctcaatcggccactacgtggactgggtccnccaggctccgaggggagggctggaggtgggtggccgttgagagacaacaaactaacagtcgaccaccgacacaaataccgcgctcngtagaaagcagatcacntcacaagngatgatcagacaactctatttanctagacaaaatgaaacngacctagaacgaaacccgcgaacgaccggtcccttataagtttntagtcgtacaagtacgaaccttaaggaactaacgaaacggtacgggtacgtaccgttaggtactccgggg

SEQ ID NO: 426437 - DNA, 601 bp, Homo sapiens
  misc_feature: GZ8MTXP02F4D7R.3.17.B06.1.454.CMB.2.raw
  modified_base (307)..(307): a, c, t, g, unknown or other
  modified_base (371)..(371): a, c, t, g, unknown or other
  modified_base (459)..(459): a, c, t, g, unknown or other
  modified_base (468)..(468): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtgggggaggcttggtccagcctgggagggtccctaagactctcctgtgcagcctctggactcaccttcacgctcaatcggccactacggtggactggggtcccnccaggcctccgaggggacggggctgggagtggggttggccgtttgagagacaacgaactaacgngtcgaccaccgcaacaataccgccgcgtctggtagaaaaggcaagtacttccaaccatacctacaaagagatgattacaagagaactntaactttanctagacaaatgaaacacgcctagaacgaaaccgacgaacgaccgggcccttataactttattgtcgttaccagtaacgaccgttaaggaacttaacgaacggtacgggtacgttacccgtggttacttcgggg

SEQ ID NO: 426438 - DNA, 620 bp, Homo sapiens
  misc_feature: GZ8MTXP02HVF9Q.3.17.B06.1.454.CMB.2.raw
  modified_base (315)..(315): a, c, t, g, unknown or other
  modified_base (396)..(396): a, c, t, g, unknown or other
  modified_base (410)..(410): a, c, t, g, unknown or other
  modified_base (491)..(491): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggagcttgggtccagcctgggagggtccctaagctctcctgtgcagcctctggactcaccttcacgctcaatcggcccacgtacggtggacgtggggtcccnccgaggcctaccggagggggaacggggctggggagggttgggggtttcggccggtttctaaggagaacaccaaactaacgngtacgacacccganacaactacgccgcgtctagtagaaaggcaagtacttcaccatctacaagagatgaattcaaggactaaactctaactttanctacgaacaaatcgaaacacgcctaggaacgaaacccgtacgaccgaccggccgttattaaacttgttcgtacgtacaaacgttacgaaccgttaagggaacttaaccgaaaccggtacgggtttacgg

SEQ ID NO: 426439 - DNA, 617 bp, Homo sapiens
  misc_feature: GZ8MTXP02GGEWN.3.17.B06.1.454.CMB.2.raw
  modified_base (301)..(301): a, c, t, g, unknown or other
  modified_base (360)..(360): a, c, t, g, unknown or other
  modified_base (420)..(420): a, c, t, g, unknown or other
  modified_base (466)..(466): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtctgggggaggcttggtccagcctggagggtccctaagactctcctgtgcagcctctggactcaccttcacgctcaatggccactacgtggactgggtccnccaggctccgaggggaacgggctgggagtggggttgccgttcagagacacaactaaacngtcgacaccgcaacaataccgccgcgtctaggtagaaaagcaagtattccaaccatcctnaaagagaattagaattcgaaagacgtaaacctctaaaccttttaancgttaagaactaaaatacgaaacacgtacctaggaaacgaaacccggaacgaacgaccggtccttacttaatttagttacgtacgtactacgtaacgaaccgtaaggaaactaacgaaacgggtacggttacgtacgtaggttacgttcgg

SEQ ID NO: 426440 - DNA, 578 bp, Homo sapiens
  misc_feature: GZ8MTXP02JUTAI.3.17.B06.1.454.CMB.2.raw
  modified_base (256)..(256): a, c, t, g, unknown or other
  modified_base (302)..(302): a, c, t, g, unknown or other
  modified_base (342)..(342): a, c, t, g, unknown or other
  modified_base (421)..(421): a, c, t, g, unknown or other
  modified_base (433)..(433): a, c, t, g, unknown or other
  modified_base (445)..(445): a, c, t, g, unknown or other
  modified_base (448)..(448): a, c, t, g, unknown or other
  modified_base (461)..(461): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctgggagggtccctaagactctcctgtgcagcctntggactcaccttcacgctcaatggccactacgtggactgggtcccncaggctccgaggggagggctgggagtggggttggccgttntagagacacaactaacagtcgaccaccgcaacaataccgccgcgtctggtagaaaggcagattccaaccatcacaaganatgattcaaganactctactttancanacaaatcgaaacncgacctaggaaccgaaccgacgacgaccggtccttactagtttagtcgtacactacgtaacgaccgtaaggaactaaccgaaacgggtcgggttacgtaccgtagggttacgtcggg

SEQ ID NO: 426441 - DNA, 619 bp, Homo sapiens
  misc_feature: GZ8MTXP02IIBNO.3.17.B06.1.454.CMB.2.raw
  modified_base (312)..(312): a, c, t, g, unknown or other
  modified_base (349)..(349): a, c, t, g, unknown or other
  modified_base (450)..(450): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtggggggaggctttgggtccaggcctgggacgggtccctaaggacctctcctgtgcagcctctggactcaccttcacgctcaatcggccacgtacgtggactgggtccncaggctcgaggggaggctggagtgggtgcgttcaganacacaactacagtcgaccaccgcaacaaagtccgcgcgtctagtagaaagcaagattccaacccatcacaaagagatgattcaagataactctaactttancctagacaaaatcgaaactacggcctaggaaaccggaaaccgaccgaaccggacgcccgttacttaagtttagttagtcgttaaccaagttaacgaacccttaaagggaacttaaaccgaaaaccgggtaccgggtacggttaccttaacggggtttaacgtccggggg

SEQ ID NO: 426442 - DNA, 606 bp, Homo sapiens
  misc_feature: GZ8MTXP02H8GSY.3.17.B06.1.454.CMB.2.raw
  modified_base (251)..(251): a, c, t, g, unknown or other
  modified_base (295)..(295): a, c, t, g, unknown or other
  modified_base (354)..(354): a, c, t, g, unknown or other
  modified_base (365)..(365): a, c, t, g, unknown or other
  modified_base (451)..(451): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttcctgttgttattttacaggtgtccagtgtgaggtgcacctggtggagtctgggggagcttggtccagcctggagggtccctaagctctcctgtgcagcctntggactcaccttcacgctcaatggccatacgtggactgggtccnccaggctccgaggggagggctgggagtggggttggtcgttcgtagagacacaactaacngtcgacaccgnaacaataccgccgcgtctgtacggaaaagcagtattccaacctatcctacaaagagatgtattcgaagaacgactctaacttttanccgttagacctaaaagtcgaaacacgccctagaacggaaacccgagaacgtaccggcccgttactatttacgttaggtctacgagtacgacccttaagggaactaaccgaaacggtacgggtaacggtacccttaggggtttaacttcccggggg

SEQ ID NO: 426443 - DNA, 645 bp, Homo sapiens
  misc_feature: GZ8MTXP02JEIFN.3.17.B06.1.454.CMB.2.raw
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctgggacgggtccctaagactctcctgtgcagcctctggactcaccttcacgctcaatcggccactacggtggactcgggtccgccaggcctccgaggggaaggggctgggagtggggttggccgtttcgtagagacacaactaacagtcgacaccgcaacaataccgccgcgtctggtagaaacggcaaggtacttccaacctatacctacaaaaggagtaatgaacttacgaaggtaacgaaaccttctaaacttttaatctacggtaactaaaaattcggaaaacacgtaccctaggaaacgaaacccggacgaacgacccgggtccctacttaattattcggtagtacctagttaacgaccttaaggaacttaaaccgaaacggtacgggttacgtaaccgttgggttacgtttccgggg

SEQ ID NO: 426444 - DNA, 515 bp, Homo sapiens
  misc_feature: GZ8MTXP02FU0WZ.3.17.B06.1.454.CMB.2.raw
  modified_base (302)..(302): a, c, t, g, unknown or other
  modified_base (412)..(412): a, c, t, g, unknown or other
  modified_base (414)..(414): a, c, t, g, unknown or other
  modified_base (417)..(417): a, c, t, g, unknown or other
  modified_base (421)..(421): a, c, t, g, unknown or other
  modified_base (431)..(431): a, c, t, g, unknown or other
  modified_base (479)..(479): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggtttcctgttgttatttacaaggtgtccagtgtgaggtgcacctggtggagtctgggggagcttggtccagcctggagggtccctaagactctcctgtgcagcctctggactcaccttcacgctcaatggccactacgtggactgggtccnccaggctccaggggaaggggctgggagtggggtggccgttcgtagagacacaactacagtgacaccgcacaatacgccgcgtctgtagaaagcagatcacatctcaagantnatnaganactctattanctagacaatgaacagctagacgaaccgacgacgacgctatattatcgngtacaagtacgactacgactaacgacggtacggtag

SEQ ID NO: 426445 - DNA, 598 bp, Homo sapiens
  misc_feature: GZ8MTXP02G8F4H.3.17.B06.1.454.CMB.2.raw
  modified_base (304)..(304): a, c, t, g, unknown or other
  modified_base (342)..(342): a, c, t, g, unknown or other
  modified_base (409)..(409): a, c, t, g, unknown or other
  modified_base (419)..(419): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtccctaagactctcctgtgcagcctctggactcaccttcacgctcaatcggccacgtacgtggactgggtccnccaggctccgaggggagggctggagtggggtgccgttnagagacacaactaacagtcgacaccgcacaataccgccgcgtctgtagaaaggcaagattccaaccntctacaaganatagattcgaaagacgtaactctaaactttatctagacaaaatgaaacacgaccctaggaacgaaacccgacgaaccgacgggacccttactatttactgtcgtactaacgtacgtaaccgttaaggaacttaaccgaaacggtacgggttagtaacccgttgggttaactttccgggg

SEQ ID NO: 426446 - DNA, 622 bp, Homo sapiens
  misc_feature: GZ8MTXP02J1RUK.3.17.B06.1.454.CMB.2.raw
  modified_base (339)..(339): a, c, t, g, unknown or other
  modified_base (461)..(461): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggagggtccctaagactctcctgtgcagcctctggactcaccttcacgctcaatggccactacgtggactgggtcccgcaggctccgaggggaagggctggagtgggttgccgttntagagacacaaactaacagtcgacaccgcaacaatacgccgcgtctttaggaaaacggtcaagtattccaacccaatcctacaaagacgtaatgattacaagaacgtaaactctaactttanaccttgactaaaatcgaaactagccctaggaaacgaaacccggacggtaaccaccgggtccgttacgtattacgttggtacgttacagtttaacgacccttaaaggactaaaccgaaacggtacgggtcggttaacctggggtttaactttcgggccgggg

SEQ ID NO: 426447 - DNA, 606 bp, Homo sapiens
  misc_feature: GZ8MTXP02JW9FZ.3.17.B06.1.454.CMB.2.raw
  modified_base (255)..(255): a, c, t, g, unknown or other
  modified_base (382)..(382): a, c, t, g, unknown or other
  modified_base (414)..(414): a, c, t, g, unknown or other
  modified_base (427)..(427): a, c, t, g, unknown or other
  modified_base (440)..(440): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctgggaggtccctaagactctcctgtgcagcctntggactcaccttcacgctcaatcggccactacgtggactgggtcccgcaggctccgaggggagggctggaggtgggttggccgttctagagacacaaactacagtcgacaccgcacaataccgccgngtctggagaaagcagtatcaccatcacaaganatgattcgaaganaccttcaactttnctagactaaatcgaaacacgtcctaggaacgaaaccggaccaccgtaaccggtccccgttattaacgtttattcggtacgtactaaagttaccggaaccttaagggaaccttaacggaaaaccgggtacgggttacggtaaccctttagggggtactttccggggg

SEQ ID NO: 426448 - DNA, 661 bp, Homo sapiens
  misc_feature: GZ8MTXP02JUYI4.3.17.B06.1.454.CMB.2.raw
  modified_base (309)..(309): a, c, t, g, unknown or other
  modified_base (357)..(357): a, c, t, g, unknown or other
  modified_base (486)..(486): a, c, t, g, unknown or other
  modified_base (508)..(508): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggagggtccctaagactctcctgtgcagcctctggactcaccttcacgctcaatcggacccactacggtggacgtcggggtcccnccgaggcctccgaggggaaggggctgggaggtggggttggcccgtttntagacgacaacaactaacgagtcgaccaccgcaacaataccgccgcgtctaggtagaaaggcaagtacttccaacctatcctacgaaagagatgaattacgaaggaacgtaaacctcttaacgttttanctagacctaaaatcggaaaccngaccctaaggaaccgtaaacccggaccgaccgaccgggtcccgttacttaaagtttcttcggtactaccgtaagtaaccgtaaccgttaagggaactaaaaccggaaaccgggtacgggttacggttacccgttagggtaacgtttccggggg

SEQ ID NO: 426449 - DNA, 581 bp, Homo sapiens
  misc_feature: GZ8MTXP02HOY69.3.17.B06.1.454.CMB.2.raw
  modified_base (255)..(255): a, c, t, g, unknown or other
  modified_base (350)..(350): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctgggaggtccctaagactctcctgtgcagcctntggactcaccttcacgctcaatggccacgtacgtggactgggtcccgccaggcctccgaggggaacggggctgggaggtggggttcggccgtttntaggacgacaacaaactacagtcgaccaccgcaacaataccgcgcgtctgacgaaaggcagattccacatctacaagagatgattcagagaactcactttatctagacaaatcgaacagcctagaacgaaaccgacgaaccgacgacccgttatacgtttattcgtagttaccagtacgacctaaggaacgtaacgaaacggacgggtagtacccgtaggttacgttcggg

SEQ ID NO: 426450 - DNA, 598 bp, Homo sapiens
  misc_feature: GZ8MTXP02GT0GU.3.17.B06.1.454.CMB.2.raw
  modified_base (254)..(254): a, c, t, g, unknown or other
  modified_base (299)..(299): a, c, t, g, unknown or other
  modified_base (372)..(372): a, c, t, g, unknown or other
  modified_base (425)..(425): a, c, t, g, unknown or other
  modified_base (455)..(455): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtgggggagcttggtccagcctggaggtccctaagctctcctgtgcagcctntggactcaccttcacgctcaatggccactacgtggactggggccnccaggctccgaggggagggctggagtgggttggccgtttcgagagacaacgaactaaacagtcgaaccaccgnaacaagtaccgccgcgtctgtagaaaaggcaagacttcaaccatctcaaaganatagattcaagaacgtaactctaactttanccttagacaaaattcgaaacagtcctagaacgaaacccgacgtaaccgacgtccgtacttaattacttgtgtactaagtaacgacctaaaggaactaaccgaaaacgggtaccggtaggttaaccctaggttaacgttcgggg

SEQ ID NO: 426451 - DNA, 549 bp, Homo sapiens
  misc_feature: GZ8MTXP02JSE4T.3.17.B06.1.454.CMB.2.raw
  modified_base (301)..(301): a, c, t, g, unknown or other
  modified_base (370)..(370): a, c, t, g, unknown or other
  modified_base (413)..(413): a, c, t, g, unknown or other
  modified_base (438)..(438): a, c, t, g, unknown or other
tcagagacgcactccacgaccggtgctcgatttagtcgatagtgaaggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtccctaagactctcctgtgcagcctctggactcaccttcacgctcaatggccactacgtggactgggtccnccaggctccgaggggagggctggaggtgggttggccgtttctagagacacaactaacagtcgacaccgnaacaataccgcgcgtctgtgaaagcagattcacatcacaaganatgattcagagaactctaactttanctgacaaatgaaacagcctaggaacgaaccgacgacacggccgtctaattgtgtcgtacacttacgacttaggaactacgaacgtacggtcgtaacctgggtaacttcggg

SEQ ID NO: 426452 - DNA, 556 bp, Homo sapiens
  misc_feature: GZ8MTXP02F5E4Q.3.17.B06.1.454.CMB.2.raw
  modified_base (361)..(361): a, c, t, g, unknown or other
  modified_base (372)..(372): a, c, t, g, unknown or other
  modified_base (417)..(417): a, c, t, g, unknown or other
  modified_base (429)..(429): a, c, t, g, unknown or other
  modified_base (442)..(442): a, c, t, g, unknown or other
  modified_base (458)..(458): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggagggtccctaagactctcctgtgcagcctctggactcaccttcacgctcaatggccactacgtggactgggtccgccaggcctccgaggggaaggggctgggagtggggttgccgtttctagagacacaactaacngtcgacaccgnacaataccgcgcgtctgtagaaagcagattcaccatctacaaagnatgattcaaganaactcaactttanctgacaaatcgaaacngcctagaacgaaccgagtacacggcccgtactattagtgtagtacaagttacgaccttaggaactaacgaacggtacggtgtaacctggtacttcggg

SEQ ID NO: 426453 - DNA, 586 bp, Homo sapiens
  misc_feature: GZ8MTXP02JAZXK.3.17.B06.1.454.CMB.2.raw
  modified_base (312)..(312): a, c, t, g, unknown or other
  modified_base (350)..(350): a, c, t, g, unknown or other
tcagagacgcactccacgaccggtgctcgatttagtcgatagtgaaggggatctctgagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtggggggagcttggtccagccgtgggagggtccctaagctctcctgtgcagcctctggactcaccttcacgctcaatcggccactacggtggactgggtcccncgaggctccgaggggagggctgggagtgggtgccgttnagagacacaactaacagtgacaccgcacaataccgcgcgtctgtagaaagcagtacttcacctatctacaaagtagattgattcaaaggtataaacctctaacttttatcgtagaacctaaaagtcggaaacaagcctaggaaacgaacccgacgaacgaccgggtccttactaacttttagtgtcgtacaagttacgaaccgttaaggactaaccgaaacgggtacggtttacgg

SEQ ID NO: 426454 - DNA, 625 bp, Homo sapiens
  misc_feature: GZ8MTXP02ITMND.3.17.B06.1.454.CMB.2.raw
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaggtgtccagtgtgaggtgcacctggtggagtcgtgggggagcttggtccagccgtgggacgggtccctaagactctcctgtgcagcctctggacctcaccttcacgctcaatcggcccactacggtggaccgtcggggtcccgccgaggcctaccggaagggggaaggggctaggggaggttggggtttcggcccgtttacgaaggacgaccaacccgtaaacctaacgagtacgaaccacccggacacgaactacccggccgtacgtcgtaggtaggaaaaggccaagtacttccaacctatctacaagagtatgattacgaaaggactaaactcttaactttatctagactaaatgaacacgcctagaacgaacccgacgacgacggtccttacttagttacgttagtgtacaagtacgtaacctaggataaccgacggtacggttacg

SEQ ID NO: 426455 - DNA, 581 bp, Homo sapiens
  misc_feature: GZ8MTXP02HM3OJ.3.17.B06.1.454.CMB.2.raw
  modified_base (252)..(252): a, c, t, g, unknown or other
  modified_base (297)..(297): a, c, t, g, unknown or other
  modified_base (334)..(334): a, c, t, g, unknown or other
  modified_base (364)..(364): a, c, t, g, unknown or other
  modified_base (378)..(378): a, c, t, g, unknown or other
  modified_base (405)..(405): a, c, t, g, unknown or other
  modified_base (410)..(410): a, c, t, g, unknown or other
  modified_base (425)..(425): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcgtgggttttccttgttgttattttacaaggtgtccagtgtgaggtgcacctggtggagtcgtggggagcttggtccagcctggaggtccctaagctctctgtgcagcctntggactcaccttcacgctcaatcggccactacgtggactgggccncaggctccgaggggagggctggagtgggtgccgtttntagagacacaaactaacagtcgaccaccgnaacaataccgccgngtctgagaaacgcaagattcaccatcnaaagngatgatcagatactntaatttatctagacaaatgaaacagcctagaacgaaaccgcgaacaccgggacccttagttaatttagttcgggttacttcaaacttacggtaccctaaaggaactaaccgaaacggtacggggttcgttaaaccggtcggtttaattcccggggg

SEQ ID NO: 426456 - DNA, 542 bp, Homo sapiens
  misc_feature: GZ8MTXP02I2ELI.3.17.B06.1.454.CMB.2.raw
  modified_base (298)..(298): a, c, t, g, unknown or other
  modified_base (336)..(336): a, c, t, g, unknown or other
  modified_base (340)..(340): a, c, t, g, unknown or other
  modified_base (400)..(400): a, c, t, g, unknown or other
  modified_base (403)..(403): a, c, t, g, unknown or other
  modified_base (407)..(407): a, c, t, g, unknown or other
  modified_base (431)..(431): a, c, t, g, unknown or other
  modified_base (446)..(446): a, c, t, g, unknown or other
  modified_base (461)..(461): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggaggtccctaagactctcctgtgcagcctctggactcaccttcacgctcaatggccactacgtggactgggccnccaggctccgaggggagggctggagtgggtggccgttntagngacacaactaacagtcgaccaccgcaacaatccgccgcgtctgtagaaagcagattcacntcnaagnatgattcagacaactctactttanctgacaaatgaaacngctagacgaaaccgngacacgggcctactattactgtgtactataacgactaggaactaacgaacggtacggtacgttaccgtggtaactttcggg

SEQ ID NO: 426457 - DNA, 594 bp, Homo sapiens
  misc_feature: GZ8MTXP02GLT1V.3.17.B06.1.454.CMB.2.raw
  modified_base (368)..(368): a, c, t, g, unknown or other
  modified_base (431)..(431): a, c, t, g, unknown or other
  modified_base (454)..(454): a, c, t, g, unknown or other
  modified_base (505)..(505): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcgtggtttccttgttgttattttacaaggtgtccagtgtgaggtgcacctggtggagtcgtgggggaggcttggtccagcctggagggtccctaagactctcctgtgcagcctctggactcaccttcacgctcaatcggccactacggtggactcggggtccgccaggcctccgaggggaacggggctgggaggtgggttggccgtttgtagagacacaactaaacngtacgaccaccgcaacaactaccgccgcgtctgtagaaaggcaagattccacatccacaaagngatagacttcgagaagtaacctntaactttatctgactaaaagtcgaaacacgcctaggaacgaaccgacgacncgggtaccctattaattattggtactaactacgtaccgtacgaagtaaccgaaacgtacgtacgggtacgtaccgtagttacggtcggg

SEQ ID NO: 426458 - DNA, 641 bp, Homo sapiens
  misc_feature: GZ8MTXP02FOPIR.3.17.B06.1.454.CMB.2.raw
  modified_base (302)..(302): a, c, t, g, unknown or other
  modified_base (371)..(371): a, c, t, g, unknown or other
  modified_base (423)..(423): a, c, t, g, unknown or other
  modified_base (471)..(471): a, c, t, g, unknown or other
  modified_base (494)..(494): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtccctaagactctcctgtgcagcctctggactcaccttcacgctcaatcggccactacgtggactgggccnccaggctcgaggggagggctggaggtgggtgccgttcagacgacaacaactaaacagtcgaacaccganaacaacgtaccgccgcgtctggtagaaaaggcaagtacttccaacatcctanaaacggagaatgaactttcgaaggaactaaaccttctaaacttttacnctacgaactaaaatcggaaaacnccgtacctaggaaaccgaaaccgaaccgaaccgaccgggtccgttactttaaagtttgttacggtacgtactaacgttaacgaaccttaagggaaaccttaaccggaaacgggtacgggttacgttaaccgtggttaacgtttcggg

SEQ ID NO: 426459 - DNA, 620 bp, Homo sapiens
  misc_feature: GZ8MTXP02JFTEK.3.17.B06.1.454.CMB.2.raw
  modified_base (317)..(317): a, c, t, g, unknown or other
  modified_base (496)..(496): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttgggtccagcctgggagggtccctaagctctcctgtgcagccctcgtggacctcaccttcacgctcaatcggcccacgtacggtggaccgtggggcccnccgaggcctccggaaggggaaggggctggggaggttggggttcggcccggtttcaggagtaccaacctaaactaaacagtcgaacacccgacaccaataccggccgtacgtctaggtagaaaggcagacttccaacctatcctacaagtacatgattcaagtagaaacttctactttanctagactaaagtcgaaactgaccctagaaacgaccgaacgacgtaccgggtacctactagtttacgtcgtaccgtataagtaacgtaccgtaacggactaaccggtaacggtacggtttaccgg

SEQ ID NO: 426460 - DNA, 580 bp, Homo sapiens
  misc_feature: GZ8MTXP02ILK10.3.17.B06.1.454.CMB.2.raw
  modified_base (253)..(253): a, c, t, g, unknown or other
  modified_base (266)..(266): a, c, t, g, unknown or other
  modified_base (300)..(300): a, c, t, g, unknown or other
  modified_base (342)..(342): a, c, t, g, unknown or other
  modified_base (364)..(364): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggtttctgttgtatttacaaggtgtcagtgtgaggtgcacctggtggagtctgggggagcttggtccagcctggaggtccctaagactctcctgtgcagcctntggactcaccttnacgctcaatcggccactacgtggactggggtccnccaggcctaccgaggggaagggctggagtgggttggcccttnagagtacacccaaacgtaaacngtacgacaccgctacaacgtccgccgcgtctaggagaaacgcaagacttacacgtatacgtacgaagagatagacttacgagtaagtaactactacttactactagtacaagtaacgtaacgacgacgacgacgaaccgacgacgacgaccgtacgtacgttacgttacgtacgtacgtaagtacgtacgtacgtacgtacgtaacgtacggtacg

SEQ ID NO: 426461 - DNA, 758 bp, Homo sapiens
  misc_feature: GZ8MTXP02HV0BW.3.17.B06.1.454.CMB.2.raw
  modified_base (257)..(257): a, c, t, g, unknown or other
  modified_base (372)..(372): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcgtggtttctgttgttatttacaaggtgtcagtgtgaggtgcacgtggtggagtcgtgggggagcttggccagcctgggagggtccctaaagctctcctgtgcagcctcnggactcaccttcacgctcaatcggacccacgtaccggtggacttggggccccgaccgagggcctaccggagggggaacgggggtctgggggaggttgggggtttggcccgtttanaaggagtaacaacccgaaactaaacaggttcgaaccacccggactaccaaagttacccggcccgtacggttacttaggtaaagaaacgggccaaagtacttaccaaccctattaccctacgaaaaggagtatggtaatttacgaaacggtataaaccttctttaaacctttactaccggttaacgaaacaaaagtacgaaaccgtaacggtaccgtaaacggaaaaccggaaaaccccggaaccggtaaacccggtaacccggttacccgtttaacgtttaaacgttttacgtttacggttaaccgtaacgttaaacgttaaacggtaacccgttaaacgggtaaaccgtaaaccggtaaaaccgggggttaaccgggttaaccgg

SEQ ID NO: 426462 - DNA, 581 bp, Homo sapiens
  misc_feature: GZ8MTXP02H5XAV.3.17.B06.1.454.CMB.2.raw
  modified_base (257)..(257): a, c, t, g, unknown or other
  modified_base (303)..(303): a, c, t, g, unknown or other
  modified_base (344)..(344): a, c, t, g, unknown or other
  modified_base (353)..(353): a, c, t, g, unknown or other
  modified_base (361)..(361): a, c, t, g, unknown or other
  modified_base (372)..(372): a, c, t, g, unknown or other
  modified_base (452)..(452): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtggggggaggcttggtccagcctgggagggtccctaagctctcctgtgcagcctntggactcaccttcacgctcaatggccactacgtggactggggtccnccaggctccgaggggagggctgggagtgggttggccgtttntagagacanaactaacngtcgacaccgnacaataccgccgcgtctgtgaaagcaagtattccaccatctacaaagagatgattacgaagacgtaactctaaacttttntactagacaaatagaacacgcgtagaacgaaccgacgacgcggtacttacttatttagtcgtacgtactagtacgtaacgtaagtaacgtaacgaaacggtacggttcggtaccgttggttaactcggg

SEQ ID NO: 426463 - DNA, 587 bp, Homo sapiens
  misc_feature: GZ8MTXP02HRS6U.3.17.B06.1.454.CMB.2.raw
  modified_base (307)..(307): a, c, t, g, unknown or other
  modified_base (409)..(409): a, c, t, g, unknown or other
  modified_base (469)..(469): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcactggtggagtcgtgggggagcttggtccagccgtggaggtccctaagctctcctgtgcagcctctggactcaccttcacgctcaatcggccactacggtggactgggtcccnccaggcctccgaggggaaggggctgggaggttggggttcggcccgttagtaggacgacaacccgaaactaacgagtgaccaccggctaccaaataccgccgngtctgtagaaagcagattcaccatcctacaagagatgattcaagataactctaactttanctagacaaaatcgaaacacggcctaagaacgaaaccgacgaaccgacggtccctattaattacttgtacgtacaagttacgacccgttaaggaactaaccgaaacggtacggttacgg

SEQ ID NO: 426464 - DNA, 628 bp, Homo sapiens
  misc_feature: GZ8MTXP02F12TA.3.17.B06.1.454.CMB.2.raw
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggagggtccctaagactctcctgtgcagcctctggactcaccttcacgctcaatggccactacgtggactgggccgccaggctccgaggggagggctggaggtggggttggccgttctaggagacaacaactaacagtacgaccaccgcaacaactaccgccgcgtctggtagaaaggcaaggtacttcaacccattccacgaaagagattagattacgaagtaactaacctcttaactttatcctagaactaaaagtacgaacacgactaggaacgaaacccggacgaaccgaccgggtccttacttaatttagttcggtacgtactaacgttaaccgtaaccgtaaggtaaactaaccggaacgggtaccgggttaggtaacccggttggttacgttcggggg

SEQ ID NO: 426465 - DNA, 567 bp, Homo sapiens
  misc_feature: GZ8MTXP02J18U8.3.17.B06.1.454.CMB.2.raw
  modified_base (343)..(343): a, c, t, g, unknown or other
  modified_base (361)..(361): a, c, t, g, unknown or other
  modified_base (419)..(419): a, c, t, g, unknown or other
  modified_base (444)..(444): a, c, t, g, unknown or other
  modified_base (478)..(478): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatcggccactacggtggactgggtccgccaggctccgaggggaggggctgggagtgggttggccgttntagagacacaaactaacngtcgacaccgcaacaataccgccgcgtctgtgaaagcagatttccaccatctcaaagngatgattcaagagaactcactttanctgacaaatgaacagcctagaacgaaaccccggnaaccgacgggcccttactatttattgacgttcaatacgacctaaggaataaccgaacgacgggttagtaacccgtggtacgtttccggg

SEQ ID NO: 426466 - DNA, 595 bp, Homo sapiens
  misc_feature: GZ8MTXP02F7WT0.3.17.B06.1.454.CMB.2.raw
  modified_base (263)..(263): a, c, t, g, unknown or other
  modified_base (297)..(297): a, c, t, g, unknown or other
  modified_base (309)..(309): a, c, t, g, unknown or other
  modified_base (345)..(345): a, c, t, g, unknown or other
  modified_base (362)..(362): a, c, t, g, unknown or other
  modified_base (370)..(370): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggaggtcttggtccagcctggacgggtcctaagctctcctgtgcagcctntggactcaccttcacgctcaatcggccactacgnggactgggtccncaggctcgaggggagggctggagtgggtggccgttnagagacacaactacagnacaccganacaataccgccgacgtcgtaggtagaaaggacgagtactacacactactacaagagatagatactagaagtaactactacttacttactacactaaatacgaacttttttttacgacgtacgaacgaaaccgaaccgaaccgaccggaccgttacttactttacgttacgttgtactaacgtaacgtaaccgtaacgtaacgtaacgtaaacggtaacggtacgg

SEQ ID NO: 426467 - DNA, 677 bp, Homo sapiens
  misc_feature: GZ8MTXP02I9XHE.3.17.B06.1.454.CMB.2.raw
  modified_base (268)..(268): a, c, t, g, unknown or other
  modified_base (287)..(287): a, c, t, g, unknown or other
  modified_base (317)..(317): a, c, t, g, unknown or other
  modified_base (461)..(461): a, c, t, g, unknown or other
  modified_base (468)..(468): a, c, t, g, unknown or other
  modified_base (474)..(474): a, c, t, g, unknown or other
  modified_base (503)..(503): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaggtgtccagtgtgaggtgcaccgtgggtggagtcgtgggggaggtcttgggtccagccgtgggacgggtccctaagctctcctgtgcagcctntggactcaccttcacgctnaatcggccacgtacggtgacgtcgggcccnccgaggcctacggaggggagggtctggggaggtggggttcgccgttagagacgaccaaccgtaactaagagtacgaccaccgcacgactacggccgtacgtcgtaggtacgaaagggcaaggtacttaccgacctataccctanaaaggtntagtanattacgaagaataaccttcttaactttanccgtagaaactaaaagttcgaaaccacgtcgtaaacgaacggaaaacccgaccggaccgacccggggttacccgttacgtttaaattttccgttaagggtcgttacccaaagtttaacggaacccgttaaggggtaactaaacccggaacggggttaccgggtttaacccgggg

SEQ ID NO: 426468 - DNA, 546 bp, Homo sapiens
  misc_feature: GZ8MTXP02ISMNT.3.17.B06.1.454.CMB.2.raw
  modified_base (307)..(307): a, c, t, g, unknown or other
  modified_base (344)..(344): a, c, t, g, unknown or other
  modified_base (399)..(399): a, c, t, g, unknown or other
  modified_base (406)..(406): a, c, t, g, unknown or other
  modified_base (417)..(417): a, c, t, g, unknown or other
  modified_base (444)..(444): a, c, t, g, unknown or other
  modified_base (449)..(449): a, c, t, g, unknown or other
  modified_base (464)..(464): a, c, t, g, unknown or other
  modified_base (514)..(514): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctggggggagcttgggtccagcctggagggtccctaagactctcctgtgcagcctctggactcaccttcacgctcaatggccactacgtggactgggtccnccaggctccgaggggaggctggagtgggttgccgttntagagacacaactacagtgacaccgcacaaatccgccgcgtctgagaaaggcagnttcaacntctacaagganatgattcgagagtaactctattttacngtaanacaaagtacgaaacngccgaagaaccgaaaccgtacgacgtaccggtccttattagttctacgtntacaagtacgactagataacgacggtacgtcg

SEQ ID NO: 426469 - DNA, 763 bp, Homo sapiens
  misc_feature: GZ8MTXP02G295H.3.17.B06.1.454.CMB.2.raw
  modified_base (314)..(314): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggaggcttggtccagcctgggacggtccctaagctctcctgtgcagcctgtggactcaccttcacgctcaagtcggacctacgtacggtggaccgtcggggtccccnccgaggcctaccggaaggggggaacggggcgttagggggaggtttcgggggttcggtacccggtttacgtaaggacgtaaccgaaactaaacgtaaacgagtaccgaaccgaccgacaacaacgtacccggccgtcgtacgtaggtaaggaaaacggtcaaagtacttaccgaacctatcgtaaacgaaaggtagtatagtaacttacgaaacggtaaactaacctttccttaaacgttttactaccgttaacggaaactaaaacggttacggaaaacctacggacccgttaaagggaaaaccgggaaaaccccgacggaaaccgtaacccgggttcccttaactttaaagtttcgttaggtaccttaacaagttaaccggtaacctaaggtaactaaaccggaacggggttacggttacgtttaccggtagggttacgtttccggggg

SEQ ID NO: 426470 - DNA, 620 bp, Homo sapiens
  misc_feature: GZ8MTXP02GNAK2.3.17.B06.1.454.CMB.2.raw
  modified_base (490)..(490): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggacgggtccctaagactctcctgtgcagcctctggactcaccttcacgctcaatcggccactacggtggactcggggtcccgccgaggcctaccggagggggaacggggctggggaggttggggttcggcccgtttcgtaggagaccaacaaactaacagtacgaccaccgcaacaataccgccgcgtctaggtagaaaggcaagtacttccaccctatcctacgaaagagatgacttacgaagaacgaaacttctaaactttancctagacaaagtgaacagcctaggaacgaacccgagaccgacgggtccttacttatttctgtacgtacaagtacgaaccgtaggaactaacgaacggtccggttaggtaaccgtgggttacttccggggg

SEQ ID NO: 426471 - DNA, 743 bp, Homo sapiens
  misc_feature: GZ8MTXP02J0MEB.3.17.B06.1.454.CMB.2.raw
  modified_base (381)..(381): a, c, t, g, unknown or other
  modified_base (536)..(536): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggagggtccctaagactctcctgtgcagcctctggactcaccttcacgctcaagtcggcccacgtacgtggacgtcggggtcccgccgaggcctccgagggggaaggggctggggaggttggggttcggccgtttagtagagaacaacaaactaaacngtaccgaaccacccgacaaacaacgtaccggcccggtcgtacgttaggtaaggaaaacgggctaaaggtactttacccgaaaccctattaccctaccgaaaaggtagaattcggaatttaccgaaaggaacgtaaaccttccttaaactttttanccgttagacctaaaaagttcggaaaaccagtaccccgttaaggaaaccgaaaaccccggacggaacccgaccggggttacccgttactttaagtttaacgttggttacgtaacctacgttaaacgaacccgttaaagggtaactaaacccggtaaacgggttaccggggttaggtttaacccgttagggggtttaactttccggggg

SEQ ID NO: 426472 - DNA, 703 bp, Homo sapiens
  misc_feature: GZ8MTXP02GZUUR.3.17.B06.1.454.CMB.2.raw
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcactggtggagtcgtgggggagcttggtccagcctggacgggtccctaagactctcctgtgcagcctctggactcaccttcacgctcaatcggccactacgtggactgggtccgcaggcctccgaggggacggggctaggggaggttggggttcggccgtttacgtaggacgaaccaactaaaccgtaaacgaggtaccgaccaccgacaacgaacgtaccggcccgtcggtctagggtaaggaaaacgggccaaagtacttacccaccctattcccgaagaaagtagaattggtaaacttcgaaaggtaacgaaacttccttaaacgttttatactagaacctaaaagttacgaaaccgtacggaccgtaaggaaaccggaaacccgacggaaaccggaaccggtaccgttacttaagtttactgggttacaactacgttaacgaaccgttaaaggaactaaaccgtaaaccggggtacgggttacggtaaaccgttggggttaactttccgggg

SEQ ID NO: 426473 - DNA, 602 bp, Homo sapiens
  misc_feature: GZ8MTXP02IQ4CY.3.17.B06.1.454.CMB.2.raw
  modified_base (256)..(256): a, c, t, g, unknown or other
  modified_base (301)..(301): a, c, t, g, unknown or other
  modified_base (455)..(455): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggagcttggtccagcctgggagggtccctaagctctcctgtgcagcctntggactcaccttcacgctcaatggccactacgtggactgggtccnccaggcctccgaggggagggctggagtggggttggccgttctagagacaacaactaaacagtcgaccaccgcaacaacgtaccgccgcgtctaggtagaaacggtcagacttcacctatcctacaagagatgattcaagagactctaactttanctagacaaaatcgaaacagaccctagaacgaaccgacgaaccgacggtacccgttactaagtttagttgttacgtactaacgtaacgtacctaagggaacttaacgaaacggtacggtacggtacccgttagggttactttccgggg

SEQ ID NO: 426474 - DNA, 661 bp, Homo sapiens
  misc_feature: GZ8MTXP02HCG6L.3.17.B06.1.454.CMB.2.raw
  modified_base (303)..(303): a, c, t, g, unknown or other
  modified_base (373)..(373): a, c, t, g, unknown or other
  modified_base (382)..(382): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggagcttggtccagcctggagggtccctaagctctcctgtgcagccctctggacctcaccttcacgctcaatcggccacgtacgtggactggggtccnccaggcctccgaggggaacggggctgggaggttggggttcggccgtttgtaggagaacacaaactaaacngtacgaccnccgacaacaataccgccgcgtctgtacgaaaaggccaagactttccacctatcctacaaaggagatagtattaccaaggaacgtaaacctctaaccttttagtccttagactaaaagtcgaaacagaccctagaaacggaaacccgacgacccgaacggtcccgttacttaaatttagtttcggacgttactaacgttaacggaacccgttaaagggaacttaaaccgaaacggtacggggttacggtaaccccgtttagggtaacgtttacccggggg

SEQ ID NO: 426475 - DNA, 687 bp, Homo sapiens
  misc_feature: GZ8MTXP02HS9T5.3.17.B06.1.454.CMB.2.raw
  modified_base (194)..(194): a, c, t, g, unknown or other
  modified_base (257)..(257): a, c, t, g, unknown or other
  modified_base (259)..(259): a, c, t, g, unknown or other
  modified_base (264)..(264): a, c, t, g, unknown or other
  modified_base (318)..(318): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtncacctggtggagtcgtgggggagcttgggtccagccgtgggacggtccctaagctctcctgtncngcctnggactcaccttcacgctacaagtcggaccacgtacgtggacttcggggtccccncgacggcctaccggaagggggaacggggcttggggagggtttggggtttcggcccggtttagtaaggagtaaccaacctaaaccgtaaccaggtacgaccaacccggcaacgaacgtaccggcccgcgttctaggtacgaaaaggccaaagtacttccaaccattccctagaagagtatggtaattacgaagtaacgtaaaccttacttaacttttactcgtagtaacaaaagttcgaaacctagaccctaggaaaccgaacccgacgtaaacccgccggggtaccttacgtttaaattacgttacgttcgtactaaagtaccggtaaccgttaaggaacgttaaaccgaaacgggtacggtttaccgg

SEQ ID NO: 426476 - DNA, 616 bp, Homo sapiens
  misc_feature: GZ8MTXP02GOOYS.3.17.B06.1.454.CMB.2.raw
  modified_base (309)..(309): a, c, t, g, unknown or other
  modified_base (351)..(351): a, c, t, g, unknown or other
  modified_base (378)..(378): a, c, t, g, unknown or other
  modified_base (393)..(393): a, c, t, g, unknown or other
  modified_base (417)..(417): a, c, t, g, unknown or other
  modified_base (422)..(422): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtgggggaggcttgggtccaggcctgggagggtccctaagactctcctgtgcagcctctggactcaccttcacgctcaatcggccactacggtggactcgggtcccncaggctccgaggggaggggctgggagtggggttggccgtttnagagacacaactaacagtcgacaccgnacaatccgcgcgtcngtagaaagcagtactcaccatcanaaagngatgacttcaagagaacctctaactttatctagactaaaatagaaactacggaccctaggaaacgaaacccgacgaacgtaccgggccttactagtttacttggtactactaactaacggtacccttaaagggaacttaaaccgaaacgggttaccggggttacgttaacccggtggggttaactttccggggg

SEQ ID NO: 426477 - DNA, 584 bp, Homo sapiens
  misc_feature: GZ8MTXP02JG25T.3.17.B06.1.454.CMB.2.raw
  modified_base (310)..(310): a, c, t, g, unknown or other
  modified_base (455)..(455): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggagggtccctaagactctcctgtgcagcctctggactcaccttcacgctcaatcggccactacgtggactggggtcccnccaggcctccgaaggggaagggcgtggaggtggggttggccgttctagagacacaaactacagtcacaccgcacaatacgccgcgtctgtagaaaggcagattcaccatcacaagagatgattacaagacgaaactcactttaanctagactaaaatcgaaacagaccctaggaaacaaacccggacgacgaccggggcccttacttaagtttacttagggtctacgaagtacggaccctaaagggaccttaacgaaacggacggtttaacggg

SEQ ID NO: 426478 - DNA, 684 bp, Homo sapiens
  misc_feature: GZ8MTXP02HR4XR.3.17.B06.1.454.CMB.2.raw
  modified_base (261)..(261): a, c, t, g, unknown or other
  modified_base (311)..(311): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcaccgtggtggaggtcgtgggggaggtcgttggtccagcctgggagggtccctaagactctcctgtgcagcctntggactcaccttcacgctcaatcggccactacggtggacctggggtcccnccgaggcctccgagggggaaggggctggggaggtggggttcggtccgtttgtaaggagaaaccaacaaactaacgagtccgaccaccgcaacaagtacccgccgtcgttctaggtagaaaacggcaagtacttcccgaaacctatacctacaaaggagtaattacggatttacgaaggtaacaaaccttactaactttttactaccgttagtactaaaattacggaaaccaacggaccccttaggaaaccgaaacccgggaaccgaaccgtaccggggtaccccttacttaacgtttagttagttcgttacaagtacgtaacctaaggtaactaacgaacggtacggtacggtaccgttggttacgttcgggg

SEQ ID NO: 426479 - DNA, 569 bp, Homo sapiens
  misc_feature: GZ8MTXP02GF06E.3.17.B06.1.454.CMB.2.raw
  modified_base (301)..(301): a, c, t, g, unknown or other
  modified_base (338)..(338): a, c, t, g, unknown or other
  modified_base (354)..(354): a, c, t, g, unknown or other
  modified_base (374)..(374): a, c, t, g, unknown or other
  modified_base (378)..(378): a, c, t, g, unknown or other
  modified_base (435)..(435): a, c, t, g, unknown or other
  modified_base (451)..(451): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtccctaagactctcctgtgcagcctctggactcaccttcacgctcaatggccactacgtggactgggccnccaggctccgaggggagggctggagtgggtgccgttnagagacacaactaacngtcacaccgcacaatccgcngtcngtagaaagcagacttccacatctcaaagagatgattcaagagtaactctaactttanctgactaaatgaaacngaccctaggaacgaaaccgcgaacacgggtacctactatttattgtgtaccaagttacgaccgttaaggaataaccgaacggtacgggttagtacccgttgggttaacgtttccgggg

SEQ ID NO: 426480 - DNA, 641 bp, Homo sapiens
  misc_feature: GZ8MTXP02FZEO3.3.17.B06.1.454.CMB.2.raw
  modified_base (306)..(306): a, c, t, g, unknown or other
  modified_base (480)..(480): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtggggggagcttggtccagcctgggacgggtccctaagactctcctgtgcagcctctggactcaccttcacgctcaatcggccactacgtggactgggtcccnccaggctccgaggggagggctgggaggtggggttggccgtttcaggagacaacgaactaacaggtcgacaccgcaacaagtaccgccgtcgtctaggtagaaaacgggcaagtactttccaaaccctattcctacaaaggagattagattacaagataaactctaaacttttancttagacaaattcggaaactacgcctaggaacgtaaaccgaccgaacgtaccgggtccttacttaatttagtttcgtacggtacctaagttaacggaccgttaaaggaactaaccgaaaacggtacggggtacgttaaccgtgggttaacgtttccggggg

SEQ ID NO: 426481 - DNA, 589 bp, Homo sapiens
  misc_feature: GZ8MTXP02I5FEU.3.17.B06.1.454.CMB.2.raw
  modified_base (429)..(429): a, c, t, g, unknown or other
  modified_base (457)..(457): a, c, t, g, unknown or other
  modified_base (473)..(473): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtccctaagactctcctgtgcagcctctggactcaccttcacgctcaatggccactacgtggactgggtccgccaggcctccgaggggaaggggctgggagtggggttggccgttctagagacaacaactaaacagtcgaccaccgcaacaataccgccgcgtctggtagaaaggcaagacttcaccatcctacaaganatagattacagaagaactcaacttttanctgactaaatgaaacngcctaggaacaaaccgacgacacggcccgttacttagttattggacttacagtaacgaaccttaagggaactaaccgaaacggtacgggtaggtacccgtgggttaacttccgggg

SEQ ID NO: 426482 - DNA, 546 bp, Homo sapiens
  misc_feature: GZ8MTXP02JEQ45.3.17.B06.1.454.CMB.2.raw
  modified_base (501)..(501): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccaccaggctccaggggaaggggctggagtggggttggccgtttctagagacacaactaacagtcgaccaccgcacaataccgccgcgtctgtgaaaggcagattcaccatctcaagagatgattcagagaactcactttatctagacaaatgaaacagacctagaacgaaacccgacgaaccacgggcccgtctattattgtntcatacgacctaggaatacaacgtacggtgtacctggtacttcgg

SEQ ID NO: 426483 - DNA, 624 bp, Homo sapiens
  misc_feature: GZ8MTXP02JXRRB.3.17.B06.1.454.CMB.2.raw
  modified_base (316)..(316): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcgtggtttccttgttagttatttacaaggtgtcagtgtgaggtgcaccgtggtggagtcgtgggggagcttggtccagcctggacgggtccctaagactctcctgtgcagcctctggactcaccttcacgctacaatcggacccacgtacggtggacgttcggggcccncgagggcctacgagggggaaggggtctggggaggttggggtcggccgttcgagacgtacaaccaactaacgagtacgaccaccgacacaataccggccgtcgtactggaaggaaacgccgtaagtacttacccaacccattaccctagaaagagtaatgtattcgaaaggaactacttactacttttacactaagaactaaagacgaactcgacctagaaaccgaaccgacgaccgccggtaccttattacgttacgtcgtatactaagtacgaacgtacggaacgtacggtaacggtacggttacgg

SEQ ID NO: 426484 - DNA, 724 bp, Homo sapiens
  misc_feature: GZ8MTXP02JK6ZY.3.17.B06.1.454.CMB.2.raw
  modified_base (312)..(312): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggagtcttggtccagcctgggagggtccctaagactctcctgtgcagcctctggactcaccttcacgctcaatcggccactacgtggacgtgggtcccnccgaggcctccggaggggaacggggcgtggggtaggtggggttcggccgttcgtaggacgacaacccaaactaacgagtcgaccaccgcacgaactaccgccgcgtactagtagaaacggcaagtacttaccaccgtattcctaacgaaaggagtaactagaaactttccgaaaggtaaccgtaaactttccttaaacgttttactacgtaacgtaaacctaaaagttacggaaaaccctcggtacccgtaaagggaaaaccccggaaaaccccggaaaccgggaaaccctaaaccgggggtcccccgttaaacgtttaacttttaacgttcggttacgttaaccaagtttaaacggaaacccgtaaaggggtaacctaaaacccggtaaacggggtaccgggtttaacggg

SEQ ID NO: 426485 - DNA, 570 bp, Homo sapiens
  misc_feature: GZ8MTXP02F4CKC.3.17.B06.1.454.CMB.2.raw
  modified_base (357)..(357): a, c, t, g, unknown or other
  modified_base (462)..(462): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagccgtgggacgggtccctaagctctcctgtgcagcctctggactcaccttcacgctcaatcggccactacggtggacgtggggtcccgcaggcctccgaggggaggggctgggaggtggggttggccgttnaggacgacaacaactacagtcaccaccgcacaataccgccgacgtctgtagaaagcagtaacttcaactatctacaagagtatgatcgaagacaactctatttanctagacctaaaatcgaaactagcctagaacgaacccgacgaccgacggccttactattacgttgacgtacaagtacgaactaggaactaacggacggtacggttacgg

SEQ ID NO: 426486 - DNA, 580 bp, Homo sapiens
  misc_feature: GZ8MTXP02G4TOH.3.17.B06.1.454.CMB.2.raw
  modified_base (303)..(303): a, c, t, g, unknown or other
  modified_base (310)..(310): a, c, t, g, unknown or other
  modified_base (326)..(326): a, c, t, g, unknown or other
  modified_base (363)..(363): a, c, t, g, unknown or other
  modified_base (460)..(460): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtgggggaggcttggtccagcctggagggtccctaagactctcctgtgcagcctctggactcaccttcacgctcaatcggccactacggtgactgggtccnccaggcnccgaggggaacgggcngggagtggggttggccgttctagagacacaactaacngtcgacaccgacaacaactacgccgcgtctggtacgaaaagcaagacttccaacatctacaaagagatgaattcagtaacgaactctaaacttttanactgtacaaaattcgaaacacgacctagaaacgaaccgacgaacgacgggacctacttagttatcgtgtactagtaacgacctaggaactacgaacgacggttgacctgggttactcggg

SEQ ID NO: 426487 - DNA, 635 bp, Homo sapiens
  misc_feature: GZ8MTXP02JMXL1.3.17.B06.1.454.CMB.2.raw
  modified_base (308)..(308): a, c, t, g, unknown or other
  modified_base (580)..(580): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggagcttggtccagcctgggaggtccctaagactctcctgtgcagcctctggacctcaccttcacgctacaatcggccacgtacggtggactcggggtccncaggcctaccgaggggaacggggctagggaggttggggttcggcccgtttcgtaaggacgaaccaaacaaactaaacgagtccgaaccaccgacaaccaatacccgccgtcgtacgtaggtaaggaaaacggcaagtattcccaaacctatccctagaaagtagattagattaccgaaggtaacaactcttaactttagtcctagaacctaaaagtcgaaaacacgaccctaaggaaacgaacccgacgaaccgacggtaccctattaattntcgtatcaatacgactaagaactaacgaacgaggttacgtacctaggtactcggg

SEQ ID NO: 426488 - DNA, 640 bp, Homo sapiens
  misc_feature: GZ8MTXP02FNYL7.3.17.B06.1.454.CMB.2.raw
  modified_base (306)..(306): a, c, t, g, unknown or other
  modified_base (367)..(367): a, c, t, g, unknown or other
  modified_base (380)..(380): a, c, t, g, unknown or other
  modified_base (433)..(433): a, c, t, g, unknown or other
tcagagacgcactccacgaccggtgctcgatttagtcgatagtgaagggggagagcggagccccatccccagaattcccaggtgttttcatttggtgatcagcactgaacacagaggactcaccatggagtttgggctgagctgggttttccttgttgttattttacaaggtgtccagtgtgaggtgcacctgggtggagtcgtggggggaggcttggtccagcctgggagggtccctaagactctcctgtgcagcctctggactcaccttcacgctcaatggccactacggtggactgggtcccncaggctccgaggggaagggctgggagtggggttcggccgttcaggagacaacaactaacgngtcgaccaccganaacaataccgccgcgtctggtagaaaaggcaagacttccaccatccacaaagngatgattcaagacgaaactctaaactttatactagaacaaaatcggaaaacacggtaccctaggaaaccgaaacccggacgaaccgaccggggccccttactaatttaacgtttggtacgttactaacgtaacgaacccttaaggggaacttaaaccggaaacggttacggggtacggttaacccgttggggttaactttccggggg

SEQ ID NO: 426489 - DNA, 694 bp, Homo sapiens
  misc_feature: GZ8MTXP02HRFDX.3.17.B06.1.454.CMB.2.raw
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtggggaggcttggtccagcctggagggtccctaagactctcctgtgcagcctctggactcaccttcacgctcaatcggccactacggtggactgggtcccgccaggctccgaggggaaggggctgggaggttggggtggccgtttcgtagagacaactaaactaacgagtcgaacaccgacaacaataccgccgtcgtactgtaggaaagcaagactccaccatcctacaaagagataggatttacgaagtaacgaaacccttactaacctttttaaatcctttacggaaactaaaacttaggaaaaccacgacccgtaagaaacggaaacccggaaccgaaccgaccgggtaccccggtttattaacgttttaacgtttcggtaagttacccgtaattaaaccgtacccgttaaaggggaacttaaaacccggaaaaccggggttacggttacgggtaaaccccggtttgggttaacggttttcccggggg

SEQ ID NO: 426490 - DNA, 540 bp, Homo sapiens
  misc_feature: GZ8MTXP02HV0Y8.3.17.B06.1.454.CMB.2.raw
  modified_base (301)..(301): a, c, t, g, unknown or other
  modified_base (336)..(336): a, c, t, g, unknown or other
  modified_base (362)..(362): a, c, t, g, unknown or other
  modified_base (377)..(377): a, c, t, g, unknown or other
  modified_base (432)..(432): a, c, t, g, unknown or other
  modified_base (488)..(488): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtacagtgtgaggtgcacctggtggagtcgtgggggagcttggtccagcctgggagggtccctaagctctcctgtgcagcctctggactcaccttcacgctcaatcggccactacgtggactgggtccncaggctccgaggggaggctggagtgggtgccgttnagagacacaactaacagtcacaccgnaacaatccgcgcgtngtagaaagcagatcaccatctacaagagatgacttcaagacgaactcaactttanctagacaaaatgaaacctgacctagaacgaaccgtacgacgacggctactattatntagcatacgacctaggaactaacgaacgtcggtagtaccgtggttactcggg

SEQ ID NO: 426491 - DNA, 653 bp, Homo sapiens
  misc_feature: GZ8MTXP02GKK65.3.17.B06.1.454.CMB.2.raw
  modified_base (304)..(304): a, c, t, g, unknown or other
  modified_base (426)..(426): a, c, t, g, unknown or other
  modified_base (444)..(444): a, c, t, g, unknown or other
  modified_base (512)..(512): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttatttacaaggtgtccagtgtgaggtgcacctggtggagtcgtgggggaggcttggtccagcctgggacgggtccctaagactctcctgtgcagcctctggactcaccttcacgctcaatcggccactacgtggactggggtccnccaggcctcgaggggagggctgggaggtggggttggccgtttctaaggacgacaacaactaacgaggtcgaccaccgcaaacgaatacccggccgcggtactggtagaaaacggctaaagtnttaccaacccatccctanaaagagattagaacttcgaaggaacgtaaacctctaaacttttactctagacaaaagttggaaaaccncggtaccgagaaacggaaaccccgacgaaccgacccgggtcccttataatttacgttggtattaccaattaccggaaccttagggaacttaaaccggaaacggtcgggttacggtacccgttggggttaactttccggggg

SEQ ID NO: 426492 - DNA, 549 bp, Homo sapiens
  misc_feature: GZ8MTXP02FLNUI.3.17.B06.1.454.CMB.2.raw
  modified_base (257)..(257): a, c, t, g, unknown or other
  modified_base (303)..(303): a, c, t, g, unknown or other
  modified_base (370)..(370): a, c, t, g, unknown or other
  modified_base (388)..(388): a, c, t, g, unknown or other
  modified_base (426)..(426): a, c, t, g, unknown or other
  modified_base (438)..(438): a, c, t, g, unknown or other
  modified_base (487)..(487): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgagtgcactggtggagtctgggggagcttggtccagcctggagggtccctaagctctcctgtgcagcctntggactcaccttcacgctcaatggccactacgtggactggggtccncaggctccgaggggaaggggctggagtggggttgccgttcagagacaccaactaacagtgacaccgnacaatacgccgcgtctgngaaaggcagattcaccatctacaagagatgattcaganaactcactttanctagacaaatgaaacagcctagacgaacccgacgacgaccgggccgttnttaacttacgttgtgttaccaagttacgacccttaggactaaccgaaccggtacggttacgg

SEQ ID NO: 426493 - DNA, 834 bp, Homo sapiens
  misc_feature: GZ8MTXP02F820U.3.17.B06.1.454.CMB.2.raw
  modified_base (314)..(314): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcaccgtggtggagtcgtgggggagcttggtccagcctgggacgggtccctaagacctctcctgtgcagcctctggactcaccttcacgctcaatcggcccacgtacggtggaccttcggggtccccnccaagggccttaccccggaagggggggaaacgggggtccttagggggtacggttcggggggtttcgggcccccggttttacgaagggacggaaacccaaaccgaaaccgttaaaaccgaggttaccgaaaccccacccggactaaacccgtaaagtaccccggcccgtcgggttcctagggtaacggaaaacgggtcctaaagggtactttcccgaaacctaattccctaagaaaaggtagtaacgttaaggtactttaccgaaaggtaactaaaaccttcttaaacgtttttaaccacgtaacgtaaactaaaagttacgaaaccgtacgaccgtaaggaaaaccgtaacccggaacgaacccggtaccgggttacctttacgttaaacgtttacgtttacggttaacgttaaccgtaaagttaacccggtaacggtaaaaccggtaaacgtaaacccgggtaaacggggtaccgggtttacgggttaacccggtttagggttaaccggtttccggggg

SEQ ID NO: 426494 - DNA, 603 bp, Homo sapiens
  misc_feature: GZ8MTXP02I9JOK.3.17.B06.1.454.CMB.2.raw
  modified_base (310)..(310): a, c, t, g, unknown or other
  modified_base (448)..(448): a, c, t, g, unknown or other
  modified_base (461)..(461): a, c, t, g, unknown or other
  modified_base (479)..(479): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagttggctgagctgggttttccttgttgttatttacaaggtgtccagtgtgaggtgcactggtggagtcgtgggggagcttggtccagcctgggacgggtccctaagactctcctgtgcagcctctggactcaccttcacgctcaatcggcccactacggtggacctggggtcccnccgaggcctccgaaggggaggggctgggagtggggttggccgttgtagacgacaccaaactaacagtcgaccaccgcacaacgtaccgccgcgtctgtagaaaggcagtacttcacatcacaagagatgattcaaganaactctactttanctagactaaatcgaaacngacctagaaaccgaaacccgacgaaccgaccgggtaccctatttaaacgtttagtttcggtacgttacaagttaaccgtaaccgtaaaggaacttaaaccggaaacgggtacgggtttaaccgg

SEQ ID NO: 426495 - DNA, 859 bp, Homo sapiens
  misc_feature: GZ8MTXP02GNQWC.3.17.B06.1.454.CMB.2.raw
tcagagacgcactccacgaccggtgctcgatttagtcgatagtgaagggggagctctgagagcggagccccagccccagaattcccaggtgttttcatttggtgatcagcactgaacacagaggactcaccatggagtttgggctgagctgggttttccttgttgttattttacaaggtgtcagtgtgaggtgcacctggtggagtcgtgggggaggcttggtccagcctgggacgggtccctaagactctcctgtgcagcctctggacctctaccttcacgctacaagtcggcccacgttacggtcggacgttcggggtccccgccgacgggcctacccggaagggggaacgggggtcgtagggggaggggtttcgggggtttcgggtcccggtttacgtaaggaaacggtaaccaaacctaaaaccgtaaaccgaggtacgaaacccgaacccggaccaaccgtaaacgtaccccggcccggtaccgttaccgtagggtaacggaaaacggggccaaggtaacctttcccgaaaccctattaccctaacgaaaacggtaacgtagttacggtaactttaacggaacggtaaacgtaaacctttccgtttaaactttttaacgttccgttaaggaaacccttaaaaaggttacggaaaaccgacggtaccccgtaaagggaaaacccgggaaaaccccggaaacggaaaaccccggtacccgggggttacccttaaaccgttttaaagttacggttttaacggttacggtaacctaaaacggttaaaccggtaaaacccggttagggaaaaccctttaaaccggaaaacccgggggtttacccgggtttaaccggggg

SEQ ID NO: 426496 - DNA, 574 bp, Homo sapiens
  misc_feature: GZ8MTXP02FTN52.3.17.B06.1.454.CMB.2.raw
  modified_base (256)..(256): a, c, t, g, unknown or other
  modified_base (264)..(264): a, c, t, g, unknown or other
  modified_base (359)..(359): a, c, t, g, unknown or other
  modified_base (482)..(482): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcacctgggtggagtcgtgggggagcttggtccagccgtggagggtccctaagctctcctgtncagcctcnggactcaccttcacgctcaagtcggacccactacggtaggactcggggtcccgccgaggcctccgaggggaggggctgggagtgggtggccgttnagagacacaactaacagtcgacaccgacacaaactacggccgtcgttcgtgtaggaaaacggcagacttcaaccatctacaagtagatgaattcaagacaactctatttacactgaactaaancgtaaacagcctagaacgaaccgacgaacgaccggtccgtactaattcttaggctacaagtacgacctaggataaacgacggacggttacgg

SEQ ID NO: 426497 - DNA, 672 bp, Homo sapiens
  misc_feature: GZ8MTXP02HIAMJ.3.17.B06.1.454.CMB.2.raw
  modified_base (305)..(305): a, c, t, g, unknown or other
  modified_base (362)..(362): a, c, t, g, unknown or other
  modified_base (406)..(406): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtggggggaggcttggtccagcctgggagggtccctaagactctcctgtgcagcctctggactcaccttcacgctcaatcggccactacgtggactgggtccnccaggctccgaggggacgggctgggagtggggtgccgttcagagacaacaactaacngtcgaccaccgcaacaataccgccgcgtctggtagaaagcaagnttccaccatcctacaaagagatgattcgaagaacgtaacctcgttaaactttatacctaggtaaccaaaaagttcggaaaacctacggaccccttaagggaaacccgaaacccggaccggaactaacccgggggtacccttacttaagtttaacgttgggttacttacctaaaggtaaccgtaacccgttaaggggaaaccttaaaccgaaacggggtaccggggtttacggtaaccccgtttaggggtttaacgtttcccggggg

SEQ ID NO: 426498 - DNA, 811 bp, Homo sapiens
  misc_feature: GZ8MTXP02H7QZK.3.17.B06.1.454.CMB.2.raw
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcactggtggagtcgtgggggaggcttggtccagcctgggagggtccctaagctctcctgtgcagcctctggattcacccttcacgctcaatcggccactacggtggactcggggtcccgccaggctccggaagggggaacggggcgtggggtacggttgggggtttacggggtcccgtttacgtacgggaacgaaccgtaaacctaaaaccttaaacggaacggttacccggaacccaacccccggacaaaaccgaaaacgttaccccgggccccggtccggttaccgtttagggtaaacggggaaaaaccggggctaaacgggtaaaccttttacccgaaacccccgttaagtccttaacccgaaaaaggttaacggaaagttagggttaaactttaccgaaagggtaaacgtaaaccctttaccgtaaacttttttaactacccgtaaggtaaacctaaaagttacgggaaaacctaacgaccccggtaaggaacccggaaaacccggaaccgaaccgtaccggggtaccccttattacgtttaagttgtacgttactaaagtacgtaccgttaaggaactaccgaacgggtacggttacgtaccgtgggtttacgtcgggg

SEQ ID NO: 426499 - DNA, 650 bp, Homo sapiens
  misc_feature: GZ8MTXP02GZS6D.3.17.B06.1.454.CMB.2.raw
  modified_base (381)..(381): a, c, t, g, unknown or other
  modified_base (463)..(463): a, c, t, g, unknown or other
  modified_base (468)..(468): a, c, t, g, unknown or other
  modified_base (492)..(492): a, c, t, g, unknown or other
  modified_base (508)..(508): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagttgggctgagcttgggttttccttgttgttattttacaaggtgtccagtgtgaggtgcacctggtggagtcgtgggggaggcttggtccagcctggagggtccctaagactctcctgtgcagcctctggactcaccttcacgctcaatcggcccactacggtggacctcggggtcccaccgaggcctccgaagggggaacggggctggggaggtggggttcggccgttgtaagacgacaacaaactaaacnggtaccgaacacccgacaacaaactaccgccgtcgtctggtaggaaaacggcaagtacttaccaaacctatcctacaaaganattanattcaagagaaactctaactttanctagacaaatgaaacngacctagaacgaaacccgagtaaccgacgggtcccttacgtaatttagtttcggtactaacattaaacgtacccgttaaaggaaaccttaacaaaaccgggggttacggttacggtaaccgttagggttaactttccggggg

SEQ ID NO: 426500 - DNA, 581 bp, Homo sapiens
  misc_feature: GZ8MTXP02ILJTM.3.17.B06.1.454.CMB.2.raw
  modified_base (255)..(255): a, c, t, g, unknown or other
  modified_base (289)..(289): a, c, t, g, unknown or other
  modified_base (301)..(301): a, c, t, g, unknown or other
  modified_base (340)..(340): a, c, t, g, unknown or other
  modified_base (344)..(344): a, c, t, g, unknown or other
  modified_base (357)..(357): a, c, t, g, unknown or other
  modified_base (384)..(384): a, c, t, g, unknown or other
  modified_base (388)..(388): a, c, t, g, unknown or other
  modified_base (411)..(411): a, c, t, g, unknown or other
  modified_base (431)..(431): a, c, t, g, unknown or other
  modified_base (436)..(436): a, c, t, g, unknown or other
  modified_base (445)..(445): a, c, t, g, unknown or other
  modified_base (463)..(463): a, c, t, g, unknown or other
tcagagacgcactccacgaccggtgctcgatttagtcgatagtgaagggggagagcggagccccatccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggagggtccctaagctctcctgtgcagcctntggactcaccttcacgctcaatcggccactacgnggactgggtccnccaggctccgaggggagggctgggagtgggtggccgttnaganacacaactaaacngtcgaacaccgacaacaataccgccgngtcngtagaaagcagattcacatccanaaagagatgacttcgaaganaactntaactttanctagacaaatcgaaaacngacctaggaaacgaaccgacgaacacgggcccttacgtatttattggtactacaagttacggaccttaaaggaattaaacccgaaaggttcgggtacgtaccgtagggttacttcggg

SEQ ID NO: 426501 - DNA, 760 bp, Homo sapiens
  misc_feature: GZ8MTXP02IP0SW.3.17.B06.1.454.CMB.2.raw
  modified_base (317)..(317): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcaccgtggtggagtcgtgggggagcttggtccagccgtgggacgggtccctaagactctcctgtgcagcctctggactcaccttcacgctacatggccacgtacggtcggacgtggggtcccnccgaggcctacccggaaggggaacggggcgtggggtagggttggggtttcggcccggtttacgaggaacgaccgaaccctaaacgtaacagtacgaacctaacccgacaccgaaagttacccggcccgtccgtacgttaggtaacggaaaaggccaagtactttaccaaccgtattaccgtaacaaaggtaacgattacggtattcgaaaggtaaactaaaccttacttaacctttttataccgtacggtaaactaaaagtttccgaaaacgtaacgtaccctaagggaaaaccgaaacccggaaccggaaacccgtaccggggtaccccgtttaactttaagttttacgttacgggtttactaaccgtaaattaaacccggtaaaccgttaaagggaaaactttaaaccccgggtaaacgggtaacggttttaacccggggg

SEQ ID NO: 426502 - DNA, 670 bp, Homo sapiens
  misc_feature: GZ8MTXP02HAU6W.3.17.B06.1.454.CMB.2.raw
  modified_base (306)..(306): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcactgggtggagtcgtgggggagcttggtccagcctggagggtccctaagactctcctgtgcagcctctggactcaccttcacgctacaatcggcccactacggtggactcggggtccnccgaggcctccggaggggaaggggctgggaggtggggttcggccgtttcgtagagaacaacaaactaacgagtacgacaccgacaacaagtaccgccgctctaggtagaaaagggcaagtacttcaacccatcctacgaaagagaattaggaattacgaaagactaaacttacctaaattttactcttagaactaaaattacggaaacacggtaccctaggaaaccggaaaccgaccggtaaccgaaccgggtaccgtttactaagttttacttaggtacgtactaacgtaacgtaaccggtaaaggtaacttaaaccggaaacggtacgggttacggtaccgttacgggttaagttcccgggg

SEQ ID NO: 426503 - DNA, 562 bp, Homo sapiens
  misc_feature: GZ8MTXP02IUECY.3.17.B06.1.454.CMB.2.raw
  modified_base (311)..(311): a, c, t, g, unknown or other
  modified_base (425)..(425): a, c, t, g, unknown or other
  modified_base (429)..(429): a, c, t, g, unknown or other
  modified_base (453)..(453): a, c, t, g, unknown or other
  modified_base (469)..(469): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggaggtccctaagctctcctgtgcagcctctggactcaccttcacgctcaatcggcccactacggtggaccttggggtcccnccgaggcctccgaggggaaggggctgggggtggttggccgttcgtagagacacaactaacagtgacaccgcaacagtacgccgacgtctgtagaaaggcagattcaccatctanaagnatgattacagacgactcactttanctagacaaatgaaacngactaggacgaacgacgacgaccggccgttactaattacttgtacgtcctataacgaccgtaggacttacgaaccggtacggtaggttacccg

SEQ ID NO: 426504 - DNA, 805 bp, Homo sapiens
  misc_feature: GZ8MTXP02IO2OS.3.17.B06.1.454.CMB.2.raw
  modified_base (257)..(257): a, c, t, g, unknown or other
  modified_base (294)..(294): a, c, t, g, unknown or other
  modified_base (310)..(310): a, c, t, g, unknown or other
  modified_base (553)..(553): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttatttacaaggtgtccagtgtgaggtgcacctggtggagtcgtgggggaggcttggtccagcctgggacgggtccctaagactctcctgtgcagcctntggactcaccttcacgctacaatcggaccactacggnggacctcggggtcccnccgacggctaccggagggggaacggggcttggggaggttcggggttacggtcccggtttcgtaggaacggacctaaaccgaaacctaaacgagttaccgaacccgacccgactaaacgaaacgttcccggcccgtcggtttccagggtacgaaagggtcaaggtacttaccaaaccctattaccctacgaaaaggacgtaattagtacttacgaagaaacgtaaacttcttaaaacctttttnaccgtagaaactaaaacgtacgaaaaccgcgtaccgtaacggaaacggtaaaccccggaacggtaaacccgtacccgggtaccgttttaaacgtaacgttttacgttacgggttaacgttaaccgtaaacgttaaaccggtaaaccccgttaaaaggggtaaacccttaaaaacccgggggtaaaccggggttaaccgggggtttaccgggtttaaccccggtttagggggtttaaaccgtttcccgggggg

SEQ ID NO: 426505 - DNA, 554 bp, Homo sapiens
  misc_feature: GZ8MTXP02JVZRZ.3.17.B06.1.454.CMB.2.raw
  modified_base (392)..(392): a, c, t, g, unknown or other
  modified_base (442)..(442): a, c, t, g, unknown or other
  modified_base (453)..(453): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagccgtggggggtccctaagactctcctgtgcagcctctggactcaccttcacgctcaatggccactacgtggactggggtccgcccgaggcctccgaggggaaggggctggagtggggtgccggttcagagacacaaactaacagtgacccaccgacacaatacgccgcgtcngtagaaaggcagatcacatctcaagagatgattcagagactacactttanctagacaaatnaacagcctaggaacgaaccgacgaacaccggaccgtacttacttagtgtacgtacatacgacctaggataacgacgacggtggtacctgtacgtcgtcggg

SEQ ID NO: 426506 - DNA, 571 bp, Homo sapiens
  misc_feature: GZ8MTXP02FFYZY.3.17.B06.1.454.CMB.2.raw
  modified_base (357)..(357): a, c, t, g, unknown or other
  modified_base (428)..(428): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggtttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcactgggtccgcaggctccgaggggaaggggctgggagtgggtctcgtagtttattacaatttctcggtaccanatactactcccgacccgtgaacgggccaattaaccatctccagacgacgtattacccgaagaactacggtntaatcttacaaatagaaacaaaccgtgaagacgccgaacacgacggtccctttatactgtcgcgagagattcggagtcgggttcgggacctcgacccgttggtacctacgtcgacttcgtcggtcggggccgtggcctacccg

SEQ ID NO: 426507 - DNA, 556 bp, Homo sapiens
  misc_feature: GZ8MTXP02FPV3O.3.17.B06.1.454.CMB.2.raw
  modified_base (308)..(308): a, c, t, g, unknown or other
  modified_base (346)..(346): a, c, t, g, unknown or other
  modified_base (361)..(361): a, c, t, g, unknown or other
  modified_base (432)..(432): a, c, t, g, unknown or other
  modified_base (464)..(464): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggagggtccctaagactctcctgtgcagcctctggactcaccttcacgctcaatcggccactacgtggactgggtccncgaggctccgaggggaagggctggagtgggtggcgttnagagacacaactaangtcacaccgcacaactacgccgctcgtgagaaaaggcagacttcaaccatctacaagagatgattcaaganaactactactttagtcagactaaatcgaaacnctccagaaacgaacccgacgacaccgggtcctactaactttacgttgcgtacaagtacgacctaaggaactaacgaaacggcggtttaacgg

SEQ ID NO: 426508 - DNA, 593 bp, Homo sapiens
  misc_feature: GZ8MTXP02JCGR1.3.17.B06.1.454.CMB.2.raw
  modified_base (305)..(305): a, c, t, g, unknown or other
  modified_base (489)..(489): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtccctaagactctcctgtgcagcctctggactcaccttcacgctcaatcggccactacgtggactggggtcccnccaggctccgaggggaagggctgggagtgggttggccgtttctaggagacacaaactaacagtcgaccaccgcaacaataccgccgtcgtctggtagaaaaggcaagtacttccaaccctatcctacaaagagatgattacgaagtaagtaacctctaactttatctagactaaaatcgaaacngacctagaacgaaccgacgacaccggcttatattatcgtagactaatacgacgtaagaacttaacgaccggtacggttacgtaccgttaggttacgttccgggg

SEQ ID NO: 426509 - DNA, 570 bp, Homo sapiens
  misc_feature: GZ8MTXP02HNJ2R.3.17.B06.1.454.CMB.2.raw
  modified_base (293)..(293): a, c, t, g, unknown or other
  modified_base (344)..(344): a, c, t, g, unknown or other
  modified_base (416)..(416): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctggggaggcttgatccagcctgggggtccctgagactctcctgtgcagcctctggcttcaccgtcagtagcagctacatgcacgtgggtccnccaggctccgaggggagggctggagtgggtctcgtagttatttacaattcnggtaccacatactactccgacccgtgaacggccgattaaccatcctccagacgacgattccgagaacaggtntatctacaaatgaacactgagacgccgacgacgacggtccgtttaatacgtgtgcgtagagtagtcgaggttcgggttaccggggaccttccgacccgttggttcctacgttcgacttccgtcgtcgggggtcccgtggcctacccgtggtccc

SEQ ID NO: 426510 - DNA, 562 bp, Homo sapiens
  misc_feature: GZ8MTXP02IIK4K.3.17.B06.1.454.CMB.2.raw
  modified_base (255)..(255): a, c, t, g, unknown or other
  modified_base (300)..(300): a, c, t, g, unknown or other
  modified_base (342)..(342): a, c, t, g, unknown or other
  modified_base (384)..(384): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctntggactcaccttcacgctcaatggccactacgtggactgggtccnccaggctccgaggggaagggctgggagtgggttggccgtttnaggagacacaactaaacagtcgaacaccgcaacaatacgccncgtctgtacgaaaaggcaagattccaaccatctcaaagagatgattcagagaactcaactttatctgacaaaatcgaaacagccctagaacgaacccgacgaaccacgggccctactaatttatcggtatcatacgacctaaggaactaacgaacgacggtgtacctggtatccgggg

SEQ ID NO: 426511 - DNA, 614 bp, Homo sapiens
  misc_feature: GZ8MTXP02FEHE3.3.17.B06.1.454.CMB.2.raw
  modified_base (256)..(256): a, c, t, g, unknown or other
  modified_base (307)..(307): a, c, t, g, unknown or other
  modified_base (358)..(358): a, c, t, g, unknown or other
  modified_base (381)..(381): a, c, t, g, unknown or other
  modified_base (466)..(466): a, c, t, g, unknown or other
  modified_base (481)..(481): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctggggggagcttggtccagcctgggagggtccctaagactctcctgtgcagcctnggactcaccttcacgctcaatggacccacgtacggtggacttggggccccnccaggcctaccgagggggaaggggtctggggaggtggggttcggccgtttnaggagaaccactaaactaaacgngtcgaccaccgctaacaataccggccgtcgtcgtgtacgaaaagggcaaggtacttcaaccattcacaagagatgattcaagtanaacttcaacttttanctagaactaaatacgaacacgtaccgagaacgaaccgacgaccgtacggacctacttattagttcgtacgtacaacgtaacgacgtaaggaactaacgtaacggtacggtacggtacgtacgttacggttacg

SEQ ID NO: 426512 - DNA, 587 bp, Homo sapiens
  misc_feature: GZ8MTXP02F1TJC.3.17.B06.1.454.CMB.2.raw
  modified_base (301)..(301): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggagggtccctaagactctcctgtgcagcctctggactcaccttcacgctcaatggccactacgtggactgggtccnccaggcctccgaggggagggctggagtgggtggccgttcagagacacaactacagtcgaccaccgcacaactaccgccgcgtctgtagaaagcaagtattcaacccatcctacaaagagatgattacagaacgaacttctaactttatctagacaaaagtcgaaacacgccctagaacgtaaacccggacgaaccgacggtcccgtacttaattattgtagtcaagtacgaccgttaaggaacttaacgaaacggtacgggttacgtaccgtggttacgttcgggg

SEQ ID NO: 426513 - DNA, 919 bp, Homo sapiens
  misc_feature: GZ8MTXP02FYIXW.3.17.B06.1.454.CMB.2.raw
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctgggaggtccctaagactctctgtgcagcctctggactcaccttcacgctcaatcggccactacggtcggacgtcgggtcccgccgaaggccttacccggagggggaacggggtcgtggggtacggttgggggtttcgggtccccggtttacgtaaggaacggtaaacccaaaccgtaaaactaaaccggtacggtacggaaaccccaaccccggacaaaccgtaaaacgtacccccggacccggtccggttaccttaggggtaaacgggaaaaacgggggtccctaaagggttaaaccctttacccaaaacccccgttacttaacccgtaacccgaaaaagggtaaacgttaacgtttaagggtaaacttttaaccgaaaagggtaacgtaaaaaccctttctttaaaacctttttaactaccgtttaacggtaaacccttaaaaaaggttacggtaaaacccgaaaccggtacccgttagggaaaaacccgggaaaaccccggaaccggtaaacccgggtaacccgggttacctttaaaccgtttaaacgttttaaacggtttcgggttaaacttaccgtaaagtttaaaaccggaccggtttaaaaacgggtaaccttaaaaccgggaaacccggggtttaaccgggttaccggggtaaacccgttttaggggttaaacggttttccccggggg

SEQ ID NO: 426514 - DNA, 624 bp, Homo sapiens
  misc_feature: GZ8MTXP02GMXP5.3.17.B06.1.454.CMB.2.raw
  modified_base (301)..(301): a, c, t, g, unknown or other
  modified_base (338)..(338): a, c, t, g, unknown or other
  modified_base (410)..(410): a, c, t, g, unknown or other
  modified_base (422)..(422): a, c, t, g, unknown or other
  modified_base (436)..(436): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtccctaagactctcctgtgcagcctctggactcaccttcacgctcaatggccactacgtggactgggccnccaggctccgaggggagggctggagtgggtgccgttnagagacacaactaacagtcgacaccgcaacaatacgccgcgtctgtagaaagcagattcaacatcacaaganatgattcaaganaactcaacttttanctagactaaaatgaaacacgcctaggaacgaaacccggacgaaccgaaccggggtcccttaacttaagtttagtttcggtacgtacgtaaacgttaacgtaaccccgttaaaggtaaaccttaaaccggaaaaccggggttacgggttacgggttaaaccctttagggggtttaacctttcccggggg

SEQ ID NO: 426515 - DNA, 715 bp, Homo sapiens
  misc_feature: GZ8MTXP02HK6AJ.3.17.B06.1.454.CMB.2.raw
  modified_base (312)..(312): a, c, t, g, unknown or other
  modified_base (464)..(464): a, c, t, g, unknown or other
  modified_base (635)..(635): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtgggggaggtcttggtccagcctgggacgggttccctaagaccttctcctgtgcagtcctctggactcacccttcacgctcatcggccactacggtggactcgggcccncgaggcctcggagggggagggctggggaggttgggtggcccgtttagagagacactaaactaacgtagacgacccaccgacaacaaactcccggccgtcgtcgttaggaaggaaacgggtcaagtactttaccgaaacccttataccctaanaaaagggtagtaataggttaacttacgaaacggtaaacttacccttacttaaaccgtttttataccttaaggaaacctaaaattaccggaaaacgttccgacccgttagaaacccggaaacccggacgttaacccggaccgtacccgtttatttaaagttttgtacggttntacctaagttacgaaccgttaaggaattaaccggaaccggttaacggggtcgttaacccttggggttacgtttcccgggg

SEQ ID NO: 426516 - DNA, 654 bp, Homo sapiens
  misc_feature: GZ8MTXP02H1XYA.3.17.B06.1.454.CMB.2.raw
  modified_base (257)..(257): a, c, t, g, unknown or other
  modified_base (385)..(385): a, c, t, g, unknown or other
  modified_base (435)..(435): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtggggggaggcttggtccagcctgggagggtccctaagctctcctgtgcagcctntggactcacccttcacgctcaatggcccactacgtggactcggggtccgccaggctccgaagggggaagggctagggaggtggggtttcggccgtttcaggagacaacgaactaaacagtgacaccgnaacaataccgccgcgtctagtagaaagtcaagattccacctagtacctanaagagagtagtactagaagaactactacttaaactttactactagaactaaaagtacgaaaccgacgtaccgtaggaaaccgaaaccgaacgtaaccgaccgggtaccgttacttaagtttacgttcgttacgtaacgtaacgtaacgtaaccgtaaggtaaccgtaaaccggtaaacgggtaccgggttacggtaaccggttagggtttaacgtcggg

SEQ ID NO: 426517 - DNA, 724 bp, Homo sapiens
  misc_feature: GZ8MTXP02G0T3Q.3.17.B06.1.454.CMB.2.raw
  modified_base (267)..(267): a, c, t, g, unknown or other
  modified_base (476)..(476): a, c, t, g, unknown or other
  modified_base (483)..(483): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcaccgtggtggagtcgtgggggagcttggtccagccgtggacgggtccctaagactctcctgtgcagcctcgnggtacctccaccttcaccgctcaatcggccacgtacggtggacgtcgggtcccgcgaggcctaccggaggggaaggggtcgtggggagggttggggtcggtcccggttagtaagacggtacaaccgaacctaacgagtacgacacccgactacgaacgtaccgcccgcgtacgtggtagaaaacggcaagacttaccgacctatcctanaaggtanacttagattacgaagtaacgtaaacttcttaaactttactccgtaagaacctaaaagtcggaaaacctaacgggccccttaagggaaaaccgggaaaccccgaaccgggtaaacccgaacccggggtacccctttagttaaaccgtttagttccgggtagttaaccctaaggtaacccggttaaacccgttaaagggtaaaactaaaccccgggtaaacgggttaccgggtttaaccgggg

SEQ ID NO: 426518 - DNA, 597 bp, Homo sapiens
  misc_feature: GZ8MTXP02H6ZUJ.3.17.B06.1.454.CMB.2.raw
  modified_base (261)..(261): a, c, t, g, unknown or other
  modified_base (363)..(363): a, c, t, g, unknown or other
  modified_base (383)..(383): a, c, t, g, unknown or other
  modified_base (394)..(394): a, c, t, g, unknown or other
  modified_base (474)..(474): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagccgtgggaggtccctaagctctcctgtgcagcctntggactcaccttcacgctcaagtcggacccactacgtggaccgtggggtccccgccaggcctccgaaggggaacggggctgggaggttggggtggcccgttntaagagtacacaactaaacngtgacaccganacaataccgccgcgtctgagaaacggcagattcaccatcctacaagtagatgattacgagaacgaacttcctaattttanactagaactaaagtacgaaacacgactaagaaacgaacccgacgaaccgacgtaccttagttaacttacgtacgtacgtactaagtacgaaccgtaggaactaaccggaacggttacggtacg

SEQ ID NO: 426519 - DNA, 645 bp, Homo sapiens
  misc_feature: GZ8MTXP02J0IPZ.3.17.B06.1.454.CMB.2.raw
  modified_base (256)..(256): a, c, t, g, unknown or other
  modified_base (344)..(344): a, c, t, g, unknown or other
  modified_base (365)..(365): a, c, t, g, unknown or other
  modified_base (437)..(437): a, c, t, g, unknown or other
tcagagacgcactccacgaccggtgctcgatttagtcgatagtgaagggggagagcggagccccagccccagaattcccaggtgttttcatttggtaatcagcactgaacacagaggactcaccatggagttgggctgagctgggttttccttgttgttattttacaaggtgtccagtgtgaggtgcacctggtggagtcgtgggggagcttggtccagcctgggagggtcccctaagactctcctgtgcagcctntggacctcaccttcacgctcaatggcccacgtacgtggactggggtcccgccaggcctccgagggaggggctggagtgggtgccgttnagagacacaactaacaggtanacccaccgcaacaacgtaccgcccgcgtcctggtacgaaaagggcaagtacttccaacctatctacaagganatgattcgaagaacgtaactactaactttatctaggaactaaagtacgaaactacgaccctaggaaaccgaacccggaccgaaccgaccgggtacccgttaactttacgtttaagttcggtacgttaccaagttaacgaacccgttaaaggaaccttaaccgaaaccgggtacggtacggttaacccgtggttacgttacgggtcggg

SEQ ID NO: 426520 - DNA, 548 bp, Homo sapiens
  misc_feature: GZ8MTXP02JFYGF.3.17.B06.1.454.CMB.2.raw
  modified_base (309)..(309): a, c, t, g, unknown or other
  modified_base (345)..(345): a, c, t, g, unknown or other
  modified_base (414)..(414): a, c, t, g, unknown or other
  modified_base (462)..(462): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttgggtccagcctggagggtccctaagctctcctgtgcagcctctggactcaccttcacgctcaatcggccactacgtggactggggtcccncaggctccgaggggagggctggagtgggtgccgttnagagacaccaactacagtgacaccgcacaactcgccgcgtctagtagaaaggcagattcaaccatctanaagagatgattcaagacaactctactttatctagactaaaatgaaacngcctagaacgaaccgacgacacggtcctattattacgttcgtagtacaagtacgaccgtaggaactaacgaacggtacggttacgg

SEQ ID NO: 426521 - DNA, 617 bp, Homo sapiens
  misc_feature: GZ8MTXP02GCVES.3.17.B06.1.454.CMB.2.raw
  modified_base (362)..(362): a, c, t, g, unknown or other
  modified_base (416)..(416): a, c, t, g, unknown or other
  modified_base (422)..(422): a, c, t, g, unknown or other
  modified_base (427)..(427): a, c, t, g, unknown or other
  modified_base (463)..(463): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggagggtccctaagactctcctgtgcagcctctggactcaccttcacgctcaatcggccactacggtggactcgggcccgccaggctccgaggggagggctgggagtggggttggccgttgtagagacacaaactaacngtacgaccaccgcaacaactacgccgcgtctggagaaacgcagacttcaacctntcctanaaganatagacttacgaagtaacgaacttcaacgttttacncgtagaactaaagtcgaaactacgccgtaacggaaccgaaaccgacgaaccgtaccggtaccttacttagtttacgtcggttactactaacgttacgtaacgtaaggtaactaacggaaacggtacggttacgtaccgttaggttacgtcgggg

SEQ ID NO: 426522 - DNA, 634 bp, Homo sapiens
  misc_feature: GZ8MTXP02GNC8R.3.17.B06.1.454.CMB.2.raw
  modified_base (260)..(260): a, c, t, g, unknown or other
  modified_base (315)..(315): a, c, t, g, unknown or other
  modified_base (376)..(376): a, c, t, g, unknown or other
  modified_base (547)..(547): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggagcttggtccagccgtgggacgggtccctaagcctctcctgtgcngcctctggactcaccttcacgctcaatcggccacgtacgtggacctggggtcccnccgaggcctaccggaagggggaacggggccggaggtcggggtctacgtaaatttatttagngggcgtagttgggttaagtacggtactacggcagtcctccggtggaccgacgggggccctaattccgaccctatcctacccagacgaactaatttacaaagtaatacgttgccttacttacaaatacgaaactaacctgaacgaaccgaggacacggacctatactattgngacgtaggtagtacggtaggtagtaagtggtgggttagttaacggtcgggggtaccgtacggggtacccgtcggtacctccgttccg

SEQ ID NO: 426523 - DNA, 754 bp, Homo sapiens
  misc_feature: GZ8MTXP02JPNFM.3.17.B06.1.454.CMB.2.raw
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcaccgtggtggagtcgtgggggagcttggtccagccgtggacggtccctaagctctcctgtgcagcctctggactcaccttcacgctcaagtcggaccacgtacggtggaccgttcggggtccccgccgacgggccgtaccggaagggggaacggggtcgtaggggtagggtttgggggttccggtcccggtttacgtaaggaacgtaaccaaacccctaaaacgttaaaccgaaggtaccggaacccaaccccggacaaccgtaaacgtacccggcccgtaccgttcgtagggtaacgggaaaacgggcctaaaggttaaccttacccaacctaacttacccgtaacgaaaagggtactaacgttagaaactttaccgaaacggtaaacttaaacccttcctttaaacgttttactccgtaagaacttaaaagtcggaaaactcggacccttaaggaaaccgaaacccggtaacaccggtaccggtccttattaacgtttacgtcgtagttacaagtaaccgaaccgttaaggactaaccggaacggtacggtttacgg

SEQ ID NO: 426524 - DNA, 597 bp, Homo sapiens
  misc_feature: GZ8MTXP02IIG5T.3.17.B06.1.454.CMB.2.raw
  modified_base (259)..(259): a, c, t, g, unknown or other
  modified_base (305)..(305): a, c, t, g, unknown or other
  modified_base (342)..(342): a, c, t, g, unknown or other
  modified_base (358)..(358): a, c, t, g, unknown or other
  modified_base (417)..(417): a, c, t, g, unknown or other
  modified_base (427)..(427): a, c, t, g, unknown or other
  modified_base (462)..(462): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtacagtgtgaggtgcacctggtggagtcgtggggggaggcttgggtccagcctgggagggtccctaagactctcctgtgcagcctntggactcaccttcacgctcaatcggccactacgtggacctgggccnccaggctcgaggggagggctgggagtgggtgccgttnagagacacaactaacngtcgacaccgcaacaagtaccgccgcggttctaggtaggaaaacgcagacttccaaccntctacaaagngatagattcaaggactaaacctctaaaccttttanactagaactaaagtacgaaactacgaccgtaggaaaccgaaaccggacgaaccgaccggtccttacttaattattcgtacacaagtaacgacgtaagaactaacgaaacggtcggtacgtaccgtggtacgtcgg

SEQ ID NO: 426525 - DNA, 599 bp, Homo sapiens
  misc_feature: GZ8MTXP02H7XG4.3.17.B06.1.454.CMB.2.raw
  modified_base (303)..(303): a, c, t, g, unknown or other
  modified_base (322)..(322): a, c, t, g, unknown or other
  modified_base (340)..(340): a, c, t, g, unknown or other
  modified_base (356)..(356): a, c, t, g, unknown or other
  modified_base (399)..(399): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggaggcttggtccagccgtgggagggtccctaagctctcctgtgcagcctctggactcaccttcacgctcaatggccactacgtggactgggtccncaggctccgaggggagggntggagtgggtggccgttntagagacacaactaanagtcgacaccgcaacaatcgcgcgtctgagaagcagatcacanctacaagagatgattcagtacgaactacaattttactccgttagactaaaacttgaaaccgtacgacctaggaaacgaaaccgtacgacgaccgggtacccgtagttaatttagtcgttacgtaactacgtaacgtaccgtaggtaaagttaccgaaaacgggtacggtaggtaacccgttaggtttaacgtttccgggg

SEQ ID NO: 426526 - DNA, 600 bp, Homo sapiens
  misc_feature: GZ8MTXP02JGBS6.3.17.B06.1.454.CMB.2.raw
  modified_base (255)..(255): a, c, t, g, unknown or other
  modified_base (305)..(305): a, c, t, g, unknown or other
  modified_base (438)..(438): a, c, t, g, unknown or other
  modified_base (454)..(454): a, c, t, g, unknown or other
  modified_base (473)..(473): a, c, t, g, unknown or other
  modified_base (484)..(484): a, c, t, g, unknown or other
  modified_base (490)..(490): a, c, t, g, unknown or other
  modified_base (503)..(503): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtcctaagctctcctgtgcagcctntggactcaccttcacgctcaatcggaccatacgtggacctcgggtccccncgaggcctccgaggggaggggctggggaggtggggttcggccgtttacgtaggagaaccactaaactaacagtcgaaccaccgcaacaaatacccggcctcgtctagtaggaaacggcaagtacttccaaccntccagaaaggatagtnaattacaaggaacaacttntaaaccgtttnacgtanaacaatacgaacncgtacagaacgaccgacgacgaccgtctacttaattgtcgtatacacgtaacacgttaagaactacggaacggtacggtgttacgtggtacgttcgg

SEQ ID NO: 426527 - DNA, 672 bp, Homo sapiens
  misc_feature: GZ8MTXP02JUCRW.3.17.B06.1.454.CMB.2.raw
  modified_base (314)..(314): a, c, t, g, unknown or other
  modified_base (361)..(361): a, c, t, g, unknown or other
  modified_base (499)..(499): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccaggccgtgggacgggtccctaagactctcctgtgcagcctctggactcaccttcacgctcaatcggccactacggtggactggggtcccnccgaggcctccgaaggggaaggggctagggaggtggggttgccgttnaggagacaccaactaacagtacgaccaccgcacaaataccggccgcgtctggtagaaaacgggcaagacttccgaaccctatcctacgaaaggagtagtagaatttccaaaggtacgtaaaccttctaaactttttanaccgttacgaaactaaaagttcgaaaaccgtacgtacccgtagaaaccggaaaaccccggacggaacccgaaccggggtccccttaattaagttttacgttcggttacgtactaaagttaccgaaaccttaggggaaactaacccggtaaaacggggtaccggtttaaccggg

SEQ ID NO: 426528 - DNA, 590 bp, Homo sapiens
  misc_feature: GZ8MTXP02F3EVB.3.17.B06.1.454.CMB.2.raw
  modified_base (303)..(303): a, c, t, g, unknown or other
  modified_base (379)..(379): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtggggggaggcttggtccagcctgggagggtccctaagactctcctgtgcagcctctggactcaccttcacgctcaatggccactcggtggactgggccnccaggcctccgaggggaacggggctgggaggtggggttggccgtttcgtagagacacaactaacagtcgacaccgnaacaatacgccgcgtctgtagaaaaggcaagattcaccatctacaaagagatgattcgaagagaaactctaactttatctagacaaaatcgaaacacgctaggaacgaaaccgacgaacacgggaccctactaatttattcgtatacaacgtacgaccttaaggaactaccgaaacggtacggggtcggttaacctgggttactaccgggg

SEQ ID NO: 426529 - DNA, 631 bp, Homo sapiens
  misc_feature: GZ8MTXP02IF6CX.3.17.B06.1.454.CMB.2.raw
  modified_base (260)..(260): a, c, t, g, unknown or other
  modified_base (355)..(355): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtggggggaggctttggtccagcctgggagggtccctaagactctcctgtgcagcctntggactcaccttcacgctcaatcggccactacggtggactgggtcccgcaggcctccggaaggggacggggctgggaggtggggttggccgtttntagagacaacaaactaacagtcgaaccaccgacaacaaacgtaccgcccgtgtctggtacggaaaacggcagatttccacctatctacaagagatgaattacgaagaagtaactctaaacttttagccttaagacaaatcgaaactacgaccgtagaacgaaacccggagaaccgacgggtaccttacttaagtttacgttagtacgtactagtaacgtaccgtaaggaacttaacgaacggtacgggtacggtttaccgtggttacgttccgggg

SEQ ID NO: 426530 - DNA, 554 bp, Homo sapiens
  misc_feature: GZ8MTXP02FN8FK.3.17.B06.1.454.CMB.2.raw
  modified_base (302)..(302): a, c, t, g, unknown or other
  modified_base (391)..(391): a, c, t, g, unknown or other
  modified_base (422)..(422): a, c, t, g, unknown or other
  modified_base (426)..(426): a, c, t, g, unknown or other
  modified_base (429)..(429): a, c, t, g, unknown or other
  modified_base (436)..(436): a, c, t, g, unknown or other
  modified_base (455)..(455): a, c, t, g, unknown or other
  modified_base (460)..(460): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcgtggtttctgtgtatttacaaggtgtcagtgtgaggtgcacctggtggagtcgtgggggagcttgggtccaggcctgggagggtccctaagactctcctgtgcagcctctggactcaccttcacgctcaatggccactacgtggactgggtccnctaggctccgagggaaggggctgggacgtggggttggccgttacaggacgacacctaaactacagtcgacaccgtcacgaatacgccgngtctagtgaaaggcagatcgaccattccganaganatnatcaganactactacttatactaganaatanacgacgacagacgaacgacgacgacgaccgtacttacttacgttacgtagtactaagtaacgtaacgtacgtacgtaacgtaacgtacggtacg

SEQ ID NO: 426531 - DNA, 649 bp, Homo sapiens
  misc_feature: GZ8MTXP02IL6R0.3.17.B06.1.454.CMB.2.raw
  modified_base (506)..(506): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtcagtgtgaggtgcacctggtggagtcgtgggggagcttggtccagcctgggagggtccctaagactctcctgtgcagcctctggacctcaccttcacgctcaatcggccactacggtggacgtggggtccccgccaggcctcccgagggggaacggggctggggagtggggttcggcccgtttgtaggagacaacaaactaaacgagtcgaaccaccgacaacaagtaccgccgcgtctagtaaggaaacgctaagactttcccgaacctattcctaacgaaaggagtaagttcggaaattaccgaaggaactaaacctcttaaacttttancctaaggtactaaaatcggaaaacacgccgtagaaacgaacccgaacggaccgaccgggtcccttatatttagttcgtactacatacgtacctaaggaacttaaaacgacggtacggtacgtaaccgtggtttaacgtcgggg

SEQ ID NO: 426532 - DNA, 568 bp, Homo sapiens
  misc_feature: GZ8MTXP02GPCIP.3.17.B06.1.454.CMB.2.raw
  modified_base (266)..(266): a, c, t, g, unknown or other
  modified_base (318)..(318): a, c, t, g, unknown or other
  modified_base (382)..(382): a, c, t, g, unknown or other
  modified_base (442)..(442): a, c, t, g, unknown or other
  modified_base (448)..(448): a, c, t, g, unknown or other
  modified_base (455)..(455): a, c, t, g, unknown or other
  modified_base (459)..(459): a, c, t, g, unknown or other
  modified_base (475)..(475): a, c, t, g, unknown or other
  modified_base (477)..(477): a, c, t, g, unknown or other
  modified_base (480)..(480): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtgggggagtcttggtccagccgtgggacgggtccctaagctctcctgtgcagcctcnggactcaccttcacgtctacaatcggccacgtacggtggacgtggggtcccncgaggcctccgaggggagggctgggagttggggttcggcctttgagacgacaaccgaaactaangtcgacaccgctacgaaactccggccgcgtctaggtagaaacggcagtactcaacatcanaaagtnatgatanaganactactattatactananaanacacacgacgacgacgaacgacgacgacgacgtactacttactacgtatactaacgtacgacgtacgtacgtacgacggtacggtacg

SEQ ID NO: 426533 - DNA, 734 bp, Homo sapiens
  misc_feature: GZ8MTXP02J3IRO.3.17.B06.1.454.CMB.2.raw
  modified_base (273)..(273): a, c, t, g, unknown or other
  modified_base (516)..(516): a, c, t, g, unknown or other
  modified_base (592)..(592): a, c, t, g, unknown or other
  modified_base (649)..(649): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccaggcctggagggtccctaagactctcctgtgcacgcctctggacctcctacctcncgtcacagcgcctacgtcggtcggtacggtccgggtcccgcgacggccgtacgggaagggggacgggtcggtaggggtagggttggggtccggtcccgttagtaggacgaaccaaaccgtaaaaccgtaacgtacggtacccgaacccgaccgaaccaaaccgtaacgtaccccggccggtccgtcgttacggaaacgggaacggcgaacgttacctacccaaacctcttaccaacgaaaagngttatcgtaactaacgagtaaacctacctttacgtttaaactttcacgacgaaacttaaaaggaccgaacgtaccnccggtaaacggaaacccgaaccggaccgaacggtcccggtctttaacttaagtttcngggttcctaactacgtaaccgtaaccgttaagaaccgtaaaccggacggggtacggtttactccggttaagggtttcgccggggg

SEQ ID NO: 426534 - DNA, 691 bp, Homo sapiens
  misc_feature: GZ8MTXP02I3011.3.17.B06.1.454.CMB.2.raw
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctgggagggtccctaagactctcctgtgcagcctctggactcaccttcacgctcaatcggccactacgtggactgggtcccgccaggctccgaggggaaggggctgggaggtggggttggcccgtttcgtaggagaccaacaaactaaacgagtccgaaccaccgacaacaacgtaccgccgtcgtctggtagaaagcaagtattccaccatcctacaaagtagatagacttacgaagaaacgtaaacctctaaacttttatacgtgtaacctaaaattcgaaaacctgacccgttaagaaaccggtaaacccgacggaaaccgtacccgggtaccctttaacttaacgtttatttacggtacgttaactaaacgttaacggtaaacccgttaagggtaaacttaaacccggaaacgggttaacccggggttacggttaacccgttaggggtttaaccgtttcccggggg

SEQ ID NO: 426535 - DNA, 639 bp, Homo sapiens
  misc_feature: GZ8MTXP02GZRWH.3.17.B06.1.454.CMB.2.raw
  modified_base (498)..(498): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtccctaagactctcctgtgcagcctctggactccaccttcacgctacaatcggccactacgtggactgggtccgccaggcctccgaggggaacgggctgggaggtggggttggccgtttctagagaccaacaaactaaacgagtcgaaccaccgacaacaactaccggcccgtcgtcctaggtacggaaaagccaaggacttcaccctaatccctagaaagtagatagtacttacaaaggaaacgtaacttaccttaaaactttttnaccttggaaacctaaaagtccgaaactacgcctagaacgaacccgacacgaccgggccttactattattgtagactagtaacgccgttaaggaacttaaccgaacggtacggttacggtaacctggggtaatttcccgggg

SEQ ID NO: 426536 - DNA, 656 bp, Homo sapiens
  misc_feature: GZ8MTXP02GUZ4U.3.17.B06.1.454.CMB.2.raw
  modified_base (303)..(303): a, c, t, g, unknown or other
  modified_base (343)..(343): a, c, t, g, unknown or other
  modified_base (347)..(347): a, c, t, g, unknown or other
  modified_base (361)..(361): a, c, t, g, unknown or other
  modified_base (371)..(371): a, c, t, g, unknown or other
  modified_base (467)..(467): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgttcagtgtgaggtgcacctggtggagtcgtgggggaggcttggtccagcctggagggtccctaagctctcctgtgcagcctctggactcaccttcacgctcaatggccactacggtggactgggtcccncaggctccgaggggagggctgggaggtgggttggccgttntagngacaacaactaacngtcacaccgnaacataccgccgcgtctaggtagaaaacggcaagacttccaacctatcctacaaagagatcgattcgaagaacgtaaaccttctaaactttttacnctacgaactaaaatcgaaactcggacctaaggaaaccgaaacccggacgaaaccggaccggtccccttaacttaagtttacgttcggtacgttactaaacgttaaccgtaaccgtaaacgggtaaactaaacccgtaaaccggggtacgggttacggttaacccgttaggggtttaacggtttcccggg

SEQ ID NO: 426537 - DNA, 764 bp, Homo sapiens
  misc_feature: GZ8MTXP02FJNNK.3.17.B06.1.454.CMB.2.raw
  modified_base (404)..(404): a, c, t, g, unknown or other
  modified_base (556)..(556): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtcagtgtgaggtgcaccgtggtggagtcgtggggggagcgttggtccagccgtgggacgggtccctaagctctcctgtgcagcctctggacctcaccttcacgctacaatcggcctacgtacggtggacgtggggtccccgcgaggcctaccggagggggaacggggctggggaggtggggttcggtccgttcgaggacgaacaacaaactaacgagtacgaccaccganaacaacgtaccgccgtcgtcgtggtaagaaacggcaagtacttaccaaaccctatccctaacgaaaaggagaacgttagaacttacgaaaggaaacttaaacctacttaaacttttaataccttacggaaactaaaaagtacgggaaaaccncggtaacccgtaagggaaaacccgtaaacccccggaaacggtacccgaaccggggttaccccgttaactttaaaagttttacggtttaggtacgttaccgtaaacgttaaaaccgaacccggttaaaaggtaaccgtaaaacccggtaaaaccggggttaccggggtacggtttaacccggtttaaggggtttaccgtttcccggggg

SEQ ID NO: 426538 - DNA, 681 bp, Homo sapiens
  misc_feature: GZ8MTXP02G3WG6.3.17.B06.1.454.CMB.2.raw
  modified_base (257)..(257): a, c, t, g, unknown or other
  modified_base (305)..(305): a, c, t, g, unknown or other
  modified_base (347)..(347): a, c, t, g, unknown or other
  modified_base (363)..(363): a, c, t, g, unknown or other
  modified_base (375)..(375): a, c, t, g, unknown or other
  modified_base (430)..(430): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtccctaagactctcctgtgcagcctntggactcaccttcacgctcaatcggaccactacgtggactggggtccnccaggctccgaggggaagggctgggagtggggttggccgttntagagacacaactacngtacgacaccgnaacaataccgccgcgtctggtaggaaacgcaagattccacctatcctacaagganatagattacgaagaacgtaactctaaacttttatacgtagtaacctaaaatcggaaaacctacggacccgttaaggaaaccggtaaaaccccggaccggaaacccgtaaacccgggggccctttaaacgttaacgttttaacgttcggttacggtaacctaaagttacggaaccccgtttaaagggaactaaaccgaaaacggtaccggggttagggttaaaccccgttggggtttaaacgtttcccgggg

SEQ ID NO: 426539 - DNA, 649 bp, Homo sapiens
  misc_feature: GZ8MTXP02IDBYW.3.17.B06.1.454.CMB.2.raw
  modified_base (355)..(355): a, c, t, g, unknown or other
  modified_base (386)..(386): a, c, t, g, unknown or other
  modified_base (538)..(538): a, c, t, g, unknown or other
tcagagacgcactccacgaccggtgctcgatttagtcgatagtgaagggggagagcggagccccagccccagaattcccaggtgttttcattttggtgatcagcactgaacacagaggactcaccatggagtttgggctgagctgggttttccttgttgttattttacaaggtgtacagtgtgaggtgcacctgggtggagtcgtggggggaggcttggtccagcctgggacgggtccctaagactctcctgtgcagcctctggactcaccttcacgctcaatcggccactacgtggacgtgggtcccgcaggcctccgaggggaaggggctgggaggtggggttcggccgtttntaggagacacaaactaacagtcgaacaccgnaacaataccggccgtcgtctagtacgaaaaggtcaagtattccacctatcacaagagattgattcgaagacgtaaactctaacgttttatccgtagaactaaaatcgaaactagaccgtagaacgaaaccgacgaccgacggtaccccgttnttaacgtttagtcgttaggttacaaacgtttacgaaacccgttagggaaattaacccgaaacggggtaaccgggttggttaacccgtttgggtttaaacgtttcccggggg

SEQ ID NO: 426540 - DNA, 629 bp, Homo sapiens
  misc_feature: GZ8MTXP02GTO25.3.17.B06.1.454.CMB.2.raw
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctgggaggtccctaagctctcctgtgcagcctctggactcaccttcacgctcaatcggccactacgtggacgtcgggtcccgccgaggcctccggaaggggacggggctgggaggttggggttggtccgttgtagagacaaccaactaacagtgaccaccgcacaactaccgccgcgtcgtggtagaaaggcagactcaacatcacaagatagtgtatacgaagtagaaacttctactttatccgtagtaacaaagtagaaacacgtaccgtagaacgaaacccggaacgtacccggaccggtacccggttacctttaaggtttacttacgttacgttacgaacgtaacgtaacccgtaaagggtacctaaaacggtaaccgggtaccgggtttaaccgggg

SEQ ID NO: 426541 - DNA, 716 bp, Homo sapiens
  misc_feature: GZ8MTXP02J1DHA.3.17.B06.1.454.CMB.2.raw
  modified_base (535)..(535): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcgttggtccagccgtgggacgggtccctaagacctctcctgtgcacgcctcgtggacctcaccttcacgctacaatcggccactacgtggacgtcggggtcccgccgacggcctccgaggggaacggggctaggggaggttggggttggtcccggtttactaggacgacaacaaactaacgagtacgaccaccgacaacaacgtaccgcccgtcggtcttaggtaggaaacggcaaggtacttcccaaaccctataccctacgaaaaggtagtaacttaggtaacttaccgaaaggtaacgaaaccttactaaacctttttaanaccgtagaactaaaagtacggaaacctacgacccgtaaggaaccggaaacccgaccggaaccgaccgggtaccgttacttagtttacgttacggttactactaacgtaccgtaaccgttaaggtaaccgttaaaccggaacgggttaccgggttacggtaccggtttagggttacgtcggg

SEQ ID NO: 426542 - DNA, 766 bp, Homo sapiens
  misc_feature: GZ8MTXP02FPKUB.3.17.B06.1.454.CMB.2.raw
  modified_base (257)..(257): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagacttggtccagcctgggagggtccctaagactctcctgtgcagcctntggactcaccttcacgctcaatcggccactacggtggactcgggccgccgaggcctaccgagggggaacggggctaggggaggtggggttcggccgtttacgtaggaacggaccaacgaaactaaacaggttaccgaaccacccggacaaacaacgttaacccggcccgtcggtcctagggtaggaaaacggggtccaaaggtacttaccaaaccctaattaccctaacgaaaaggaagtaacttaggaactttaaccgaaagggtaaactaaaacccttcttaaactttttacgaccgttaaggaaaccttaaaaagttcggaaaaacctacggacccgttagggaaaaccggtaaaaccccggaccggaaaccgtacccggggtaacccttaacgtttaaagtttacgttaggtacgttaacctaacgttaaacgtaacccgtaaaggaacttaaaccggaaacgggttacgggttacggttaaccgtaggttaacgtttccggggg

SEQ ID NO: 426543 - DNA, 738 bp, Homo sapiens
  misc_feature: GZ8MTXP02G0ZHQ.3.17.B06.1.454.CMB.2.raw
  modified_base (308)..(308): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtgggggaggcttggtccagcctgggagggtccctaagactctcctgtgcagcctctggactcaccttcacgctcaatcggccactacggtggactcggggtcccnccgaggcctccgaggggaaggggcgtgggaggtggggttcggccgtttcgtaggagaccaacgaaactaacgagtcgaccaccgacaacaacgtaccgccgcgtctaggtaggaaaaggcaagtacttccgaaccctattcctacaaaggagtaattggaacttacgaaaggaacgtaaaccttcttaaactttttatccgttaaggaaacctaaaattcgggaaaacctacggtacccgttaagggaaaccggaaacccggaccgaaacccgaccggggtacccctttattaaacgtttacggtttaggtacgttaacctaacgttaaaccggtaacccgtttaaaagggaaccgtttaaaacccgaaaaccgggggttacgggttaccgggtttaacccgtttagggggtttaacgtttccccggggg

SEQ ID NO: 426544 - DNA, 673 bp, Homo sapiens
  misc_feature: GZ8MTXP02H1NZF.3.17.B06.1.454.CMB.2.raw
  modified_base (300)..(300): a, c, t, g, unknown or other
  modified_base (399)..(399): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtggggggaggtcttggtccagccgtgggacgggtccctaagactctcctgtgcagcctgtggacctctaccttcacgctcaatcggaccacgtacgnggacgtgggtcccgccaggcctcggaggggaggggctggggaggtggggttggccgttgagacgacaaacaactaacagtcgaaccaccgacaaccaanacccggccgtcggttactaggtacggaaagggcctaaggactttacccacctataccgtaacgaaagagtaatgtaactcgaaaggactaaacttcttaaacttttactcgtacgtaagtaaaatcggaaacacgacccgtaaggaaaccggaacccggaaacgaccgaaccggttacccttattaatttacgttcgttacgacttaacgtacgtaaccgtaggaactaaccggaaacggtacggggtcgtttaaccgtcggtttacggtcggg

SEQ ID NO: 426545 - DNA, 785 bp, Homo sapiens
  misc_feature: GZ8MTXP02HU6EM.3.17.B06.1.454.CMB.2.raw
  modified_base (316)..(316): a, c, t, g, unknown or other
  modified_base (405)..(405): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttcttgttgttattttacaaggtgtccagtgtgaggtgcactggtggagtcgtgggggagcttggccagcctggaggtccctaagactctctgtgcagcctcgtggacctcaccttcacgtctacaagtcggcctacgtacggtggaccgtggggtccccnccgtagggcctaccggaagggggacggggcgtagggagggttggggttcggcccggtttataaggacgaaccaacctaaaacgttaacngtacgacacccggacaccaaagtaccgcccggtaccgttctagggtagaaaacgggctaaacgtactttacccaaccgaattacccgtaacaaaagggtgtaaactttggaaaactttccggaaaaggttacggtaaaaaccccttttattaaaccctttttaatcgttaaacggaaacctaaaaaattccggggaaaaccacggtaacccttaaggggaaaacccgaaaaaccccgggtacgaaaacccgggtaacccgggttccccgtttaaactttaaagtttacggtttcggttacgtaacccgtaaagtttaaaaccgaacccgtttaaaagggaactttaaaaacccggaacgggtttaaccggggtttaccgg

SEQ ID NO: 426546 - DNA, 578 bp, Homo sapiens
  misc_feature: GZ8MTXP02JRQIH.3.17.B06.1.454.CMB.2.raw
  modified_base (314)..(314): a, c, t, g, unknown or other
  modified_base (351)..(351): a, c, t, g, unknown or other
  modified_base (363)..(363): a, c, t, g, unknown or other
  modified_base (366)..(366): a, c, t, g, unknown or other
  modified_base (372)..(372): a, c, t, g, unknown or other
  modified_base (376)..(376): a, c, t, g, unknown or other
  modified_base (386)..(386): a, c, t, g, unknown or other
  modified_base (456)..(456): a, c, t, g, unknown or other
  modified_base (462)..(462): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtggggggagcttggtccagcctgggagggtccctaagctctcctgtgcagcctctggactcaccttcacgctcaagtcggcccactacggtggacgtcgggtcccncgaggctccgaggggagggctggagtgggtgccgttnagagacaccaanacngcgacnccgnacatcgccgngtctagagaaacggcagtattacaccatcacaagacgatgattcgaaggtaactaacttactaactttanccgtanaacaaatacgaacacgcctaggaacgaacccggacgaccgaccggtaccgtacttaattacgttgtacgtactaagtaacgacccgtagaactaaccgaacggtacggtttacggg

SEQ ID NO: 426547 - DNA, 650 bp, Homo sapiens
  misc_feature: GZ8MTXP02FMJ3E.3.17.B06.1.454.CMB.2.raw
  modified_base (260)..(260): a, c, t, g, unknown or other
  modified_base (310)..(310): a, c, t, g, unknown or other
  modified_base (376)..(376): a, c, t, g, unknown or other
  modified_base (389)..(389): a, c, t, g, unknown or other
  modified_base (574)..(574): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtggggggaggcttggtccagccgtgggacgggtccctaagctctcctgtgcagcctntggactcaccttcacgtctcaatcggccactacggtggactggggtcccncgaggcctccgaggggaagggctagggaggtgggttcggccgttgtagacgaacacaaacgtaacngtacgaccaccgnaacaactaccgccgcgtctagggtagaaaaggccaagtatttcccaacccataccctagaaagagaagtagacttacaaaggaactaaaaccttctaaactttacgtacgtacgtactaaaattacgaaacaacggactacggaaacgaaccgaccgaacgtaccggacccgttatacttatttntaactacacgtaacgtactaacggaataacgtaaacggacggttacggtaaccgtaggtcgtttaaaaaaacgggg

SEQ ID NO: 426548 - DNA, 748 bp, Homo sapiens
  misc_feature: GZ8MTXP02JWYM3.3.17.B06.1.454.CMB.2.raw
  modified_base (257)..(257): a, c, t, g, unknown or other
  modified_base (573)..(573): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcaccgtggtggagtcgtgggggagcttggtccagccgtgggaggtccctaagactctcctgtgcagcctntggacctccaccttcacgctacaatcggccacgtacgtggactcggggtcccgaccgaggcctaccggaagggggaacggggcgttaggggaggttggggttcggtcccggtttagtaaggacgtaaaccaaactaaaccgtaaacgaggtaccggaaccacccgacaacaacgtaccggccgtcgtcgtaggtaggaaacgctaaaggacttaccgaacctagtacctacgaaagtacggtaatcggaacttaccgaaagtaacgtaacccttactaaaccttttagcccttaagacctaaaaatcggtaaaacncgtacccgtaagaaacgaaacccggacgaaaccgtaccgggtacccttactttaagttagtttacggtacgtaactaaacgttaaccggtaaaccgttaaacgggtaactaaacccggtaaaacggggtaccgggtttacgggtaacccgtttaggggtttaactttccgggggg

SEQ ID NO: 426549 - DNA, 728 bp, Homo sapiens
  misc_feature: GZ8MTXP02F3ZCK.3.17.B06.1.454.CMB.2.raw
  modified_base (338)..(338): a, c, t, g, unknown or other
  modified_base (354)..(354): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctgggacgggtccctaagactctcctgtgcagcctctggactcaccttcacgctcaatggccactacgtggactgggtcccgcaggctccgaggggagggctggagtggtgccgttnagagacacaactaacngtcgacaccgcacaataccgcgcgtctggtagaaacggcaagtacttaccaaccctatcctacgaaaagagtaagtaggaactttaccgaaagggtaacgtaaaacccttacttaaacttttttaaacctaccgtaacgtaaaccttaaaagtaacgaaaaccgtaccggtacccgtaaggaaaacccggtaaacccggaacccggaacccggtacccgggtaccctttaacttaaacgttttacgtttacggttacgttaaccgtaaacgttaaccgtaacccggttaaaggtaaaccgttaaacccggtaaaccggggttaccggggtttaaccggtttacccggtttacggggtttaccggtttccggggg

SEQ ID NO: 426550 - DNA, 634 bp, Homo sapiens
  misc_feature: GZ8MTXP02HTMUX.3.17.B06.1.454.CMB.2.raw
  modified_base (346)..(346): a, c, t, g, unknown or other
  modified_base (364)..(364): a, c, t, g, unknown or other
  modified_base (446)..(446): a, c, t, g, unknown or other
  modified_base (525)..(525): a, c, t, g, unknown or other
  modified_base (572)..(572): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtggggaggcttggtccagcctggagggtccctaagactctcctgtgcagcctctggactcaccttcacgctcaatcggccactacgtggactcgggtccgccaggcctaccgaggggagggctgggagtggggttcggcgtttntagagacactaaactaanagtccgaacacccgacaacaaatacccgccggtcgtctaggtacgaaagggccaagtaacttccacccgtaattacccgtanaaaagtggaattacgtaatttaccgaaagacgtaaacctccttaaacttttctactacggtaacaaaagtagaaacccngaccctagaaacgaccgacgacgacggcccttagtatttacgtacgngttacagttacgaaccgtagaacgttaacgaaacggtcggtagtaccctggttacttcgggg

SEQ ID NO: 426551 - DNA, 761 bp, Homo sapiens
  misc_feature: GZ8MTXP02G8ZW6.3.17.B06.1.454.CMB.2.raw
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcacgtggtggtaggtttgggggaggtcttggtccagccgtgggacggtcctaagactctcctgtgcagcctctcggactccaccttcacgtctacaagtcggacccacgttacggtcggaccgtcggggtccccgccgagggtcccgtaccgggaagggggtaacgggggcgtaggggtagggtttcgggggtttacgggtcccggtttacgtaaggaacggaaacctaaccgaaaacctaacgaggtacgaaccaccggacaaaccgacgtacccggcccgtacgttccgtagggtaacggaaaacggcctaaagtacctttaccaacctagtacctacgaaaaggtagagttacgtaacgttacgaaacggtaaataaaccccttactttaaacttttacgactttaacggaaactaaaacgtacggaaactacgtaccgtaaggaaaccgtaaacccgaccggtaactacccgggttacttactttaagttagttcgtacgtactaaacgtaacggaaccgttaaggtaacctaaccggaaacggttcggtaacggtttaccgg

SEQ ID NO: 426552 - DNA, 619 bp, Homo sapiens
  misc_feature: GZ8MTXP02JM93C.3.17.B06.1.454.CMB.2.raw
  modified_base (276)..(276): a, c, t, g, unknown or other
  modified_base (305)..(305): a, c, t, g, unknown or other
  modified_base (611)..(611): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcaccgtggtggagtcgtgggggaggcttggtccagccgtgggggtccctgagactctcctgtgcagcctctggcttcaccgtnagtgcagctacagtcgcacgtcggtcccncgacggctaccgaggggaagggctgggaggtggtctcgtagtttattactaattccgtacggtaccactactacctacctcccgacccgtgaacgggccgtaactaaccactcctacccaagagaacgtacgttaccgagaaacgtacgtagtactacttaacaaaatacgaaaccaaccgtagaacgtacgaccgacgaaccgaccgtacctttatacgtgcgagagagtacgttgaggttcgggtaccgggacctccgtacccgttggttacctaacgtcctagtccgtacggtcgggtacccnggtccccg

SEQ ID NO: 426553 - DNA, 632 bp, Homo sapiens
  misc_feature: GZ8MTXP02HW5GG.3.17.B06.1.454.CMB.2.raw
  modified_base (258)..(258): a, c, t, g, unknown or other
  modified_base (533)..(533): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcaccgtggtggagtcgtgggggagcttggtccagcctgggagggtccctaaagactctcctgtgcagcctntggactccaccttcacgctcaatcggccactacggtggactcggggtccccgcaggcctccgagggggaaggggctgggaggtggggttcggccgtttacaggagaacacaaactaacgaggtccgaccaccgacaacaaataccgccgtcgtctaggtacgaaaaggcaagtacttccaacctatctacaaagagatagaattcaaggaataacctctaacgtttatctgtaaccaaagttacgaaacagcctaggaaacgaaccggtacaacnccggggtacctacgttattagttgtactactaacgtacgaaccgtaggtaaactaccgaaaacgggttacggttacgtaccgtgggtttaactccgggg

SEQ ID NO: 426554 - DNA, 581 bp, Homo sapiens
  misc_feature: GZ8MTXP02FHCL3.3.17.B06.1.454.CMB.2.raw
  modified_base (241)..(241): a, c, t, g, unknown or other
  modified_base (296)..(296): a, c, t, g, unknown or other
  modified_base (333)..(333): a, c, t, g, unknown or other
  modified_base (447)..(447): a, c, t, g, unknown or other
  modified_base (457)..(457): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggtttccttgttgttattttacaaggtgtccagtgtgaggtgcacctgtggagtctggggagcttggtccagcctggagggtccctaagactctccngtgcagcctctggactcaccttcacgctcaatggccactacgtggactgggtccncaggctccaggggaagggctggagtgggttgccgttnagagacacgaactacagtgaccaccgctacagtaccgccgtcgtctggtacgaaagggcaagattccaaccagtcctacaagagactgaattcaagagaaacctcaactttacnctagacaaancgaacacgaccgtagaacgaacccgacgacgaccggtccttacttattattgtacgtacaacgtaaccgaacgtaacggaactaaccgaaaccggtacggttacgtacgtcggtacgttccggg

SEQ ID NO: 426555 - DNA, 625 bp, Homo sapiens
  misc_feature: GZ8MTXP02FWNM4.3.17.B06.1.454.CMB.2.raw
  modified_base (262)..(262): a, c, t, g, unknown or other
  modified_base (482)..(482): a, c, t, g, unknown or other
  modified_base (509)..(509): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcaccgtggtggagtcgtgggggagcttggtccagcctggacggtccctaagctctcctgtgcagcctntggactcaccttcacgctacaagtcggcccacgtacggtggacgtcggggtccccgccgaggcctaccggaagggggaacggggtcgtaggggagggttcggggttcggtcccgtttacgaaggaacgaccaaccaaaactaacgagtacgacacccgacacgaactaccggccgacgttctaggtagaaacggcaagtacttccaacctatcacaaganatgattcaagagaaccttctactttanactagactaaatcgaaactagccctagaacgaacccgaacgaccgaccggtccttacttaattagttcgtacgtacaagtaacgacctaaggactaaacgaacggtacgggttacg

SEQ ID NO: 426556 - DNA, 684 bp, Homo sapiens
  misc_feature: GZ8MTXP02FKHEW.3.17.B06.1.454.CMB.2.raw
  modified_base (384)..(384): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcgtgggttttccttgttgttattttacaaggtgtccagtgtgaggtgcacctggtggagtcgtgggggaggcttggtccagcctggagggtccctaagactctcctgtgcagcctctggactccaccttcacgctcaagtcggccactacggtggactggggtcccgccgaggcctccgaggggaaggggctgggaggtggggttggccgttcaggagacaacaactaacagtccgacaccgnaacaaataccggccgtcgtctaggtagaaaaggcaagacttaccaaccattcctacgaaagagaattgaatttacgaaggtaactaaacctcttaacttttaactccttaggaacctaaaagttacgaaacaccggtaccttaagggaacgaaacccggaccgaaaccgacccggggtccctttaaccgttagttttaacgtttcggtacttaacgtaactaaccggtaaccgttaaagggaacttaaccggaaaacgggttcgggttacggtttaacccggttaggtacgtttccgggg

SEQ ID NO: 426557 - DNA, 552 bp, Homo sapiens
  misc_feature: GZ8MTXP02JX8CM.3.17.B06.1.454.CMB.2.raw
  modified_base (303)..(303): a, c, t, g, unknown or other
  modified_base (339)..(339): a, c, t, g, unknown or other
  modified_base (384)..(384): a, c, t, g, unknown or other
  modified_base (413)..(413): a, c, t, g, unknown or other
  modified_base (424)..(424): a, c, t, g, unknown or other
  modified_base (453)..(453): a, c, t, g, unknown or other
  modified_base (490)..(490): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtccctaagactctcctgtgcagcctctggactcaccttcacgctcaatggccactacgtggactgggtcccnccaggctccgaggggagggctggagtgggtgcgttnagagacacaactaacagtcgacaccgcaacaataccgccgcgtcngtagaaaggcagattcaccatcacaaganatgattcaganactctaactttatctagacaaatgaaacngaccgtagaacgaaccgacgacacggtctctaagttntcgtgtacagttacgaccgtaaggaactaacgaacggtacggtagtaccgtggtactcgggg

SEQ ID NO: 426558 - DNA, 877 bp, Homo sapiens
  misc_feature: GZ8MTXP02GQA2E.3.17.B06.1.454.CMB.2.raw
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccaggccgtgggagggtccctaagactctcctgtgcagcctcgtggacctcaccttcacgtctacaagtcggacccactacggtggaccgttcggggtcccgccgagggcctcccggaaggggggaacgggggccttagggggaacggttggggggtttaccgggccccggtttctaaaggggacggtaacctaaacctaaaactaaaccgaggttacccgaaccgaaccccggtacaaacctaaacgttcccgcccggtcgttcctagggtaacggaaaacgggtccaaggttacttacccaaccctaattccgtaacgaaaaggacgtaattacggaactttaccgaaggtaaaacgtaacccttactaaacttttttaacgccttagggaacctaaaaagttcggaaaacctaccggtaccccgttaaggggaaaacccggaaaccccggtaaccgggtaaacccgaaaacccgggggttcccccgtttaaactttaaaaggtttttaccgtttacggggttaacgttaaaccctaaacgggtttaaaccgtaaacccccggtttaaaggggaaacctttaaaacccgggaaaaccgggtttaacgggggttcccgggttaaaaccccgtttggggtttaaacggttttccccggggg

SEQ ID NO: 426559 - DNA, 767 bp, Homo sapiens
  misc_feature: GZ8MTXP02JJ1X5.3.17.B06.1.454.CMB.2.raw
  modified_base (399)..(399): a, c, t, g, unknown or other
  modified_base (521)..(521): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgtttattttacaaggtgtccagtgtgaggtgcacctggtggagtcgtgggggagcttggtccagcctggaggtccctaagctctcctgtgcagcctctggactcaccttcacgctcaatcggccacgtacgtggactggggtccccgccagggcctacccggaagggggaacggggtcgtggggtaggttcggggttcggtcccgtttacgtaaggaacgaaccgtaccaaaactaaacgnggtaccgacccaaccccgcaaacaaacgttaccgcccgtgtcctaggtaggaaaacgcaagtacttaccaacctatcctacgaaagagtatgtaattcaagacgaacttcgtaaacttttanctagaaacaaagttacgaaacgacgtaccgtacggtaaacccggaaacccgtaacggaacccgtaccccggggtaccttttaaccgttaaagttttaacgttaccggttacggtaacctaaacggtttaaaccggtacccgtttaaaagggaaacctttaaaaccccgggggaaaaccggggtttaacccgggggtttaccggtttaaaacccgggtttacggggtttttaaaccggttcccgggg

SEQ ID NO: 426560 - DNA, 846 bp, Homo sapiens
  misc_feature: GZ8MTXP02JMGLY.3.17.B06.1.454.CMB.2.raw
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtgggggaggcttggtccagcctgggacgggtccctaagactctcctgtgcagcctcgtggacctcaccttcacgctacaatcggcccaactacggtcggaccgtcggggtccccgccgaacgggtccgtacccggaaggggggtaaacggggggtcgtacgggggtagggtttggggggtttcggggtccccggtttaacggtacggaacggtaaaccaaaccgtaaaaccgtaaacgtaacggtacccggaaccaaccccggacaaaacccgtaaacggtacccgacccgggtcccggttaccgttacggggtaaacgggaaaacggggcctaaaggtaacctttacccaacccgttaatacccgtaacgaaaaggacggtatagtaactttaacgaacgtaaacgtaaccttacttaaaccttttaagtaccgttaacgtaaactaaaatacggaaaacgaaccgttaccggtaaacggaaaaccggtaaaccccggaaccgaaaccggtacccgggtaaccgtttaactttaaacgtttaagttccgggttattaaccgtaaattaaccggtaaccgtaaggtaacgtaaacgtaaaccggtacgggttacggtaacctttacggggttacgttccgggg

SEQ ID NO: 426561 - DNA, 804 bp, Homo sapiens
  misc_feature: GZ8MTXP02FYJNU.3.17.B06.1.454.CMB.2.raw
tcagagacgcactccacgaccggtgctcgatttagtcgatagtgaagggggagagcggagccccagccccagaattcccaggtgttttcatttggtgatcagcactgaatacagaggactcaccatggagtttgggctgagctgggttttccttgttgttattttacaaggtgtccagtgtgaggtgcaccgtggtggagtcgtggggggaggtcgttggtccaggccgtgggacgggtccctaagacctctcctgtgcagcctctggactccaccttcacgctacaatcggccacgtacggtggacgtcgggtcccgccgaggcctaccggaagggggaacggggtcgtaggggtaggttcggggttcggtcccggtttcgtaaggacggaaccaaacgaaacctaaacgaggtaccgaaccacccgacaacaacgtacccgccgtcgtacgtggtaacggaaacggcaagtacttacccaaaccgttattacccgtaacgaaaaggtagtaataggtaacttaccgaaaggtaaccgtaaaaccttccttaaactttttacgaccgttaacggaaaacctaaaacgtacgaaaaccgtacggtacccgttaaagggaaacccgtaaaaccccggaccggaaacccggtacccggggtaccctttaaacgttaagttttaccggttacggttacgtaacctaacgttaaaccggaccttaaaacgggtaaacgttaaacccggaaaacgggttaccgggggttaacgtttaccggttacgggtttaacggtttaccccggggg

SEQ ID NO: 426562 - DNA, 741 bp, Homo sapiens
  misc_feature: GZ8MTXP02JXFS0.3.17.B06.1.454.CMB.2.raw
  modified_base (579)..(579): a, c, t, g, unknown or other
  modified_base (606)..(606): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcacgtggtggagtcgtgggggagtcgttggtccaggccgtgggacgggtaccctaaggaccttcctccgtgtgcacgtcctgtggactccaccttcacgctacaagtcggaccacgtacggtggaccgttcggggtccccgccgaacgggccgtaccggaaggggggtaacggggtctaggggtagggttcgggggtttgggtccccgtttagaaggacgaaaccaacgtaaactaacgagtaccgaaccaccgacaaacacgtaccggcccggtcgttaccgtaggtaacggaaacgggtcaaacggtacctttaccgaacccctatcccgtaacgaaaaggataaagtgtaacttacgaaaggtaactaaaccttcttaaacttttacnccgtaagactaaaagtacgaaaaccgngtacccgtaaggaaccggaaacccgaacgaacccgacggtacccgttacttaagttattcggtaactactaagtacgtaaaccgtagaacgttaacgaacggttacgggtggtaacccgttaggtacgttccggg

SEQ ID NO: 426563 - DNA, 708 bp, Homo sapiens
  misc_feature: GZ8MTXP02JHNHO.3.17.B06.1.454.CMB.2.raw
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagccgtgggagggtccctaagactctcctgtgcagcctctggacctcaccttcacgctacaatcggacccacgtacggtggactcggggtcccgccgaggcgtccgaggggaacgggctagggaggtggggtcggcccgtttcgtaggacgaccaacaaactaacgagtcgacccaccgtacaacgaataccggcccgtcgttccgtagtaaggaaacgcaagtacttccaaccctatcccgtaagaaaggatacgtagtacttacgaaggtaactaaaccttcttaaacttttactccgttaaagaacctaaagtacgaaacctacggaccgtaaggaaaccgaaaccggaccgaaccgtaccgggtacctttacgttacgtttaggttacgtacgtacgtaaacgttaaccgtaacggttaaggaaccgttaaaccggaaaccgggttacgggtacggttacccgtttagggttaccggtttccgggg

SEQ ID NO: 426564 - DNA, 576 bp, Homo sapiens
  misc_feature: GZ8MTXP02F4XKM.3.17.B06.1.454.CMB.2.raw
  modified_base (318)..(318): a, c, t, g, unknown or other
  modified_base (374)..(374): a, c, t, g, unknown or other
  modified_base (386)..(386): a, c, t, g, unknown or other
  modified_base (461)..(461): a, c, t, g, unknown or other
  modified_base (535)..(535): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagccgtgggacgggtccctaagactctcctgtcgcagcctcgtggactcaccttcacgctacaatcggcccactacggtggacctgggtcccnccaggcctccgaggggaagggctggaggtgggtggtccgttgagacgacacaacanagtcgacaccgnacaatacgccgcgtctgagaaacggcagtacttcacatcacaagagatagattcaaagtacgaactctactttanactagaccaaaagtcgaactacgctagaacgaaaccgacgtaccgacggtccgtacttagttcgtagtccgtanaacgtacgtaaccgtaggactaaccgaacggtacgttacgg

SEQ ID NO: 426565 - DNA, 703 bp, Homo sapiens
  misc_feature: GZ8MTXP02GJGMU.3.17.B06.1.454.CMB.2.raw
  modified_base (306)..(306): a, c, t, g, unknown or other
  modified_base (458)..(458): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcgtgggttttccttgttgttattttacaaggtgtccagtgtgaggtgcaccgtggtggagtcgtgggggagcttggtccagccgtggaggtccctaagactctctgtgcagctctggactcaccttcacgctcaagtggacccacgtacgtggacctgggtcccncgtaggcctaccggaagggggagggcgtgggaggttcggggttcgccgtttacaggagaccaacgaaactaaacgaggtcccgaaccgaccgacaacgtaacgtacccgccgtcgtcctaggtacgaaaagtccaagtacttccgaaacctntacgtaagaaagtatagtagaacttacgaacgtaaactaacttacttaaactttagaccgtacgaaactaaaagtaccggaaacgaccgtacgtagaaacccggtaaaaccgcggtaaaccgtaccgggttaacctttagttaacgtttagtacggttactaactaacgttaaacggacgttaaaggaaacttaaccgggaaacggttacggggttaccgtacgttaacgggtttacggtccggg

SEQ ID NO: 426566 - DNA, 709 bp, Homo sapiens
  misc_feature: GZ8MTXP02HI3X4.3.17.B06.1.454.CMB.2.raw
  modified_base (521)..(521): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtccctaagcctctcctgtgcagcctcgtggactcacccttcacgctcaatggcccatacggtggactcgggtccgccaggcctaccgaggggaaggggctggggaggttggggttcggccgtttacgaaggagaaccaacgaaaccgttaaacgaggtacggaaccccaccgacaaccaaagtaccggcccgacgttctagggtacggaaaacggccaagtacttacaacccgtatccctaacaaaggcgtatggaactttcaaaggtaactaaaccttctaaacttttnacccgttggtaacctaaaaagttccgggaaaactacgcccggttaaagaaaccggaaacccggaccgaaccgacccgggtaccccggtttattaaacttggttcttacggtacaaagttaccgaacccgttaaggaaccttaaccgaaacgggttcgggttacggtaccgtacggtttaacgccgggg

SEQ ID NO: 426567 - DNA, 769 bp, Homo sapiens
  misc_feature: GZ8MTXP02G36LS.3.17.B06.1.454.CMB.2.raw
  modified_base (179)..(179): a, c, t, g, unknown or other
  modified_base (396)..(396): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagtctgggttttccttgttgttatttacaaggtntccagtgtgaggtgcaccgtggtggagtctgggtggaggtcttggtccagcctgggacgggtccctaagactctcctgtgcagcctctggactcacccttcacgctacaatcggaccacgtacgtggactcgggtccgcaggcctaccggaaggggacggggctaggggaggttggggttacggccgtttagaggtagaaccccaacaaacgtaacngtacgaaccacccgcaacaaacgtccgaccgcgttacgtggtaggaaaacgtcaaagtacttacccaaaccctattacccgtaacgaaaaggtactaaaccgttaggtaaactttccgaaaacggtaaacgtaaccctttaacgtaaacctttttaacgtaccttaaacggaaactaaaaacgttacgtaaaaaccgacgtaccccgtaagggaaacccggaaaacccggacccggtaaaaccgacccggggtacccgtttaaacctttaaacgtttacgtttacggttacccgtaaagttacggttaaaaccggtaaaacccggttaagggtaaacccttaaaaccgggtaaaaccgggtttaacccggggg

SEQ ID NO: 426568 - DNA, 555 bp, Homo sapiens
  misc_feature: GZ8MTXP02J3G83.3.17.B06.1.454.CMB.2.raw
  modified_base (264)..(264): a, c, t, g, unknown or other
  modified_base (287)..(287): a, c, t, g, unknown or other
  modified_base (301)..(301): a, c, t, g, unknown or other
  modified_base (322)..(322): a, c, t, g, unknown or other
  modified_base (382)..(382): a, c, t, g, unknown or other
  modified_base (386)..(386): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccactgtgagctgcgactgggtggcgtcgtggggggagcttggtgcaggccgggtgggtcccctgcgacttctcctgtgctaattttcngaacgccccctttcaatcagtgnggatgaattggccncaggctcgagggagggctggngtggggtgcaatataaaaagtagacgtgctggtgagaccacagactacgctgctgccttnaggngcagattccacatctcagagatgaaatcaacagagcacttcttgtttcagtacaaatgaacagccgtaggaaacggcgacgggacacgacgcctattagttattacttacgtactagttacggaacacttacgtacggttcccgtcgggggtaccaacggggtaccccc

SEQ ID NO: 426569 - DNA, 598 bp, Homo sapiens
  misc_feature: GZ8MTXP02GAVE9.3.17.B06.1.454.CMB.2.raw
  modified_base (260)..(260): a, c, t, g, unknown or other
  modified_base (307)..(307): a, c, t, g, unknown or other
  modified_base (349)..(349): a, c, t, g, unknown or other
  modified_base (380)..(380): a, c, t, g, unknown or other
  modified_base (393)..(393): a, c, t, g, unknown or other
  modified_base (424)..(424): a, c, t, g, unknown or other
  modified_base (430)..(430): a, c, t, g, unknown or other
  modified_base (443)..(443): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcacctgggtggagtcgtggggggagcttggtccagcctgggagggtccctaagactctcctgtgcagcctcnggactcaccttcacgctacaatcgaccactacgtggactgggtcccncaggctccgaggggaagggctggagtggggttcgccgtttanagagtacaacaactaaacagtcgaacaccgnaacaatacgccgngtctagagaaagcaagtactacactatacanaaaganatagatacagaanaactactacttatatataataataagaacacgacgacgaacgaaaccgaacgaacgacgtacgtacttattattacgtacgtacgtacgtaacgtaacgtaaacgtaaacgtaaacgtaaacggtaacggtacggttacgtacggttacgtacgg

SEQ ID NO: 426570 - DNA, 626 bp, Homo sapiens
  misc_feature: GZ8MTXP02F7RDG.3.17.B06.1.454.CMB.2.raw
  modified_base (423)..(423): a, c, t, g, unknown or other
  modified_base (449)..(449): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggagcttggtccagcctggacgggtccctaagactctcctgtgcagcctctggactcaccttcacgctcaatggccactacgtggactcgggtccgcaggctccgaggggaagggctgggagtgggtgccgttcgtagacgacaacaactaacagtacgacaccgcaacatacgccgcgtctggtagaaaggcaagattaccacatctacaaagatantattcaaggtacaactctaactttancctagaacctaaagtagaaaccagtacccgtaggaaacgtaaccccggaacgacccgtaccggggtacccttacgttaaatttcgtcgttacgtactaaacgtaacggacccttaaaagggaactaaacccggaagtaacggggtttacgtaccggttagggttaactttccggggg

SEQ ID NO: 426571 - DNA, 818 bp, Homo sapiens
  misc_feature: GZ8MTXP02IURFX.3.17.B06.1.454.CMB.2.raw
  modified_base (319)..(319): a, c, t, g, unknown or other
tcagagacgcactccacgaccggtgctcgatttagtcgatagtgaagggggagagcggagccccagccccagaattcccaggttgttttcatttggtgatcagcactgaacacagaggactcaccatggagtttgggctgagtcttgggttttccttgtttgtttattttacaaggtgtccagtgtgaggtgcacgtggtggagtcgtgggggagtcgttggtccagccgtgggacgggtccctaagcctctcctgtgcagcctgtggactccaccttcacgctacaatcggcctagtacggtggaccgtcggggtccnccgaggcctaccggaagggggaacggggtctaggggtaggttgggggtttcggtccccggtttacgtaaggaacgaaacccaaacgtaaaacctaaacgacggttaccgaacccacccgacaaaccgaacgttacccggcccggtcggttccgtaggtaacggaaaagggcctaaaggtactttacccaaaccctattaccgtaaacgaaagagtaaagttggtaactttacaaaggaaacgtaaccttacgttaaactttttaacgtcgaacgtaaacctaaaagttacggaaaaacctacggtaccccgtaaagggaaacccggtaaaaccccgggaccgaaaaccggtaccccggtaccgtttactttaaagtttaagtttcggttacgtaaccctaaagttaaaccgtaacccgtttaaaggaaacgttaaaacccggtaaacggggttacgggttaccggtaaaccgtttacggggttaacgtttacccggggg

SEQ ID NO: 426572 - DNA, 802 bp, Homo sapiens
  misc_feature: GZ8MTXP02HQJHM.3.17.B06.1.454.CMB.2.raw
  modified_base (305)..(305): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggtagttttggctgagtcgttgggttttccttgttgtcttatttacaaaaggtgtccagtgtgaggtgcgaggtggtggagacgtgggaggaggtcttgatccgaggtccggtcggggggtccctgacgtacctctccgtgtcgcacgtcctcgtcggtccttccgaccgtcaggtacncacgtctacagtcgccgtacgtcgggtcccgccgacgggtccgtacccgggaagggggaacggggtccgtaggggacggttcgggttaccttacgttaaagtttactttaacgtaagtttccgtacccggtaaaccacgtaacttaccgttacccgtacccccgtaccgggtacgggaaaccgggtaccctaaagttaaaccccgtatacccgtacgaacgaacgtaacgtaccgttaccgaaacggaactacgggtttataaccttacgttaacaaaacgtacgaaaaccgaaccgtgaacgaccggaccgaacgtaaccgtacggttaaccgtttacgtacggtaggtcgaacggttaagacgttacggttccgggtaacggggtttcgggtaccccgggaaacctttcccgtaccgggtttacgtttcccgttaaacgttccgggtacttacccggttcgggtaccgggggtcccgtcggttaacccctcccgg

SEQ ID NO: 426573 - DNA, 630 bp, Homo sapiens
  misc_feature: GZ8MTXP02FJ4Z1.3.17.B06.1.454.CMB.2.raw
  modified_base (367)..(367): a, c, t, g, unknown or other
  modified_base (484)..(484): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcaccgtgggtggagtcgtggggggagcttggtccagccgtgggacgggtccctaagctctcctgtgcagcctctggactcaccttcacgctacaacgtggcccccctagtaccggtggacgtcgggtccgcgaggctaccggaggggaggggctgggagtggggtggccgttnaggacgacaaccaaactaacagtcgacaccgacacaacacgccgcgtctgtagaaagcagtacttcactatctacaagagatgattcgaaagactaaactctaactttactacgtanaactaaaatacgaaacacgaccgtaagaaaccggaaacccgaacgaaccgtaccgggtaccttacttaaagtttacgttaggtctaacctaagtacggaaaaccgttaaggaacttaaaccggaaacgggttacgggtttaaccgg

SEQ ID NO: 426574 - DNA, 658 bp, Homo sapiens
  misc_feature: GZ8MTXP02GEE75.3.17.B06.1.454.CMB.2.raw
  modified_base (302)..(302): a, c, t, g, unknown or other
  modified_base (342)..(342): a, c, t, g, unknown or other
  modified_base (362)..(362): a, c, t, g, unknown or other
  modified_base (395)..(395): a, c, t, g, unknown or other
  modified_base (466)..(466): a, c, t, g, unknown or other
  modified_base (487)..(487): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcactggtggagtcgtgggggagcttggtccagcctggagggtccctaagactctcctgtgcagcctctcggactcaccttcacgctcaatcggccacgtcgtggactcgggtccncgaggctccgaggggaagggctgggagtgggtggccgttntaggagacaacaactaacgngtacgaccaccgacaacaataccggccgcgtcnggtagaaagcagtattcaaccatccgtacaaagacgtatagacttacgaaggtaacaactctaactttacncctagactaaatcggaaaacncgacctaggaacggaaacccgacggacctacgggtacccgtacttaaattacgttcggtaacttacgaaaacgttaacggtaacccgttaaaggggtaaacttaaacccggaaaacgggttacccgggggttaaggtttaaccccgtagggggtttaacgtttcccggggg

SEQ ID NO: 426575 - DNA, 563 bp, Homo sapiens
  misc_feature: GZ8MTXP02FZ8ET.3.17.B06.1.454.CMB.2.raw
  modified_base (257)..(257): a, c, t, g, unknown or other
  modified_base (303)..(303): a, c, t, g, unknown or other
  modified_base (325)..(325): a, c, t, g, unknown or other
  modified_base (338)..(338): a, c, t, g, unknown or other
  modified_base (342)..(342): a, c, t, g, unknown or other
  modified_base (352)..(352): a, c, t, g, unknown or other
  modified_base (363)..(363): a, c, t, g, unknown or other
  modified_base (378)..(378): a, c, t, g, unknown or other
  modified_base (411)..(411): a, c, t, g, unknown or other
  modified_base (432)..(432): a, c, t, g, unknown or other
  modified_base (441)..(441): a, c, t, g, unknown or other
  modified_base (445)..(445): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcgtgggttttccttgttgttattttacaaggtgtccagtgtgaggtgcacctggtggagtcgtgggggagcttggtccagcctgggagggtccctaagactctcctgtgcagcctntggactcaccttcacgctcaatggaccatacggtggacctggtccncaggctcgaggggagggctggngtgggtgccgttnaganacacaatacngtacacaccgnacaataccgcgcgtnaggtagaagcagtacttccactatctacgaagngtatgattacaagactaactnttactttanctanactaaatacgaacacgcgtagaacgaaaccgacgaaccgcggtactacttattacgtgtactacacgtacgaacgtaagaacgtacgaacggtacggtacgtacgtcggtacgttcgg

SEQ ID NO: 426576 - DNA, 592 bp, Homo sapiens
  misc_feature: GZ8MTXP02I1VHG.3.17.B06.1.454.CMB.2.raw
  modified_base (319)..(319): a, c, t, g, unknown or other
  modified_base (489)..(489): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcacctgggtggaggtcgtgggggaggtcttggtccagccgtgggacgggtccctaagactctcctgtgcagcctctggacctctaccttcacgctcaatcggcctactacgtggactcgggtccncgaggctccggaggggagggcgtggagttggggttcgtccgttacagagacaaccaacacagtcgacaccgacacaactaccgccgtccgtcgtgtagaaacggcagtacttacaacccgtatcaacgaaagagattgacttacaaaggtacaacctttcgtattttacngtacactaaatgaaacacggtctaagacgaaccgacgaccgcggccttattacggttatcgtctacaagtacgacgtaagactaacgaacgtaggtttaccgg

SEQ ID NO: 426577 - DNA, 632 bp, Homo sapiens
  misc_feature: GZ8MTXP02H15OM.3.17.B06.1.454.CMB.2.raw
  modified_base (256)..(256): a, c, t, g, unknown or other
  modified_base (261)..(261): a, c, t, g, unknown or other
  modified_base (312)..(312): a, c, t, g, unknown or other
  modified_base (333)..(333): a, c, t, g, unknown or other
  modified_base (376)..(376): a, c, t, g, unknown or other
  modified_base (431)..(431): a, c, t, g, unknown or other
  modified_base (440)..(440): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaagttgtccagtgtgaggtgcacctgggtggagtcgtggggggaggcttggtccagcctgggagggtcccctaagacctctcctgtgcngcctntcggactcacccttcacgctcaagtcggaccactacggtggactcgggccnccaggcctcgaggggagggcngggagtggggttggccgtttctagagacaactaaactaaacgnggtacaaccgaccgataaccaaatacccggccgtcgtctaggtgaaacgcaagtnttcccaacnttaccctagaaagtagattagatttacaaggaactaactactaaacttttcattgaaccaaaatcggaaactacgactaggaacgaaaccgtacgaacgtacgggccttagtatttcggtatcgtacatacgtaaccttaggaaacttaccgaaacggtcgttacgggttaacttcgggaagtttcccgggg

SEQ ID NO: 426578 - DNA, 841 bp, Homo sapiens
  misc_feature: GZ8MTXP02G7ZXD.3.17.B06.1.454.CMB.2.raw
  modified_base (258)..(258): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggagcgttggtccagccgtggacgggtccctaagctctcctgtgcagcctntggacctccaccttcacgtctacaatcggccacgtacggtggaccgtcggggtccccgccgacggtcctaccccggaaggggggtaacggggtcgttaggggaaggttgggggtttacgggtccccgtttaccgtaaggaacgtaaaccgaaacctaaaaccgtaaaacgtaggttacccgaaacccgaccccgacaaaccgtaaacgttaaccccggcccgtaccggttccgttagggtaaaggaaaaccgggcctaaaggtaacctttacccaaacccttagttaccccttaacgaaaaggagtaacttagaaccgtttacaaggtaaactaaaccttacttaaacgttttactacgtacgtaacaaaagttcggaaaacctcgaccgtaaagggaacccgaaaaccggtccgaaacgtaccccggggtacctttaacggtttaaatttacgtttccgggtagttaaaccctaagttaaaccggtaacccgtttaaggaaaccgtaaaaccgtaaaccgggggttaaccggggtttaccggtttaaaaccccgttgggggttttaacgtttaccccggggg

SEQ ID NO: 426579 - DNA, 925 bp, Homo sapiens
  misc_feature: GZ8MTXP02JIC5S.3.17.B06.1.454.CMB.2.raw
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcaccgtggtggagtcgtgggggagcttggtccagcctgggacgggtccctaagacctctcctgtgcacgcctcgtggacctcaccttcaccgctcaagtcggaccctaacgtacggtcggtaccgtcggggtccccgccgagggccgtacccggaaggggggaacgggggcgttggggacggttggggtttcggtccccgtttcgtaaggaacgaaccgaaaccgaaaaccttaaacaggtacccgaaaccaacccggacctaaaccgaaacgtacccggcccgtcggttcgttacgggtaacgaaaagggcaaacggtactttcccaaaccccattaccctaagaaaaggaaggtaaattaggtaactttaccgaaaggtaaacgtaaaccctttacgttaaacctttttaaactcccgtttaagtaaacgtaaaaacgttaccgaaaaaccgtaccgggtaacccgttaaacggggaaacccggtaaaacccccgggtaaaccggtaaaccccgggtacccggggttaaaaccccgtttaacgttttaaaacgtttttaacggggtttaccggttaaacggtttaaacccgtaaacgggtttaaaaccggtaaccccgtttaaaaaggggtaaaacccggttaaaaaacccggttaaaaccgggggttaacccggggggttttaaccggtttaaaacccggttttacgggggttttaaccccggtttcccggggg

SEQ ID NO: 426580 - DNA, 667 bp, Homo sapiens
  misc_feature: GZ8MTXP02GTR5G.3.17.B06.1.454.CMB.2.raw
  modified_base (308)..(308): a, c, t, g, unknown or other
  modified_base (468)..(468): a, c, t, g, unknown or other
  modified_base (505)..(505): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtgggggagcttggtccagcctgggagggtccctaagactctcctgtgcagcctctggactcaccttcacgctacaatcggccactacggtggacctggggtcccnccgaggcctaccggagggggaacggggctggggaggtggggttcggccgtttagtaggacgaccaacgaaactaaacgagtaccgaccaccgacaacaacgtaccgccgtcgtctggtaggaaacggcaaggacttccgaacctatcctacgaaaggtanattacgacttacgaaggaactaacctctaaacttttnactagtaacaaaagttcgaaacacgtaccgtaaggaaccgaaacccgacgaaccgaccgggtcctttactaagtttagttcggtactaccaagtacggaaccgttaagggaacttaacgaacgggtacgggttacgtaacccgttgggttacgtttcggggg

SEQ ID NO: 426581 - DNA, 838 bp, Homo sapiens
  misc_feature: GZ8MTXP02F9CD3.3.17.B06.1.454.CMB.2.raw
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcaccgtggtggagtcgtgggggagtcgttggtccagccgtgggacggtccctaagctctcctgtgcagcctctggactccaccttcacgtctacaagtcggacctaacgtacggtcggaccgtcggggtccccgccgagggccctaccggaaggggggtaacggggcgtagggggtagggtttgggggtttcgggtccccggtttacgtaaacgggaacggtaaacccaaaccgtaaaaccgttaaacgacggttaaccgaaaccccgacccccggacaaaccgtaaaacgttaccccgggccccgggtccggttaccgttaggggtaaacgggaaaacggggtcctaaagggttaaacctttacccgaaacccttagttacccgtaaagaaagggtaaacgtaagtttacgtaacgtttaaccgaaagggtaaacgtaaacccttactttaaaccttttaacgtccctaggtaaacctaaaagttcggaaaaccttaccggaccttaagggaacccgtaaaaccggaccgaaccggtaccgggttaccttagtttaaacgtttgtacgttacgtactaaacgttaaccggacgtttaggaacttaaccggaacgggtacggttacgtaccggttaggttacgttccgggg

SEQ ID NO: 426582 - DNA, 792 bp, Homo sapiens
  misc_feature: GZ8MTXP02F6R58.3.17.B06.1.454.CMB.2.raw
  modified_base (257)..(257): a, c, t, g, unknown or other
  modified_base (314)..(314): a, c, t, g, unknown or other
  modified_base (366)..(366): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggagcttggtccagcctgggacggtccctaagactctcctgtgcagcctntggactcaccttcaccgctacaatcggccctacgtacggtggaccttcggggtcccnccaggcctaccggagggggaacggggctggggaggttggggttcgccgtttnagagtacaacaactaacagtcgaaccaccgcaacaacgtaccgccgcgtctaggtagaaaacggcaagtactttaccaaccctattccctaacgaaaggagtaatacggaactttacgaaaggtaaacgtaaaccttccttaaaactttttaactaccgttacggtaaactaaaaacggttacggaaaaccctaaccgggtacccgttaacggaaaacccgggaaaacccccggtacggaaacccgtaacccgggggtaccccctttaaacgtttaaagttttaaacggtttggggttaaaccttaaccgtaaagttaaaaccgggtaaccccgtttaaagggaaaccctaaaacccgggtaaaaccggggtaccggggttaaccgggtttaacccgtagggggtttaaccgttttacccgggggg

SEQ ID NO: 426583 - DNA, 840 bp, Homo sapiens
  misc_feature: GZ8MTXP02FI3MR.3.17.B06.1.454.CMB.2.raw
  modified_base (262)..(262): a, c, t, g, unknown or other
  modified_base (267)..(267): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggaggcgttggtccagccgtgggacgggtccctaagcctctcctgtgcngcctntgactcaccttcacgctacaatcggcccagtacggtggaccgtcggggtccccgaccgacgggcctacccggaaggggggaacggggcgtaggggtagggttcgggggtttacgggtccccgttttacgaaggaacggtaaccaaaccccgtaaacctaaaccgagggtacgacccaaccccggacaaccgaaaacgtcccggacccgtcgttccgtaggtacgaaaaacggggtccaaaggtaactttacccaaacccgtaattcccgtaaacgaaaggtaaaggtaattaggtaaaccttacgaaaggtaaaccggtaaaaccttcccttaaactttttaactacgttaaacgaaccctaaaaaagttcggaaaacccgtacgtaaccccgtaaagggaaaacccggtaaaaccccggaaaacccggtacccggaaaccccgggttaacccccgtttatttaaacgtttaacgttttaacggtcgtttacccaaaagtaaacccgtaaacccggttaagggaaaacctttaaaacccgggaaaaaccgggttccggggtttaaacccgggg

SEQ ID NO: 426584 - DNA, 658 bp, Homo sapiens
  misc_feature: GZ8MTXP02JHWPO.3.17.B06.1.454.CMB.2.raw
  modified_base (248)..(248): a, c, t, g, unknown or other
  modified_base (256)..(256): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctgggacggtccctaagactctcctgngcagcctntggactcaccttcacgctcaatcggacctacgtacgtggaccgtggggtcccgccgaggcctccgaggggaaggggccgtagggaggttggggttcggcccggtttactaggacgaaccaacgaaacctaaaccgagtcccgaccaacccgcaaccgaagtacccgcccgtcgtcctaggtaggaaaacggcaagtacttaccgaacccatacctacgaagagactagattacgaagtacgaacttcttaactttatactagaactaaaagtacgaaacacgtaccgtagaacggaaccgacgtaccgaccggtctacgttattagtcgtagtacctagtacgaaccttaaggaactaacgtaacggacgggttacgtaccgtttagggtactttccggggg

SEQ ID NO: 426585 - DNA, 647 bp, Homo sapiens
  misc_feature: GZ8MTXP02IQZ2R.3.17.B06.1.454.CMB.2.raw
  modified_base (254)..(254): a, c, t, g, unknown or other
  modified_base (266)..(266): a, c, t, g, unknown or other
  modified_base (301)..(301): a, c, t, g, unknown or other
  modified_base (356)..(356): a, c, t, g, unknown or other
  modified_base (369)..(369): a, c, t, g, unknown or other
  modified_base (413)..(413): a, c, t, g, unknown or other
  modified_base (461)..(461): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggaggtccctaagactctctgtgcagcctntgactcaccttnacgctcaatggaccacgtacgtggactgggtcccnccgaggctcgaggggaggctgggagtgggtgccgttgtagacgacacaactaacngtcgaccaccganaacaataccgccgtcgtctggtagaaacgcaagtacttcaaccntcctagaaagagtatagacttacgaagtaacgtactcttaacttttanacgttaggaactaaaattcggaaaacctcgcgttaagaacggaaaacccgcgaaccgaaccggtcccgtttaacttaagtttgttacgggttactacgtaagttaaccggtaacccgttaagggaaacttaacccggaaacggttacgggttcggttaaacccgttgggtaacccgtttccggggg

SEQ ID NO: 426586 - DNA, 741 bp, Homo sapiens
  misc_feature: GZ8MTXP02IO6NQ.3.17.B06.1.454.CMB.2.raw
  modified_base (311)..(311): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggagcttggtccagcctgggacggtccctaagacctctcctgtgcagcctgtggactcaccttcacgctacaatcggaccacgtacgtggacctggggtccccnccgaggccgtaccgaagggggaacggggctggggacggttgggttcggccgtttataggacgacaacaaataaacgagtcgaacccacgacaactaactaccgccgtcgttctacgggtaagaaacggctacgtaactttacccaacctaacttaccaacgaaaagaagtattaggaatttacgaaagtaactaaccttacttaaacctttttagccgttaagaaccaaaaagttaccggaaactacggtaaccctaaggaaacccggaaaacccgggaacctaaaccggacccggtacccggtttaaacttaaacggtttagtttcggttacgtaaacgtaacgttaaaccgaacccgttaaggaaaccgttaacggaaaccgggttaacggttcggtaaccccgtttaggggtttaacttcccggggg

SEQ ID NO: 426587 - DNA, 647 bp, Homo sapiens
  misc_feature: GZ8MTXP02HGU87.3.17.B06.1.454.CMB.2.raw
  modified_base (313)..(313): a, c, t, g, unknown or other
  modified_base (363)..(363): a, c, t, g, unknown or other
  modified_base (416)..(416): a, c, t, g, unknown or other
  modified_base (470)..(470): a, c, t, g, unknown or other
  modified_base (585)..(585): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcacgtgggtggagtcgtgggggagcgttggtccagcctgggacgggtccctaagctctcctgtgcagccctgtgactcacttcacgctacaatcggacctagtacggtggacgtcggggtccccncgaggctccgaaggggaggctgggaggtggggttcgcccgtttgaaaggngtaaacaactaaactaaacgagtaccgaaccaccgcaaacaagtacccgccgngttcctggtaaggaaaacgtcaagacttccgaacctattacgacgaaaggtaanatagtactaagaagtaactaacttcttaaactttactacgtacaaataaagtacgaaacacgtaccgagaaaccgaaccgacgacgtaccggtcttaacgttagttagtcgttanacgtagtacgtaactaggaactaacggtaacggttacggtcgtacggttacggttacgtcgg

SEQ ID NO: 426588 - DNA, 672 bp, Homo sapiens
  misc_feature: GZ8MTXP02HKU3P.3.17.B06.1.454.CMB.2.raw
  modified_base (461)..(461): a, c, t, g, unknown or other
  modified_base (536)..(536): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggtttttccttgtttgtttattttacaaggtgtccagtgtgaggtgcacctggtggagtcgtgggggaggcgttggtccagccgtggagggtccctaagactctcctgtgcagcctcgtggacctcacccttcaccgctcaatcggccactacgtggacgtcgggccgccaggcctccggaggggaacgggcgtggggaggttggggttcggccgtttacgtaggagaacaacgaaactaaacgagtacgaaccaccgacaacgaacgtaccgccgcgtctaggtaagaaaggcagtacttcaacctatcccgtanaaagtagattgaacttcaaaggtaactaaccttacttaaactttacgactagtaaacctaaaagtacgaaaaccncgtaccgaaggaaacccgaaaccggaccgaaccgtaccggttcccgttaattacgtttagttgtaccgtataacgtaccgtaacgaagtaacgtacggaaaccggttacggtacggtaccgttaggttacgtcggg

SEQ ID NO: 426589 - DNA, 594 bp, Homo sapiens
  misc_feature: GZ8MTXP02IBPU5.3.17.B06.1.454.CMB.2.raw
  modified_base (299)..(299): a, c, t, g, unknown or other
  modified_base (389)..(389): a, c, t, g, unknown or other
  modified_base (447)..(447): a, c, t, g, unknown or other
  modified_base (458)..(458): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggaggtccctaagactctcctgtgcagcctctggactcaccttcacgctcaatggccactacgtggactgggtccnccaggctccgaggggagggctggaggtgggttggcccgtttcgtaaggagtacacgaaactaaacagtcgacactgacacaatacgccgngtctggtagaaaagggcagtacttccacatctacaaagagatgattcgaagcgaactntaccttttaancttagactaaaatcgaaacagcccgtagaaacgaaccgagaccgaacccggtcgttactaagttattcggtagttccagttaacgacccgtaaggtaactacgaaaacccggtggtacggttaccgtaggtttacg

SEQ ID NO: 426590 - DNA, 531 bp, Homo sapiens
  misc_feature: GZ8MTXP02IV0BG.3.17.B06.1.454.CMB.2.raw
  modified_base (255)..(255): a, c, t, g, unknown or other
  modified_base (303)..(303): a, c, t, g, unknown or other
  modified_base (363)..(363): a, c, t, g, unknown or other
  modified_base (386)..(386): a, c, t, g, unknown or other
  modified_base (406)..(406): a, c, t, g, unknown or other
  modified_base (414)..(414): a, c, t, g, unknown or other
  modified_base (424)..(424): a, c, t, g, unknown or other
  modified_base (434)..(434): a, c, t, g, unknown or other
  modified_base (464)..(464): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgtttattttacaaggtgtccagtgtgaggtgcacctggtggagtcgtgggggagcttggtccagcctggacgggtccctaagctctctgtgcagcctntggactcaccttcacgctacaatcggccactacgtggactcgggtccnccgaggcctccgaggggaagggctgggaggtgggtggccgttcaggacgacaacaactangtcgaccaccgcacatccgccgngtctgagagcagactcactntcacaagnatgatcaganactctattantagacaatgaacacgcagaacacgacgacncggccttatatgttcgactacagtacgctaaggaacacggtaacgcggtacgtacctggtactcggg

SEQ ID NO: 426591 - DNA, 699 bp, Homo sapiens
  misc_feature: GZ8MTXP02HFMBP.3.17.B06.1.454.CMB.2.raw
  modified_base (188)..(188): a, c, t, g, unknown or other
  modified_base (256)..(256): a, c, t, g, unknown or other
  modified_base (269)..(269): a, c, t, g, unknown or other
  modified_base (275)..(275): a, c, t, g, unknown or other
  modified_base (301)..(301): a, c, t, g, unknown or other
  modified_base (304)..(304): a, c, t, g, unknown or other
tcagagacgcactccacgaccggtgctcgatttagtcgatagtgaagggagctctgagagcggagccccagccccagaattcccaggtgttttcatttggtgatcagcactgaacacagaggactcaccatggagtttgggctgagcgtggtttcgtgtagttatttacaaggtgtcagtgtgaggtncactggtggagtcgtgggggagcttggtccaggcctgggaggtccctaagactctctgtgacagcctntggactcaccttnacgtcncaatgccatacgtgactgggtccccncgngctacgaggggacggtcgtggtaggttgggtcgaccgtttagaaggacgacaaccgaaactaacgagtacacaccgacactaacgtccgccgtcgtgtaggaacgaaacggcaagtaccttaccgaacctagttaccgaaacgaaaggaagtagttagtaacgttacgtaaacggtaaacgtaaacttaacttaacgtttaacttacgttaacgtaaccgtaaacgtaaacgtaaacgtaacgtaaccgtaacggtaaaccggtaaaacccggtaaaccggtaaaccggtaacccggtaaccggttacgttaacgtttaacgtttacgttacgttacgtaacgtaaccgtaaaccgtaacggtaacgtaaaccgtaaaccggtaaccggtaacgg

SEQ ID NO: 426592 - DNA, 765 bp, Homo sapiens
  misc_feature: GZ8MTXP02FOSLU.3.17.B06.1.454.CMB.2.raw
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtcagtgtgaggtgcacctggtggagtcgtgggggagcttggtccagcctgggagggtccctaagactctcctgtgcagcctctggactcaccttcacgctacaagtcggcccacgtacggtggaccgtcggggtccccgccgaggcctaccggaaggggggaacggggtccgttaggggagggttgggggtttcgggcccggtttacgtaagggacggtaacaaccgtaaaaccttaaacgaggttaccggaacccaccgacaaaaccaataccccggcccgtcggttctaggtaaggaaaacgggcctaaagtactttaccaaccctattaccctacgaaaagagtaattagaactttacgaagtaacgtaaaccttacttaaacttttactacgttaacggtaactaaaaagttacgaaaaccgacgtaccgtaggaaaccggaaaacccggacggaaacccgaccgggtaccccgttacttaagtttaattcggttacgttactaacgttaacgaccgtaaagggaactaaacccggaaaacgggtacgggttcggttaaacccgttaggggttacgtttaccggggg

SEQ ID NO: 426593 - DNA, 690 bp, Homo sapiens
  misc_feature: GZ8MTXP02HV2NR.3.17.B06.1.454.CMB.2.raw
  modified_base (306)..(306): a, c, t, g, unknown or other
  modified_base (380)..(380): a, c, t, g, unknown or other
  modified_base (506)..(506): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtcccctaagactctcctgtgcagcctctggactcaccttcacgctcaatcggccactacgtggactcggggtccnccaggcctccgagggggaacggggctggggaggttggggtttcggaccgtttcgtaaggagacacaaactaaanagtcgacacccgacaactaacgtaccgccgtcgtctggtagaaacgggcaagatttccaaccctatcccgacaaagagaattgaactttcgaagacgtaaaacctctaaacttttactccgttaanaactaaatacgaaacaccgtaccgtaaggaaaccggaaacccgacggtaacccgaccgggtacctttaactttaagttttacgttcggttacgttaacaacgtaaccggtaaccgtaaggtaaaccgttaacggaaaccgggttacgggtacggtttaacccggttggtttaaccggttcgggg

SEQ ID NO: 426594 - DNA, 626 bp, Homo sapiens
  misc_feature: GZ8MTXP02IUHEQ.3.17.B06.1.454.CMB.2.raw
  modified_base (255)..(255): a, c, t, g, unknown or other
  modified_base (299)..(299): a, c, t, g, unknown or other
  modified_base (338)..(338): a, c, t, g, unknown or other
  modified_base (351)..(351): a, c, t, g, unknown or other
  modified_base (405)..(405): a, c, t, g, unknown or other
  modified_base (413)..(413): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcactggtggagtcgtgggggagcttggtccagcctgggagggtccctaagactctcctgtgcagcctntggactcaccttcacgctcaatggccactacgtggactgggccncaggctcgaggggagggctggagtggttgcgttcagganacacaactaacgngtgacaccgacaacaagtaccgcgcgtctggtacgaaaagcgaagattcaaccntaccgtanaaagataatatacttagaagaacgaactacttaactttaacttactacgtaactaaagtaacgaaacgaacgaccgtacgaacgaaaccggaaccgaacgacggtaccgttacgttaagtttagtttacgtagtacgtaacgtaacgtaacgtaacgtaaacgtaaacgtaaacggtaacggtaacggttacgttacggttaacggtttacgg

SEQ ID NO: 426595 - DNA, 651 bp, Homo sapiens
  misc_feature: GZ8MTXP02JHWNS.3.17.B06.1.454.CMB.2.raw
  modified_base (316)..(316): a, c, t, g, unknown or other
  modified_base (373)..(373): a, c, t, g, unknown or other
  modified_base (384)..(384): a, c, t, g, unknown or other
  modified_base (471)..(471): a, c, t, g, unknown or other
  modified_base (499)..(499): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcactggtggagtcgtgggggagcttggtccagccgtgggacggtccctaagcctctcctgtgcagcctctggacctcaccttcacgctcaatcggaccacgtacggtcggaccccgggtccnccgaggcctcgaggggaggctgggagtgggtggccttcgagagacacaacctaacgngtcgacaccgnaacatccgccgcgtctgtagaaagtcagattcacctatctacaaagcgtatagtattacgaagaactaaacttactaacttttaacncgttaagaacctaaaagtcggaaaaccncgtaccctaggaaaccgaaaacccggaccggaaccgacccggggtccctttactaaaatttcggttacgtagttacccaaaagttccggaaaacccgttaaggggaaacttaaccgaaaacccggggtacggggtttacggtttaaacccgg

SEQ ID NO: 426596 - DNA, 626 bp, Homo sapiens
  misc_feature: GZ8MTXP02GE5XS.3.17.B06.1.454.CMB.2.raw
  modified_base (256)..(256): a, c, t, g, unknown or other
  modified_base (303)..(303): a, c, t, g, unknown or other
  modified_base (380)..(380): a, c, t, g, unknown or other
  modified_base (399)..(399): a, c, t, g, unknown or other
tcagagacgcactccacgaccggtgctcgatttagtcgatagtgaagggggagagcggagtcccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctgggagggtccctaagactctcctgtgcagcctntggactcaccttcacgctcaatcggccacgtacgtggactgggtccnccaggcctccgaggggagggctgggagtggggttcgccgtttacagagaccaacgaactaaacagtcgaccaccganaacaataccggccgcgtcngtaagaaaggcaagtacttcaaccatccctaagaaagagtaatgactttaacaacgaagaactactaacttacttactacgaactaaataacgaacacgtaccgacgaacgaaccgaaccgacgaccgtaccgtacttaattagttacgttagtactaactaacgtaacgtaacgtaacgtaaacgtaaacggtaacggtacggttacggttacggttacggttcgg

SEQ ID NO: 426597 - DNA, 731 bp, Homo sapiens
  misc_feature: GZ8MTXP02GDA3A.3.17.B06.1.454.CMB.2.raw
  modified_base (277)..(277): a, c, t, g, unknown or other
  modified_base (284)..(284): a, c, t, g, unknown or other
  modified_base (297)..(297): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagttgggctgagcttgggttttccttgttgttattttacaaggtgtccagtgtgaggtgcaccgtggtggagtcgtgggggagtcttggtccagccgtgggacggtccctaagctctcctgtgcacgtcctcgtgactcctacctcacnctacaancgaccacgtacgnggacgtcggtccgcgagccgtacggaggggacgggcgtgggaggttgggttcggtccgttagtaggaacgtaaccgaacaaaacctaaagtacggaccaaccgacccgacctaaaactaacgttaccctccgggtaccgttccgttaggtaaaggaaaacggcaaaggttaccttaccgaaaccctatttacccgaacgaaaaggagtaagttagtaaaccgtttagaaacggtaactaaaaccttctttaaactttactactacgtaaacaaataacgaaccgactaccgtaacgaaacggaaacccgacggaaacgcccgggttaacctacgttttaatttaacgttggtacgtaacgtaacgtaccggtaacgttaaagaacgtaaaccgaacgggtaccggtacggtacgttaggttacgtttaccgggg

SEQ ID NO: 426598 - DNA, 673 bp, Homo sapiens
  misc_feature: GZ8MTXP02JOOOA.3.17.B06.1.454.CMB.2.raw
  modified_base (258)..(258): a, c, t, g, unknown or other
  modified_base (310)..(310): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggagcttggtccagcctgggacgggtccctaagactctcctgtgcagcctntggactcaccttcacgctacaatcggccactacggtggacctcggggtcccnccgaggcctccggaagggggaaggggctggggaggtggggttcggccgtttcgtaagacgacaacgtaactaacgagtccgaccaccgacaacaactaccggaccgcgttcgtaggtacggaaaacggcaagtacttcccaaccctatacctacgaaaggcgtaattaggaacttacgaagtaacgtaaaccttccttaaacttttactacttacgaaactaaaagttacgaaaaccgcgtaccccgtaagggaaaccgaaacccggaccgaaaccgtaccgggccctttaacttagttacgttagtcgtacagtacgtactaggaataacgaacgtcgggtactaccgttggtacgttcggg

SEQ ID NO: 426599 - DNA, 578 bp, Homo sapiens
  misc_feature: GZ8MTXP02I9ENZ.3.17.B06.1.454.CMB.2.raw
  modified_base (254)..(254): a, c, t, g, unknown or other
  modified_base (267)..(267): a, c, t, g, unknown or other
  modified_base (299)..(299): a, c, t, g, unknown or other
  modified_base (342)..(342): a, c, t, g, unknown or other
  modified_base (359)..(359): a, c, t, g, unknown or other
  modified_base (370)..(370): a, c, t, g, unknown or other
  modified_base (446)..(446): a, c, t, g, unknown or other
  modified_base (455)..(455): a, c, t, g, unknown or other
  modified_base (473)..(473): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggaggtccctaagactctcctgtgcagcctntggactcaccttnacgctcaatggccactacgtggactgggtccnccaggcctccgaggggaagggctgggagtggggttgccgtttnagagacacgaactaacngtcgacaccgnaacaataccgccgcgtctaggtacgaaaaggcaagattccaaccatccgtacaagagatgattcgaagtagaactnaactttaanctagacaaaatcgaaacngcctagacgaaaccgacgacgacgggcctactagttattggtatactataacgaccttaaggaacttaacaaacggtacggtacggtaccttgggtactttcggg

SEQ ID NO: 426600 - DNA, 843 bp, Homo sapiens
  misc_feature: GZ8MTXP02I1NQ3.3.17.B06.1.454.CMB.2.raw
  modified_base (260)..(260): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttatttacaaggtgtccagtgtgaggtgcacgtggtggagtcgtgggggagcttggtccagccgtgggacggtcctaagctctctgtgcagcctncggactctaccttcacgctacaacgtcggacctacgtacggtcggaccgtcggggtcccgccgaacggccgtaccggaagggggaacggggtcgtaggggtagggtttcggggttcggtacccgtttagtaacggaaacggtaccaaacccgtaaactaaccgaggtaccgaacccgaacccggacaaccgtaaacgttaccccggcccgggtaccgttacgtacgggtaaacgggaaaacgggtccctaaaggtaaacctttccccgaaaccgtacttaaccgttaaacgaaaagggtacggtaactttaaggtaaactttaccgggaaaagttaaaccggttaaaaccctttcgttttaaaactttttaccgaccgggttaaaacgtaaaaccgttaaaacggtacccggtaaaaccgtaccggtaacccgtaaacgggaaaaccccgggtaaaaccccggtaaccggtaaacccggtacccgggttaccctttaaagtttaacgtttacggttacggttacgtaacgtaacgtaacgtaaccggtaaggtaaccgtaaaccggtacgggtacggttacgg

SEQ ID NO: 426601 - DNA, 765 bp, Homo sapiens
  misc_feature: GZ8MTXP02IPWQN.3.17.B06.1.454.CMB.2.raw
  modified_base (594)..(594): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgtttgttattttacaaggtgtccagtgtgaggtgcacgtggtggagtcgtgggggagtcgttggtccagccgtgggacgggtccctaagacctctcctgtgcacgcctcgtggacctccaccttcaccgctacaatcggacctaactaccggtggaccgttcggggtccccgccgacggggtcctccgggaaaggggggtaacgggtcgtaggggtagggttcggggtttcgggaccccggtttacgtacggaacgtaacctaaaccgtaaacgtaaacgtacggtaccgaaccctaccccggcaaaacgtaaactaacccggccgtccggttcgtaggtaacggaaaacgggccaaaggttacttaccaaacccgtatacccgtaagaaagagtaagtacgtattacgaaaggtaacaaaccttcttaaacgttttacncgtaacgtaaactaagtacggaaaccgtacgtacgtaacggaaccgaaaccggacgtaaccggtaccggtaccgtttaacttatttagttcgtacttacgtaaacgtacgtaacggtagtaaacgtacggtaacggttacgggttacggtaccggttaggttacggtcggg

SEQ ID NO: 426602 - DNA, 727 bp, Homo sapiens
  misc_feature: GZ8MTXP02JFXOU.3.17.B06.1.454.CMB.2.raw
  modified_base (244)..(244): a, c, t, g, unknown or other
  modified_base (313)..(313): a, c, t, g, unknown or other
  modified_base (564)..(564): a, c, t, g, unknown or other
  modified_base (588)..(588): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacgtggtggagtcgtggggagcttggccagcctgggaggtccctaagctctcctgngcacgcctctggcctcaccttcacgtctacaaagtcggaccctacgtacggtggaccgtcggggtcccnccgagggcctacccggaagggggaacggggcttaggggaggttcgggggttaggccccgttttagaggacgaacctaaacgaaacctaacgagtccccgaaccacccggacaaacctaagtaccccgcccggtacgtccgtagggtacgaaaacgggtctaaaggtactttccgaaacccctagttacccgtagaaaaacggtgtaaacgttgaacgttacaaagggtaacttaacctcttaaacttttancttaggaacaaagtcgaaaacccncgtaccgtaaggaaaccggaacccgacggtacgtacccgtacgtttacgtaatttgtcggttacgactaacgttacggaacgtaacggtaactaaaccggaaacggttaccggtaggttaccgttaggttacggtcggg

SEQ ID NO: 426603 - DNA, 692 bp, Homo sapiens
  misc_feature: GZ8MTXP02GPJI3.3.17.B06.1.454.CMB.2.raw
  modified_base (257)..(257): a, c, t, g, unknown or other
  modified_base (263)..(263): a, c, t, g, unknown or other
  modified_base (316)..(316): a, c, t, g, unknown or other
  modified_base (481)..(481): a, c, t, g, unknown or other
  modified_base (490)..(490): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacgtgggtggagtcgtgggggaggcgttggtccagccgtgggacgggttccctaagactctcctgtgcngcctcnggactcaccttcacgctcaatcggtaccacgtacggtggacgtcggggtaccnccaggtcgtccgagggggaagggcgtggggaggttcggggttggtccggtttacgtaggaacgaccgaaacctaaaacctaacggtaacgtcgaacccgaccgacgaaacaaacgtacccgccgtccgtactaggaaggaaacgtccaagtacttaccaaacctnttaccgaanaaagagtattacgattacgaagaaactaactaccttaaacttctacgtagtaaactaaagtaacgaaactacgactaacggaaccgaaaccgacgaaccggtaccgtaccttagttaacgtttatacgtagtactaacgtaaaccgtacgtaagaaacgtaacggtaacggtacgggtacgttacgttgggtttacgtcggg

SEQ ID NO: 426604 - DNA, 750 bp, Homo sapiens
  misc_feature: GZ8MTXP02I4T5W.3.17.B06.1.454.CMB.2.raw
  modified_base (509)..(509): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcaccgtggtggagtcgtgggggaggcgttggtccaggccgtgggacggtccctaagactctcctgtgcacgcctcgtggactcctaccttcacgcttacaagtcggcctacgtacggtcggtacgtccggggtcccgccgacggtccgtccggaagggggaacggggtccgtggggacgggttggggttcggtccggtttactaaggacgaaccaacaaactaaacgtacggtacccgaaccaccgacaactaacgtcccgccgcgttccgtagaacggaacggcaaggtaacttcccgaaactcgttacacgaaaaggtntagttacgtatacgaaacgaacgtacttactttaagttactacgtacgaaactaaagtacgaaaccgcgtaccgaacgaaaccggtaaaccgaaccgacccggtaacgttaacccgtttacttacggttttagtacggttaacctacgttaaaccgtaaaacggtcgttaaaacgtaaccgtaaaccgggtaaccgggtacgggttaccggtttaacgggtttcgggttacgtttccgggg

SEQ ID NO: 426605 - DNA, 997 bp, Homo sapiens
  misc_feature: GZ8MTXP02IIALA.3.17.B06.1.454.CMB.2.raw
  modified_base (260)..(260): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcgtggttttcttgttgttatttacaaggtgtccagtgtgaggtgcacctgggtggagtcgtggggggaggcttgggtccagcctgggacgggtccctaagactctcctgtgcagtcctntggactccaccttcacgctcaatcggacctacgtacggtggaccgtcggggtccccgccgacgggcctacccggaaagggggggaacggggtcctaggggtaggggttcgggggttttacggggccccggttttaacgtaagggaacgggtaaacctaaaacccgtaaaaccgttaaaaccggaaggttaccccgaaaaccccgaaccccggaacccaaaaccgtaaaaacgttcccccggggaacccccgttcggggtttacccttaaagggggtaaaaccggggtaaaaaacgggggcccctaaagggtttaaacctttaccccaaaacccccgttaaattaccccttaaacgaaaaacgggtaaaggtaaactttaagggtaaaccttttaaccgggaaaagggttaaaaccgtaaaacctttccctttaaaaccgttttttacgttaaacccttaggtaaaacctaaaaaggttaccgggtaaaaaccctacgggaaccccgttaaaggggaaacccggtaaaaaccccggtaaccgggtaaaacccgggaacccccgggggttaaccctttaaaaccgttttaagtttaaaccggtttcggtttaacggtaaacctaaagttaaacccggggttaaccttaaagggggtaaaaccctaaccggtaaaaaccggggttccgggggtttaacggggtttaaccccgtttagggggttaaaccggtttccggggg

SEQ ID NO: 426606 - DNA, 519 bp, Homo sapiens
  misc_feature: GZ8MTXP02FK8EJ.3.17.B06.1.454.CMB.2.raw
  modified_base (192)..(192): a, c, t, g, unknown or other
  modified_base (274)..(274): a, c, t, g, unknown or other
  modified_base (302)..(302): a, c, t, g, unknown or other
  modified_base (341)..(341): a, c, t, g, unknown or other
  modified_base (398)..(398): a, c, t, g, unknown or other
  modified_base (409)..(409): a, c, t, g, unknown or other
  modified_base (427)..(427): a, c, t, g, unknown or other
tcagagacgcactccacgaccggtgctcgatttagtcgatagtgaagggggagagcggagccccagccccagaattcccaggtgttttcatttggtgatcagcactgaacacagaggactcacccatggagtttgggctgagctggttttccttgttgttatttacaaggtgtccagtgtgaggtgcacctntggagtctgggtagcttgtccagcctggaggtccctagactctcctgtgcagcctctggactcacctcacgctcaatggccnctacgtggactgggtccgccaggctccngggaaggggctggagtgggttgccgtttctagagacacnctacagtcgacaccgcacatacgccgctctgtgaaagcagattcaccatctacaagngatgattcagngaaactcactttatcgtnacaaatgaacagccctgagaaccgacgacacgccgtactattagttgtagtcatacgacctaggaatacaacgacgtgtacctggtattcgg

SEQ ID NO: 426607 - DNA, 603 bp, Homo sapiens
  misc_feature: GZ8MTXP02GC62H.3.17.B06.1.454.CMB.2.raw
  modified_base (253)..(253): a, c, t, g, unknown or other
  modified_base (299)..(299): a, c, t, g, unknown or other
  modified_base (337)..(337): a, c, t, g, unknown or other
  modified_base (367)..(367): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggaggtccctaagctctctgtgcagcctcnggactcaccttcacgctcaatggccacgtaccgtggacctgggccnccaggctcgaggggaagggctggaggtgggtgccgttnagagacaacaacaacgtgacgaccaccganacaagtaccgcgcgtcagtagaaacgcaagacttcaccatcctaacaagagatgattcgaagtacgaactctaactttagcctagacaaaatcgaaacacgtccaggaacgtaaacccgacgtaaaccgccgggcctttaacgttatttattacggtcggttaaccaaggtaacgaccgttaaggaaccttaaaccgacggtacggttcggtaaaccttggggtaactttccgggg

SEQ ID NO: 426608 - DNA, 647 bp, Homo sapiens
  misc_feature: GZ8MTXP02IV170.3.17.B06.1.454.CMB.2.raw
  modified_base (245)..(245): a, c, t, g, unknown or other
  modified_base (250)..(250): a, c, t, g, unknown or other
  modified_base (282)..(282): a, c, t, g, unknown or other
  modified_base (293)..(293): a, c, t, g, unknown or other
  modified_base (328)..(328): a, c, t, g, unknown or other
  modified_base (332)..(332): a, c, t, g, unknown or other
  modified_base (344)..(344): a, c, t, g, unknown or other
tcagagacgcactccacgaccggtgctcgatttagtcgatagtgaagggggagagcggagccccagccccagaattcccaggtgtttcatttggtgatcagcactgaacacagaggactcaccatggagtttgggctgagctgggttttccttgttgttattttacaaggtgtccagtgtgaggtgcacctggtggagtcgtgggggagcttggccagcctggaggtccctaagctctctgtgcngcctnggactcaccttcacgctcaatggccacgtcgnggactggtccnccaggctcgagggaggctggagtggttgccgtttnaganacacactaaacngtcgaccaccgcaacaagtaccgcccgcgtcctaggtagaaaacgggctaaggactttacccgaaccctattccgtacaaaggagtataggtaactttcgaaggtaacaaactctaaactttattacacgtacaaaattcgaaaacctagcctaggaacgaaaccccgacgaaccgaccgggtccgttacttaagtttagttcgtacggttactaacgttaacgtaacccgttaagggtaactaaaccggtaaacgggtaacccgggttgttaaaccccgttaggggttaacttttcccgggg

SEQ ID NO: 426609 - DNA, 568 bp, Homo sapiens
  misc_feature: GZ8MTXP02I32D2.3.17.B06.1.454.CMB.2.raw
  modified_base (296)..(296): a, c, t, g, unknown or other
  modified_base (338)..(338): a, c, t, g, unknown or other
  modified_base (350)..(350): a, c, t, g, unknown or other
  modified_base (361)..(361): a, c, t, g, unknown or other
  modified_base (399)..(399): a, c, t, g, unknown or other
  modified_base (402)..(402): a, c, t, g, unknown or other
  modified_base (407)..(407): a, c, t, g, unknown or other
  modified_base (411)..(411): a, c, t, g, unknown or other
  modified_base (418)..(418): a, c, t, g, unknown or other
  modified_base (428)..(428): a, c, t, g, unknown or other
  modified_base (446)..(446): a, c, t, g, unknown or other
  modified_base (466)..(466): a, c, t, g, unknown or other
  modified_base (487)..(487): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttatttacaaggtgtccagtgtgaggtgcacctggtggagtcgtgggggagcttggtccagcctggaggtccctaagactctctgtgcagcctctggactcaccttcacgctcaatggccactacgtggactgggccnccaggcctccgagggaagggctggagtgggtcgccgttcagnacacgaactacngtcgacaccgnacaagtaccgccgcgtctggtagaaagcagtatcaccntcnaagantagnttcaganactcatttanctgaccaaagtcgaaacnggctaggaacgtaaacccgngaaaccacgggtcccttaatntttaacgttggtactacacgtaacgaccttaagggaactaacgaaaccgtcgggttacgtaaccttgggtaactttcgggg

SEQ ID NO: 426610 - DNA, 712 bp, Homo sapiens
  misc_feature: GZ8MTXP02J2V43.3.17.B06.1.454.CMB.2.raw
  modified_base (394)..(394): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcaccgtggtggagtcgtgggggaggcttggtccagccgtgggacgggtccctaaagactctcctgtgcacgcctctggacctcaccttcacgctcaatcggaccacgtacgtggactcgggtcccgcgaggctacccgaggggaagggcgtaggaggttggggtcggcccgttagtagacgacaaccgtaaactacgagtcgaaccnccgacaaactaacgccggccgcgtacgtaggtacgaaagggcctaaagtacttcccaacctatacctacgaaaggtataatggaacttacgaaagtaacgtaacctacttaaaccttttactacgttacgaacctaaaagtcgaaaacgttaccgaccgttaacgggaaaaccgacccggtaaccggaacgtacccggggtaccttacttaaagttaccgtttagtacgtactaaacgtaacggtaaacccgttaaggaaccgtaaaaccggtaacggtacggtttaccggtaaaccgttcgggtttacgttccgggg

SEQ ID NO: 426611 - DNA, 531 bp, Homo sapiens
  misc_feature: GZ8MTXP02JFV6Y.3.17.B06.1.454.CMB.2.raw
  modified_base (338)..(338): a, c, t, g, unknown or other
  modified_base (361)..(361): a, c, t, g, unknown or other
  modified_base (415)..(415): a, c, t, g, unknown or other
  modified_base (440)..(440): a, c, t, g, unknown or other
  modified_base (443)..(443): a, c, t, g, unknown or other
  modified_base (452)..(452): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggagggtccctaagactctcctgtgcagcctctggactcaccttcacgtctcaatggccactacgtgactgggtcccagctcagggaggctggacgtgggttgccgttnagtagacaaccgaactacgagtnacaccgcacaactacgccgcgtctgtagaaaggccagacttcaccatcacaagngactgattcagacgactcactttancanacaatcaangactagacgacgacgacgacgtcctattacttagtcgtatactaagtacgaacgtaggactaacgtacggtacggtacg

SEQ ID NO: 426612 - DNA, 734 bp, Homo sapiens
  misc_feature: GZ8MTXP02FHE8W.3.17.B06.1.454.CMB.2.raw
  modified_base (315)..(315): a, c, t, g, unknown or other
  modified_base (550)..(550): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaggtgtccagtgtgaggtgcaccgtggtggagtcgtgggggagcttggtccagcctgggacgggtccctaaggacctctcctgtgcagcctctggacctcaccttcacgtctacaatcggacctacgtacggtggacctggggtcccncaggcctaccggaggggaagggtctggggaggttggggttacggcccgtttacgaggagaacccgaactaacgttaaccaggtccgaaccgaccggactaacgaactacccggcccgtcgtaccgtggtaaggaaaacggccaaaggtactttacaaaccctaatcccgttaacgaaaaggagtaattacggaactttaccgaaaggtcgtaaaaccttctaaactttttaaacncgtaagaactaaaagacgaaacacggaccgtaaggaaaccgaaacccggaccggtaaccgtacccgggttaccttaacgttactttacggttacgtacgtacctaacggtaacgaacccgttaaaggaactaaccggtaaacgggtcgggttaacggtaccggttacgggttacgttcccgggg

SEQ ID NO: 426613 - DNA, 673 bp, Homo sapiens
  misc_feature: GZ8MTXP02I5TIK.3.17.B06.1.454.CMB.2.raw
  modified_base (254)..(254): a, c, t, g, unknown or other
  modified_base (289)..(289): a, c, t, g, unknown or other
  modified_base (476)..(476): a, c, t, g, unknown or other
  modified_base (552)..(552): a, c, t, g, unknown or other
  modified_base (572)..(572): a, c, t, g, unknown or other
  modified_base (579)..(579): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggaggtccctaagactctcctgtgcagcctntggactcaccttcacgctcaatcggccacgtacgnggactgggtcccgccaggccttccgagggggaacgggctaggggaggtggggtttacggccgtttccgtaaggacggaccaaccgaaacctaaacaggtaccgaacccaccgactaacaaagtacccggcccgcgttcctggtacgaaaacggggccaaaggctttaccgaaaccctattaccctanaaaagggatattaggaactttaccgagaaaccgaaacttctaaacttttatactacgacaaaacttggaaaacccngtacctagaacggaaaccgngaaaccncgggtacccttagtactttaagttgacgtactaatacggaccttaaaggaactaacgaaacgtccgggttagtaccgttgggtaactttccggg

SEQ ID NO: 426614 - DNA, 625 bp, Homo sapiens
  misc_feature: GZ8MTXP02JRJ5T.3.17.B06.1.454.CMB.2.raw
  modified_base (187)..(187): a, c, t, g, unknown or other
  modified_base (259)..(259): a, c, t, g, unknown or other
  modified_base (275)..(275): a, c, t, g, unknown or other
  modified_base (344)..(344): a, c, t, g, unknown or other
  modified_base (347)..(347): a, c, t, g, unknown or other
  modified_base (359)..(359): a, c, t, g, unknown or other
  modified_base (379)..(379): a, c, t, g, unknown or other
  modified_base (384)..(384): a, c, t, g, unknown or other
  modified_base (419)..(419): a, c, t, g, unknown or other
  modified_base (422)..(422): a, c, t, g, unknown or other
  modified_base (448)..(448): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtncacctgggtggagtctgggggagcgttggtccagcctgggacgggttccctaagcctctcctgtgcagcctntggactcacttcacgntcaatcgccactacggtggacctgggcccgcaggtcctcgaggggaggctaggagtgggttggccgttnagngacacgactaangtcacaccgaacaatccgcnccgtntagtagaaagcaagtattccactagctcaataganagnttacgagagtaaacctctaactttancgttagacaaagtacgaactacgaccgtagaacgaacccgcgttaaaccgccgtaaccggtcttaagttaccttggtcgttaccgtaaagtttacaaacccgggttaagaagttaaaaccccgtaaacgggggtaccggtacgggtttaaacccgttgggttaaactttcccggggg

SEQ ID NO: 426615 - DNA, 497 bp, Homo sapiens
  misc_feature: GZ8MTXP01C7XO3.13.39.D06.1.454.CMB.2.raw
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgttggtggtataactatgtctcctggtatcaacaacacccaggcaaacgcccccaaactcatcattatgaagtcatttatccggcctcaggtatttctaaatcgcttctctggctcaagtctggcaacacggcctccctgaccatctctgggctcaggctagaaggacgaggctgattatactgcagtctcatataacaaccatacaaacacacaggttcttcggaagtgggaaccaaggtcaccgtcttaaggcc

SEQ ID NO: 426616 - DNA, 504 bp, Homo sapiens
  misc_feature: GZ8MTXP01A2T4J.13.39.D06.1.454.CMB.2.raw
  modified_base (225)..(225): a, c, t, g, unknown or other
  modified_base (426)..(426): a, c, t, g, unknown or other
tcagtcacgtactacacgaccggtgctcgatttagtgacatctcgcagttctttggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcttgggacttatagacttgtctcctggtaccaacaccacccaggcaaggcccccagagtcatcatttatgggggcaagtaggcggccgtcagggatttccacctcgcttctctggctccaagtctggcacacggcctcctgacatctctggtctcaggctgaggacgagctgcctagttactgctgctcatangctaggttcttctgtggtcttcggcggttagggtccaagttcgaccgttctaaggtcaagcccaggctcgccccgtcg

SEQ ID NO: 426617 - DNA, 530 bp, Homo sapiens
  misc_feature: GZ8MTXP01EDYE7.13.39.D06.1.454.CMB.2.raw
  modified_base (349)..(349): a, c, t, g, unknown or other
  modified_base (397)..(397): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctcttcagcagtgtagttctactggagctggatccggcagcccgcggaaggctggagtggatgggctatcaatgccagtgggggcacagctacaacccccctcctcaagacgccgcgtcnccatttcagtagacacgtcaagaccagactctccctgaagctgattcngtcgaccgcgcaggacacggccgtgtatactggtgcgcgtacaggtcggacgtctggggccaagggacccacgggtcacccggttcttcccgtcacggtccctaccaccgaacgggccccttaagttccccgg

SEQ ID NO: 426618 - DNA, 511 bp, Homo sapiens
  misc_feature: GZ8MTXP01EFHYP.13.39.D06.1.454.CMB.2.raw
  modified_base (227)..(227): a, c, t, g, unknown or other
tcagtcacgtactacacgaccggtgctcgatttagtgacatctcgcagttctttggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcttgggacttatagacttgtctcctggtaccaacaccacccaggcaaggcccccagagtcatcatttatgggggcaataggcggccgtcagggatttccactcgcttctctggctcaagtctggcacacggcctcctgacatctctggtctccaggctgaggacgaggctgccctattactgtctgctcatatgctaggttcttctggttcggtcttcgggcggttaggtccaaagttcgaccgttctaaggtcaagcccaggcctcgccccgtcg

SEQ ID NO: 426619 - DNA, 522 bp, Homo sapiens
  misc_feature: GZ8MTXP01D9MQ4.13.39.D06.1.454.CMB.2.raw
  modified_base (372)..(372): a, c, t, g, unknown or other
  modified_base (392)..(392): a, c, t, g, unknown or other
  modified_base (409)..(409): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttcagcagtggtagtttctactggagctggatccggcagcccgccgggaaggactggagtggattggggcttatcaatgccagtgggggcaccagctacaacccccctcctcaagacgccgcgtcaaccatttcagtanacacgtcaaagaccagctcnccctgaagctgagttcngtcgaccgcgcaggacacggcctgtatactgtgcgcgacaggtggacgtcgtggggccaagggccacggtcaccgttcttcctcacgccctccacgacgggcccaagtcccgg

SEQ ID NO: 426620 - DNA, 504 bp, Homo sapiens
  misc_feature: GZ8MTXP01AW8RI.13.39.D06.1.454.CMB.2.raw
  modified_base (227)..(227): a, c, t, g, unknown or other
  modified_base (254)..(254): a, c, t, g, unknown or other
  modified_base (304)..(304): a, c, t, g, unknown or other
  modified_base (418)..(418): a, c, t, g, unknown or other
  modified_base (428)..(428): a, c, t, g, unknown or other
tcagtcacgtactacacgaccggtgctcgatttagtgacatctcgcagttctttgggggggtcacaagaggcagcgctctcgggacgtctccaccatggcctgggctctgctgctcctcaccctcctcactcagggcacagggtcctgggcccagtctgccctgactcagcctgcctcgtgtctggctctcctggacagtcgatcatcgtctcctgcactggaaccngcactgatgttgtggtatactatgtcnctgtatcaacacaccaggcaaagccccaaatcatcattatgatcatttancggtcctcaggtatttccgtaatcgtacttctctggctccaagtctggcacacggctccctgaccatctctgggctccaggctcgaagcgaggctgattatacgtgcagcctanatacacacanacaacaacacgagtcgttaggaacgtacggaacgacgttccaaccgtactaacggcacgacccaacgcccaacccg

SEQ ID NO: 426621 - DNA, 520 bp, Homo sapiens
  misc_feature: GZ8MTXP01BL6D6.13.39.D06.1.454.CMB.2.raw
  modified_base (440)..(440): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgttggtggtataactatgtctcctggtatcaacaacacccaggcaaacgcccccaaactcatcatttatgaagtcatttatcccggccctcagggtatttctaaaatcgtcttctctggctccaagtctggcaacacggcctccctgaccatctctggctccagctgaagcgaggctagattatactgccagtctcatntaacaaccataccaaagacaacacggttcttacgggaagttggggaaccaaaggttccaaccgtccgttaagggtaaccc

SEQ ID NO: 426622 - DNA, 586 bp, Homo sapiens
  misc_feature: GZ8MTXP01B5S6B.13.39.D06.1.454.CMB.2.raw
  modified_base (210)..(210): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctnatctgcagtgtctctggtgctcttcagcagttggtagtttctacgtggagctggactccggcacgcccggcgggaaggactggagtggattgggcttatcaatgccgaggtgggggcaccgagctaccaaccccccctcctacgaagacgcccgcgtcaacctatttcagtacgacacgtaccaaagaccagctcctccctagaacgctagacttcgagtcgacccgccgacaacgggacgacgggtccgtagttacttacgtggtacgaccggcgtacgagggtcggccggttcggcgggggaccaaacggggccgaacggtcccaccgttccttccgtcacgccctccaccgacggcccgttaacgttccccgg

SEQ ID NO: 426623 - DNA, 503 bp, Homo sapiens
  misc_feature: GZ8MTXP01BZYI4.13.39.D06.1.454.CMB.2.raw
  modified_base (233)..(233): a, c, t, g, unknown or other
  modified_base (381)..(381): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccngcactgatgtgtgtataactatgtctcctggtatcaacaacacccaggcaaacgcccccaaactcatcatttatgaagtcatttatccggccctcgagggtatttctaaatcgcttctctggctccaagtctggcaacacggcctccngaccatctctgggctccaggctgaaggacgaggctgattatactgcagtctacatataacaaccatcaaacacacaggttcttacggaagtgggaacctaaagcaccgtccttaaggtaacc

SEQ ID NO: 426624 - DNA, 585 bp, Homo sapiens
  misc_feature: GZ8MTXP01AN648.13.39.D06.1.454.CMB.2.raw
  modified_base (475)..(475): a, c, t, g, unknown or other
  modified_base (522)..(522): a, c, t, g, unknown or other
  modified_base (539)..(539): a, c, t, g, unknown or other
tcagtcacgtactacacgaccggtgctcgatttagtgacatctcgcagttctttggggagctctgggagtggagccccagccttgggattcccaagtgtttgttttccgtgatcaggactgaacacacaggactcaccatggagttggggctgagcgtggagttttccttacgttgctatggttagaaggtgtcagtgtgaggtgcacctggtggagtcgtgggggaggcttggtacaggccgtggggggtccctgagactctcctgtgcagcctctggattcaccttcagtaccctagacatgcactgggtccgaccaacgtctaagggaaaaggtccggaggtgggtctcgagggtattgggctagtggttggtgacactattctattcaggtacctcggtagaacggggccattcaccatcacagaagaaaactcgaccaaactaacctccttaccaactacttacaaagtnaacacacgagagagacggggacgacggcgtgtagtataagtagttgngaggagggattacgttnttattaattacttcgtacgtacggttgggtaacgaacggtaacccg

SEQ ID NO: 426625 - DNA, 559 bp, Homo sapiens
  misc_feature: GZ8MTXP01EO7J2.13.39.D06.1.454.CMB.2.raw
  modified_base (374)..(374): a, c, t, g, unknown or other
  modified_base (451)..(451): a, c, t, g, unknown or other
  modified_base (479)..(479): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctcttcagcagtggtagtttctactggagctggatccggcacgcccggcgggaaggctggagtggattgggcttatcaatgccgaggtgggggcacagctaccaacccccctcctacaagacgcccgacgtcaacatttcagtanacacgtacaaagaccagctctcctagaagtctagtacgttctgcgaccgccgcaacggacacggtcctgtattacgngtagcgcgacgagggtcggacgttcggnggggaccgaacgggttaccgacggtccaccggttcaccctcacgtccctaccgaccgacgggtccccttaagttccccgg

SEQ ID NO: 426626 - DNA, 508 bp, Homo sapiens
  misc_feature: GZ8MTXP01BGAO2.13.39.D06.1.454.CMB.2.raw
  modified_base (320)..(320): a, c, t, g, unknown or other
  modified_base (363)..(363): a, c, t, g, unknown or other
  modified_base (377)..(377): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactggtgttggtggttatactatgtctctgtatcaacaacacccaggcaaacgcccccaaatcatcatttatgaagttcatttancgccccctcgaggtatttctaatcgcttctctggctcaagtcnggcacacgcctccngacatctctgtctcagctgacggacggaggctcgaccttattacgtgctgctcatatgctaggttcttgttgtcggtcgttcgggcggttacgggtcaaaggtcgacccgtcgttacggtcaacgaacccg

SEQ ID NO: 426627 - DNA, 560 bp, Homo sapiens
  misc_feature: GZ8MTXP01D5PHU.13.39.D06.1.454.CMB.2.raw
  modified_base (258)..(258): a, c, t, g, unknown or other
  modified_base (269)..(269): a, c, t, g, unknown or other
  modified_base (343)..(343): a, c, t, g, unknown or other
  modified_base (371)..(371): a, c, t, g, unknown or other
tcagtcacgtactacacgaccggtgctcgatttagtgacatctcgcagttctttggggagctctgggagtggagccccagccttgggattcccaagtgtttgtttccgtgatcaggactgaacacacaggactcaccatggagttggggctgagctggattttccttcttgctatgttagaaggtgtcagtgtgaagtgcagctggtggagtcgtgggggagcttggtacagcctggcagggtccctgagactctccngtgcagcctcnggattcacctttgatgattatgccatgcacgtggggtccgcaagcctccgaggggacggcctggagtgggtccncgaggtattagtggaaaattggtggtancagttagggctagtggcggactcgtggtgaagggccgagttccacctatctccagacgaacaacgaccaaagaacctcctagtactctagacaaatgaacagcctaggaagagctggaggaccaacgggttccttggttatttaagtgtaagtaacaaaagttactaaccccttaaacccgtttaacgg

SEQ ID NO: 426628 - DNA, 673 bp, Homo sapiens
  misc_feature: GZ8MTXP01DVTJG.13.39.D06.1.454.CMB.2.raw
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactgggtgaggccttcacagacccctgtccctcatctgcagtgtctctggtgctccttcagcagtggtagtttctactggagctggatccggcacggcccggccggggaagggactggagtggagttgggcttatcaatgccgaggtcgggggacaccgagcctaaccaaccccccctccctacaacgacgcccgacgtccaaccatttcaagtacgaccacgtaccaaacgaccagcctcctcccgtagaagtcgtagtacgttctgtcgaccgccgcaacgggaccgaccggtccgttagtaacttaccgtgtcggccgcgtaacgtacggggtcgggaaccggttcggtacgggggacccgaaacgggggaccccgtaaccggggttcccgttaaccccgggttccttaccccgttaacccgacccggtaaccccgttaccccgaaccccgggttaaaccgggggtcccccttaacgggtttccccccggg

SEQ ID NO: 426629 - DNA, 669 bp, Homo sapiens
  misc_feature: GZ8MTXP01COITB.13.39.D06.1.454.CMB.2.raw
  modified_base (210)..(210): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctnatctgcagtgtctctggtgctccttcagcaggtggtagtttctacgtggagctggactccggcacggccccggaccggggaaggacgtgggagtgggagttggggcttagcaagtgcccgaggtgggggacaccgagcctaaccgaacccccccctccctacgaaacgacgccgaccgtacaacctatttacgaagtacgacacgtaccaaacgaacccagcctcctacccgtagaacgctagtacgttctggacgacccgccgacgaacggggaccgtaccgggtccgtagttacgttaccgtggttcgaccgcgaaccgtgggtcgggtaacggttccgggtacgggggacccgaaacggggacccgtaaccgggtccgttacccggttccttaccccgtaacgaaccggtcccctaccccggaaacccgaaccgggtccccaacgtttcccccggg

SEQ ID NO: 426630 - DNA, 540 bp, Homo sapiens
  misc_feature: GZ8MTXP01DBEQD.13.39.D06.1.454.CMB.2.raw
  modified_base (308)..(308): a, c, t, g, unknown or other
  modified_base (329)..(329): a, c, t, g, unknown or other
  modified_base (459)..(459): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgttggtggtatactatgtctctgtatcaacaacacccaggccaaacgccccaaactcatcagtttangaagtcatttactccggcctnaggtatttcgtaaatcgtcttctctcggctcaagtctaggacaacaccggcctccctgacctactctcgtgggcctccaggctagaaggggacgtaggtcttagtattatacgtgacagtctacattaanaacaacatacaaacacgaacttacggttcttacgggaagtggggaaccaacggttcccaccgttccgttaacggtaacccg

SEQ ID NO: 426631 - DNA, 576 bp, Homo sapiens
  misc_feature: GZ8MTXP01DEC6F.13.39.D06.1.454.CMB.2.raw
  modified_base (486)..(486): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttcagcagtggtagtttctactggagctggatccggcacgcccggccgggaagggactggagtggattgggcttatcaatgccaggtgggggcaccgagctaccaaccccccccgtccctacgaagacgcccgaccgttccaaccgtatttcgagtagaaccacgtaccaaacgaacccagcctctccctgaaacgctagagttctgtcgaccgccgacaggacacgggtcctgtattacgtgtgcgcgacgngggtgacggtcgtcgggggccaaaggggccacgggttcaccggttccttcctcgacgccctacccaccgaacgggccccaagttccccgg

SEQ ID NO: 426632 - DNA, 607 bp, Homo sapiens
  misc_feature: GZ8MTXP01DQW4F.13.39.D06.1.454.CMB.2.raw
  modified_base (210)..(210): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctnatctgcagtgtctctggtgctccttcagcagtggtagtttctactggagctggatccggcacggcccggcgggaaggctggagtggattgggcttatcaatgccgaggtgggggcaccgagctaccaaccccccctccctacaagacgcccgaccgtacaacctatttccaagtacgaccacgtaccaaacgaccagcctctccctagaaacgcttagtagttctggtacgaccgccgacagggaccgacggtccgttagtacttacgtggtcgaccgtcgacgtagggtcggaccgtcggtcgggggaccaaacggggacccgtacgggtccttaacccggttccttcccgtcgacgccccgtaccgaccgaacgggtccccaacgtttccccggg

SEQ ID NO: 426633 - DNA, 720 bp, Homo sapiens
  misc_feature: GZ8MTXP01CP9QW.13.39.D06.1.454.CMB.2.raw
  modified_base (573)..(573): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgctagtcgtctcgtggtcgtccttccttcagcgtaggttggtttacgtttcctagtggagtcgtaggacgtcccggcaccggcccggacgggaaggcgtgggtaggtggtagttggtacttagtacaagtcggaccgtaggggtcgggggaccaaccgacgtacctaaccctaaacccccccccttcccgaacgaaggaccgcccgtaacgtaccctaaccttaacgtttacgaaaggtaaccgaccgtaacccgtaacaaaaccgaaacctcgaccttccctaccgtagaacgtcttaggtacgttctacggtacgacccgccgaagacggaccgtaccggtccgttagtacttacgnggtcgacggaccgagtacgggtcggtacggttcgggacggggaccggaaaaccggcccgtaaaccgggtcccttaccgttccgttacccgtccgaacccgtcccaaccccggaaccggttaacccggtccccttcggtttcccccgg

SEQ ID NO: 426634 - DNA, 532 bp, Homo sapiens
  misc_feature: GZ8MTXP01CC1J1.13.39.D06.1.454.CMB.2.raw
  modified_base (233)..(233): a, c, t, g, unknown or other
  modified_base (445)..(445): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccngcactgatgttggtggtataactatgtctcctggtatcaacaacacccaggacaaacgcccccaaactcgtacatttatgtaaagttctatttactccggcccccctcgagggtatttctaatccgtcttctctggctcagtctgcacacgcctcctgaccatctcgtggctcgagctgaagacgggaggtctgtattatactgcagtctanatataccaactattacaaacacaacgtggttacgttcggaaggttcgggaacctaagtcctaccgttccgttaacgggcaacccggg

SEQ ID NO: 426635 - DNA, 609 bp, Homo sapiens
  misc_feature: GZ8MTXP01CF9RJ.13.39.D06.1.454.CMB.2.raw
  modified_base (229)..(229): a, c, t, g, unknown or other
  modified_base (313)..(313): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcgttgggacttatagtacttgtctcctggtaccaacaccaccaggccaacggcccccagacgtcatctagtttagngggggacaagtaggccggccgtcgagggtactttccaccttcgcttctcgtcggcctaccaagtctcggaccaacgccggtccctcctagacctaattcctcgtcggtcctccgaggtctaggacggacgaggtctacgtacccttagtttacgtgtcttacgtccttacagttacgtcgtcgttacggttttccttcgttggttcgggttcgttcggggtcgggttacggtacgtaaggttccgccggttccgtaaggtccgaacgtcccgacggcctcccgttccccgttccgg

SEQ ID NO: 426636 - DNA, 536 bp, Homo sapiens
  misc_feature: GZ8MTXP01B62E0.13.39.D06.1.454.CMB.2.raw
  modified_base (311)..(311): a, c, t, g, unknown or other
  modified_base (324)..(324): a, c, t, g, unknown or other
  modified_base (379)..(379): a, c, t, g, unknown or other
  modified_base (393)..(393): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactggtgttggtggttataactatgtctctggtatcaacaacacccagacaaacgcccccaaactcatctatttangaagtctatttanccggccccctgaggtatttctaatcgtcttctctgctcagtctgcacacgcctcngacatctctggtcncagctgaggacggaggtctcgcttatacgtgctgctctatatgcgtaggtttcttcgttggttcgggttccgttcgggcgggttacgggttaacccgaaaggttcggtacccggttccgttacggtccgaacggtaaccccgg

SEQ ID NO: 426637 - DNA, 593 bp, Homo sapiens
  misc_feature: GZ8MTXP01A87CI.13.39.D06.1.454.CMB.2.raw
  modified_base (233)..(233): a, c, t, g, unknown or other
  modified_base (317)..(317): a, c, t, g, unknown or other
  modified_base (487)..(487): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaacngcagtgatcgttgggactatagacttgtctcctggtaccaacacccacccaggaccaacggccccagacgtcatctagtttagngggggacaagtacggccggtccccgtacgagggtactttcccactccgtcttctctcggcctccgaagtctggaccaacgaccggcccctacccgtagaactaacttcctcgttcggtcctccgaggtcgtaggacgggacgggacggtcgtcgtacccttagttaccgngcctgtcctatactgtcgtaacgttcgtttcgttgttcggttcggttcggttcgggcgggttacggtaacgtaggtccgtacgtcggttacgtcgaaccgaaccgg

SEQ ID NO: 426638 - DNA, 580 bp, Homo sapiens
  misc_feature: GZ8MTXP01CYMW1.13.39.D06.1.454.CMB.2.raw
  modified_base (468)..(468): a, c, t, g, unknown or other
  modified_base (479)..(479): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttcactggagctggatccggcagcccgcgggaagggctggagtggattgggcttatcaatgccaggtgggggcacgagctaccaacccccccgtccctacaagacgcccgccgtacaacccgatttcagtacgacacgtaccaaagaacccagcctacgtccctagaaacgctagagttctgacgacccgcgcagggaccacggccgtagtattaccgngtgcgcgacgnggtcggacgtcggcgggaccgaacgggacccgtacggtccacccgttccgttacccgtcgaccgtccccgaccgacccgaaccggtcccttaacggtcccg

SEQ ID NO: 426639 - DNA, 767 bp, Homo sapiens
  misc_feature: GZ8MTXP01CL4RP.13.39.D06.1.454.CMB.2.raw
  modified_base (212)..(212): a, c, t, g, unknown or other
tcagtcacgtactacacgaccggtgctcgatttagtgacatctcgcagttctttggggactttctgagagtcctggacctgctgtgcaagaacatgaaacatctgtggttcttcctcctcctggtggcagctccagatgggtcctgtcccaggtgcagctgcaggagtcgggcccaggactgggtgaggccttcacacgacccctgtccctnatctgcagtgtctcgtggtgctccttcagctagtggtagttcacgtggagctggactccggcacggcccggaccggggaaggacgtgggagtggagttggggacttagtcgaagtcgccgtagggtcgggggaccaaccgagaccctaacccccgtaaccccctcctacgaaacgaccgcccgacgtccacctatttacgaacgtacgaaccacgtaccaaacgaaccacgtacctcctacccgtagaaacgtcgtaggtaacgtttccgttacggtaccggaacccggacccggacggaacgggtaacccgtaacccgggtacccggtttaacgttaaccgttaaccggttcggttaaaccggtcccggggaaccgtaaccggtaaacgggggtttcggggaacccgggtttccgggttaccggggggaaacccaaaccggggggtaacccctaacccgggggttacccttaccccgggttaccctccccggttaccgaaccggttcccccgtacccgaacccggtaaacccggggttcccccttaacccgggg

SEQ ID NO: 426640 - DNA, 632 bp, Homo sapiens
  misc_feature: GZ8MTXP01ANDUF.13.39.D06.1.454.CMB.2.raw
  modified_base (220)..(220): a, c, t, g, unknown or other
  modified_base (235)..(235): a, c, t, g, unknown or other
  modified_base (315)..(315): a, c, t, g, unknown or other
  modified_base (454)..(454): a, c, t, g, unknown or other
  modified_base (497)..(497): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtntctcgtggtgctctnagcagtggtagttctacgtggagctggactcccggcacggccccggaccggggaaggacgtggagtggagttgggcttancgaagtgccgaggtcgggggacaccgacgcctaccaacccccccctcctacgaacgacgcccgacgtccaacctattacgaagtacgacaccgtacaaacgaacccagcctacgtcccgtagaagtcctagacgttcgngtcgacccgcgacacgggacgaccgggtcgtagttacttacgnggtacgcgcgtacgtgggtcggtaaccgtcggtacgggggacccaaacggggccctaacgggtcccaccggttccttcccgaacgaccgtccctacccgaccggttaaccgggtccccttaaggtttcccccggg

SEQ ID NO: 426641 - DNA, 540 bp, Homo sapiens
  misc_feature: GZ8MTXP01DDB1E.13.39.D06.1.454.CMB.2.raw
  modified_base (260)..(260): a, c, t, g, unknown or other
  modified_base (449)..(449): a, c, t, g, unknown or other
  modified_base (460)..(460): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactgggtgaggccttcacagaccctgtccctcatctgcagtgtctctggtgctccttcagcagtgtagttctactggagcnggatccggcagcccgccgggaaggctggagtggattggggcttatcaatgccagtgggggcaccagctaccaaccccccctccctacaacgacgcccgcgtcaaccatttcagtagacacgtaccaaagaccagctctccctgaaagctgagttctgtcgaccgcgcaggacacggccgtgtattacgngtgcgcgacgnggtcggacgtcgtggggccaaaggggccaacggtcaccgttcttacctcgagccctccaccgacgggcccaagttcccgg

SEQ ID NO: 426642 - DNA, 639 bp, Homo sapiens
  misc_feature: GZ8MTXP01AK09M.13.39.D06.1.454.CMB.2.raw
  modified_base (235)..(235): a, c, t, g, unknown or other
  modified_base (258)..(258): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctcttnagcagtggtagtttctactgganctggatccggcacggcccggcgggaaggcgtggagtggattgggcttatcaatgccgaggtgggggcaccgagctaccaaccccccctcctacgaagcgcccgcgtccaacctatttcagtacgacacgtaccaaagaccagctctccctagaacgctgacgttctcgtcgaacccgccgacgaacggggaccgaaccggggtcccgttagttaacttaccgtggttcggccggcggtaacgtacggggtcgggaaccggtcgggtacgggggacccgaaacggggacccgtaaccgggttccgaaccccggttcttccccgttcgacccgtcccgttacccgaacccggaaccggggtccccttaacggtttcccccggg

SEQ ID NO: 426643 - DNA, 552 bp, Homo sapiens
  misc_feature: GZ8MTXP01D45R5.13.39.D06.1.454.CMB.2.raw
  modified_base (229)..(229): a, c, t, g, unknown or other
  modified_base (309)..(309): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcttgggacttatagacttgtctcctggtaccaacaccacccaggcaacggcccccagacgtcatcatttagngggggcaagtaggcggcgtcagggactttccacctcgcttctctggcctcaagtctggaccaacgccggcctcctgacaatctctggtctcgaggctgaggacgaggctgccttagttactgctgctcatatgcgtaggttcttcgtggttcggttcgttcgggcgggttacgggtacgaaaggttcgttaccgttactaagggtccaacggtccccgaagggcctccggcccccgtttccgg

SEQ ID NO: 426644 - DNA, 533 bp, Homo sapiens
  misc_feature: GZ8MTXP01BSVVS.13.39.D06.1.454.CMB.2.raw
  modified_base (358)..(358): a, c, t, g, unknown or other
  modified_base (389)..(389): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctcttcagcagtggtagtttctactggagctggatccggcagcccgcgggaaggctggagtggattgggcttatcaatgccaggtgggggcacgagctacaaccccccctcctcaagacgcccgcgtcnccatttcagtagacacgtcaagaccagctcnccctgaagctgtagttctgtcgaccgccgcagggacacggccgtgtacttacgtgtcgcgcgacagggtcggacgtcgtggggccaaggggccacgggtcaccggttcttcctcacgcctccaccgacgggtcccaagtcccgg

SEQ ID NO: 426645 - DNA, 526 bp, Homo sapiens
  misc_feature: GZ8MTXP01C5T4Y.13.39.D06.1.454.CMB.2.raw
  modified_base (229)..(229): a, c, t, g, unknown or other
  modified_base (442)..(442): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcgttgggacttatagacttgtctcctggtaccaacaccaccaggcaagcccccagagtcatcatttagtgggggcaagtaggcggccgtcgagggatttccacctcgcttctctggctccaagtctgggacaacaccggcctccctgacaatctctcggtctccgaggctgacggacgaggctgccttagttactgctgctcatntgctaggttcttcgtgttcggtcgttcgggcggaggtaccaagttcgccgttctaaggtcaacgccgaggcctcgccccgtcgg

SEQ ID NO: 426646 - DNA, 525 bp, Homo sapiens
  misc_feature: GZ8MTXP01CFB49.13.39.D06.1.454.CMB.2.raw
  modified_base (229)..(229): a, c, t, g, unknown or other
  modified_base (308)..(308): a, c, t, g, unknown or other
  modified_base (387)..(387): a, c, t, g, unknown or other
  modified_base (442)..(442): a, c, t, g, unknown or other
  modified_base (501)..(501): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcttgggacttatagacttgtctcctggtaccaacaccacccaggccaaggcccccagagtcatcatttagngggggcaagtaggcggccgtcgagggtactttccgacctcgcttctctggcctccgaagtctggccaacacggcctccngacagtctctggtctccgaggctgaggacgagctgcctagtactgctgctcatangctagttcttcgtgtggtcgttcgggcggaggtcctaagttcgccgttcgtaagggtcncggcccagccgtcgccccgttcgg

SEQ ID NO: 426647 - DNA, 537 bp, Homo sapiens
  misc_feature: GZ8MTXP01BW9M4.13.39.D06.1.454.CMB.2.raw
  modified_base (229)..(229): a, c, t, g, unknown or other
  modified_base (372)..(372): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcttgggacttatagacttgtctcctggtaccaacaccacccaggcaacggcccccagagtcatcatttagtgggggcaagtaggcggccgtcgagggtatttccacctcgcttctctggctcaagtctggcaacncggcctcctgacatctctggtctcgaggctgaggcgaggctgccctagttctgctgctcatatgctaggttcttcgttggtggttcgttcgggcggttacgggtcctaaaggttcgccgttccgtaagggttccaacgcccgaggttccgtccgcccccgttcgg

SEQ ID NO: 426648 - DNA, 564 bp, Homo sapiens
  misc_feature: GZ8MTXP01AM825.13.39.D06.1.454.CMB.2.raw
  modified_base (210)..(210): a, c, t, g, unknown or other
  modified_base (235)..(235): a, c, t, g, unknown or other
  modified_base (353)..(353): a, c, t, g, unknown or other
  modified_base (485)..(485): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctnatctgcagtgtctctggtgctcttnagcagtgtagttctactggagctggatccggcagcccgcgggaaggactggagtggattgggcttatcaatgccaggtgggggcacagctacacccccctcctcagacgccgcgtccncctatttcgagtacgacacgtccaaagaccagcctactcccgtagaacgctagacgttctggtcgaccgccgcgagggaccacgggtccgtagtacttaccgtgtcgacgcgtacgaggtcggacgttcggnggggcccgaaagggacccgacggtcacccggttcttcccgtcacgccctacccgaccgaacgggtcccaagttccccgg

SEQ ID NO: 426649 - DNA, 697 bp, Homo sapiens
  misc_feature: GZ8MTXP01DH08M.13.39.D06.1.454.CMB.2.raw
  modified_base (220)..(220): a, c, t, g, unknown or other
  modified_base (224)..(224): a, c, t, g, unknown or other
  modified_base (234)..(234): a, c, t, g, unknown or other
  modified_base (255)..(256): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtntctntggtgctctnagctagtgtgttctactggannggactccggcacggcccggacgggaaggacgtggaggtggagttgggcttagtcaagtcgccgtaggtcggggggtaccaaccgacgtcctaaccctaaccccccccgtaccctacgaacggacgcccgtaaccgtaccaacctactttccaaacggttaacgaccgaacgtacccaaaacggtaaaccccaggtccttcccgtaccccgttaggaacgtacgttacggtacgtttccgttacggaccgaacccggcccgacgaacgggtaaccggtaccgggtacccgttagttaacgttaccgtggtcgacggccgtacgtacgggtcggtcggtcgggtcgggggaccgaacggggaccgtaccggtccgacccgttcttccccgtcaccgtccccgtaacccgacccggaacgggtccccttaacggtttcccccgg

SEQ ID NO: 426650 - DNA, 580 bp, Homo sapiens
  misc_feature: GZ8MTXP01CAWPR.13.39.D06.1.454.CMB.2.raw
  modified_base (229)..(229): a, c, t, g, unknown or other
  modified_base (250)..(250): a, c, t, g, unknown or other
  modified_base (396)..(396): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcgttgggacttanagtacttgtctcctaggtacccaacacccaccaggccaaacggcccccaagacgtacatctatttagtgggggacaagtaggcgccgtcagggtacttccacctcgtcttctctggctacctaagtctggcaaccacgccctaccngacaagtctcgtcggtctcaggctagacggacgagctgacccttagtactgctcgtctctatacttcgtcgttggtttcttcgtggttcggttcgttcgggcggttacgggttaccgtaaacggttcgttaccgttccgtaagggtaccaacggtacccgacggccgtccgttccccgttccgg

SEQ ID NO: 426651 - DNA, 755 bp, Homo sapiens
  misc_feature: GZ8MTXP01B8C0U.13.39.D06.1.454.CMB.2.raw
  modified_base (210)..(210): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctnatctgcagtgtctctggtgctccttcagctaggttggtagtttctacgtggagcgtggactcccggcacggcccggacgggaaggactgggagtgggagttgggacttagacaagtgaccgaggtcgggggacacgacgacctaccctacccccctaccagacgccgccgtactaccaactacttacgaacgtacgaccgtaccgtaaaccgaaaccgtaccgtacgtacccttacccgtaccgtaacgaacgtacggtttacggttacgttacggtacggtaaccccggtacccggaccgaacccgtaaccggggtaaccggtaccccggggtttaccgtttacgttaacgttaccggtcggtaccgggtacccggacggtaacggggtaccggggttccggtaaccgggtcccggggaacggggaaacccgggaaccgggttacccgtaccggtacccgttacccgttccgttaccccgtaaccgacccgtcccgtaacccggaccggttaaccccggtcccgttaaccgggtttccccccgg

SEQ ID NO: 426652 - DNA, 532 bp, Homo sapiens
  misc_feature: GZ8MTXP01DIK6B.13.39.D06.1.454.CMB.2.raw
  modified_base (233)..(233): a, c, t, g, unknown or other
  modified_base (450)..(450): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccngcactgatgttggtgtataactatgtctcctggtatcaacaacacccagacaaacgacccccaaatcatctaatttatagtaagtctatttactaccccgccctacgagggtactttactaaactcgtcttctctgctaccagtctggacacacggtcctcctgaccatctcgtcggcctccgaggctgaacggtacgaggactagattattctgcngtctacataactaacaaccataccaaacactacgacgttcttacggaagtacgggaaccaagcaccgtccgaaggtaacccg

SEQ ID NO: 426653 - DNA, 615 bp, Homo sapiens
  misc_feature: GZ8MTXP01EUR3C.13.39.D06.1.454.CMB.2.raw
  modified_base (219)..(219): a, c, t, g, unknown or other
  modified_base (235)..(235): a, c, t, g, unknown or other
  modified_base (497)..(497): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggccaggactggtgaggccttcacagaccctgtccctcatctgcagtntctcgtggtgctcttnagctagtggtatttctacgtggagctggatccggcacgcccggacgggaagggcgtggagtgggtagttggggctttatcgaagtggcccgagggtcgggggcaccgagcctaaccaacccccctccacgagacgcccgacgtccaacctatttacgacgtacgacctacgtaccaaacgaaccagtacctctaccctagaacgtctagtacgttcgacgtcgacccgcgacacggggaccgtacggtccgtgtaacttcgnggtcgaccggtcgtacggacgggtcggtaacggtcggtacggggaccgaaacggggcctacgggtaccacccggttcttacccgcgtacgcctaccgacgacggtccttaacgtcccg

SEQ ID NO: 426654 - DNA, 656 bp, Homo sapiens
  misc_feature: GZ8MTXP01EVMKG.13.39.D06.1.454.CMB.2.raw
  modified_base (309)..(309): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacgagggtcctgggcccagtctgccctgactcagcctgcctccgtgtctggctctcctggacagtcgatcatcgtctcctgcactggaaccagcactgatgttggtgtataactatgtctctgtatacaacaacaccaggacaaacgccccaaactcatctatttanagtaatctatttactcccggacctgaggtatttactaaatcgtcttctctcggctactaagtctacggacaacgaccggccctacccgtcgaccctatccgttcgtcgggccttccgaggcgtaggaaacggacggtagggtccttaggtaatttacgttaacgttggacctagtacccttactaacttaacgtaaaccctaaacccttacttaaacccgaaaacccaacgtaacccggttaaggggtttccccggtttaacgggggaaacgggtttaccggggaaaaccccgtaaaacgggttccccgttaaccccggttaacccgtttaacggggtaacccccgg

SEQ ID NO: 426655 - DNA, 643 bp, Homo sapiens
  misc_feature: GZ8MTXP01CPXC0.13.39.D06.1.454.CMB.2.raw
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctcttcagcagtgtagtttctactggagctggactccggcacggcccggcgggaagggactggagtggattggggcttatcaatgccgaggtgggggcaccgagctaaccaaccccccctcctacaagacgcccgacgtacaacctatttcaagtacgacacgtaccaaacgaacccagcctacctccctagaaacgccttagtaacgtttccgtggtcgaacccggccgaccgaacggggaaccgacgggtcccgttagttaacttaacgtcggtcgaccggcgaaccgaggggtcgggaccggtcggtcgggggacccgaaacggggacccgtaaaccgggtcccttacccggttccttacccgtcgaaccgtccctacccgaacccgaacgggtccccaacgttccccggg

SEQ ID NO: 426656 - DNA, 541 bp, Homo sapiens
  misc_feature: GZ8MTXP01APN4W.13.39.D06.1.454.CMB.2.raw
  modified_base (228)..(228): a, c, t, g, unknown or other
  modified_base (306)..(306): a, c, t, g, unknown or other
  modified_base (419)..(419): a, c, t, g, unknown or other
  modified_base (427)..(427): a, c, t, g, unknown or other
tcagtcacgtactacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcttgggacttatagacttgtctcctggtaccaacaccacccaggcaaggcccccagagtcatcatttagngggggcaataggcggcgtcaggggatttccactcgcttctctggctccaagtctgggcacacggcctccctgacaatctctggtctcaggctgaggacgagctgcctattacngctgctcntactgctaggttcttcgtgtcggtcgttcgggtcggttagggtaccctaaaggttccgaccggttccgtaagggtcctaacggccccgaaggttccctcggcccccgttccggg

SEQ ID NO: 426657 - DNA, 602 bp, Homo sapiens
  misc_feature: GZ8MTXP01CWZM6.13.39.D06.1.454.CMB.2.raw
  modified_base (533)..(533): a, c, t, g, unknown or other
  modified_base (562)..(562): a, c, t, g, unknown or other
  modified_base (567)..(567): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtcccctcatctgcagtgtctcgtggtgctccttcagcagttggtagtttctacgtggagctggatccggcacggccccggacggggaagggactgggaggtgggtagttggggcttaatcaagtcgccgaggtcgggggcaccgagcctaaccgaacccccccctccctacgacgacgcccgacgtaccaacctatttcagtacgacaaccgtacaaacgaaccagtcctacctccctagaaacgcgttagtacgttcgtgtccgaccgccgacacggacgcggtccgttagtacttacgtgtgccggtcgacgagggtcgacgtcggngggaccaacgggaccacggtcaccgttcncctcncgccctaccgaccgacgggtcccttaaggtccccg

SEQ ID NO: 426658 - DNA, 753 bp, Homo sapiens
  misc_feature: GZ8MTXP01EYB6J.13.39.D06.1.454.CMB.2.raw
  modified_base (213)..(213): a, c, t, g, unknown or other
tcagtcacgtactacacgaccggtgctcgatttagtgacatctcgcagttctttgggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagacccctgtcccctnatctgcagtgtctctggtgcttccttcagctaggttggttagtttctacgtggagcgtggactccggcacggcccggacgggaaggacgtgggagtgggtagtttggggtactttagtacgaagtcggacccgaagggtcggggggaccaacccgaggtaccctaaaccccgtaaaccccccccctccctacgaaacggaccgccccggaccgttacccaacccgtacttttaccgaacggttacgaacccgtaaccgggtacccaaaacgggaaccctacgaccttaccctaccccgtaggaaacgtccgttaggttacgttcgtacggtaccgacccgaccgacgaacggggacccgtaaccgggtccgttagttaacgtttaccgtggttcgaccggtcgaacggtacggggtacgggtaaccggtcgggtacggggttacccggaaacggggacccgtaccggtaccgacccggttccttacccgtccgacgtccccgtacccgacccggaccgggtcccttaacggtttccccgg

SEQ ID NO: 426659 - DNA, 770 bp, Homo sapiens
  misc_feature: GZ8MTXP01DO69L.13.39.D06.1.454.CMB.2.raw
  modified_base (228)..(228): a, c, t, g, unknown or other
  modified_base (234)..(234): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactggaaacngcagtnatcgttggacttatagtacttgtctcctaggtaccaacaccaccgaggaccaacggcccccagacgtacatctagtttagtgggggacaaagtacggccggccgtacgagggtactttcccgacctcgtactttcgtctcgggtaccttaccaaggtcctacgggacccaaaccgtacccgggtcccctacccgtacggaacctaaacttccgttcgtcgggttacccttacccgaacgggtccttaagggaacggtaccggaacggtcccgtttacgggtaccccttaaaggtttaccgtacgggtaccgttcgtacccgttaccgtaaactttggtaaaccgggttccgtttaaccggggttttccctttccggtttcgggtttccgggttaaccggttttccgggggaccgggttaacggggtttaacccgaaaacgggtttcccggttacccgggtttaaccccggtaagggttaccccgaaccggttaccccggaaaggttcccccgtcccggttcccccccgtttccggg

SEQ ID NO: 426660 - DNA, 659 bp, Homo sapiens
  misc_feature: GZ8MTXP01DTP12.13.39.D06.1.454.CMB.2.raw
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttcagcagtggtagtttctacgtggagctggactccggcacggccccggaccggggaagggactgggagtgggagtttggggctttagtacgaagttcggacccgtagggtcggggggccaccgacggcctaacccaacccccccctccctacaacggacgccccgacgtaccaaccgtatttcgaagtacgaccaccgtaccaaacgaacccagcctacctcccgtagaagtctagtacgttcgtgtaccgacccgccgacgaacgggaccgtaccgggtccgttagttacttaccgtgtacgcgcgacgtagggtcggaaccgtcggtcggggaccgaaacgggcccgtacgggtccgacccggttccttcccgtcgaaccgcccgtacccgaccggaaccggtccccgttaacgttcccccgg

SEQ ID NO: 426661 - DNA, 714 bp, Homo sapiens
  misc_feature: GZ8MTXP01BP2T0.13.39.D06.1.454.CMB.2.raw
  modified_base (229)..(229): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgtattcgttaggtacttatagtacttgtctccgtacgtaacccaaccacccacccgacggaccgaaccggccccagacgtactatactagtttaggtagggggacaaggtacgggccggtaccgtacgtacgggtacttccgacccgttccgtcttcgtcgtcgtacctaccgtaacgtccgtacggacccaaccgaccggtccctaccgtacgtacctaacttccgtcgttcggtcctaccggacggtcgtacgggaacgggaccggacgggtccgttacgtaccttaacggttccgttcgtccgttacgtaccttcgtacgttacgtcgtaccgttacggtttctttcggttcgggttccgggttcggttccggggtacggggttaccgggttaaccgtaaacggttccggttacccggttccggtaacggtccgtaaccggacccgtacgggttcccgtccccggttccccgttccg

SEQ ID NO: 426662 - DNA, 582 bp, Homo sapiens
  misc_feature: GZ8MTXP01AXI0Y.13.39.D06.1.454.CMB.2.raw
  modified_base (210)..(210): a, c, t, g, unknown or other
  modified_base (306)..(306): a, c, t, g, unknown or other
  modified_base (426)..(426): a, c, t, g, unknown or other
  modified_base (547)..(547): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctnatctgcagtgtctctggtgctcttcagcagtgtagtttctactggagctggatccggcacgcccggcgggaagggactggagtggattgggcttancaatgccaggtgggggcacgagctaccaacccccccctcctacaagacgcccgacgtccaacctatttccagtacgacacgtaccaaagacccagcctctccctagaacgctgtagttcngtcgaccgcgacgacggacacggtccgtagttattaccgtgtgcgcgacgaggtcggacgtcgtcggggaccaaacgggccgtaacggtccacccggttccttcccgtaacgccggtcccnccgacccggaaccgggtccccaacgttcccccggg

SEQ ID NO: 426663 - DNA, 688 bp, Homo sapiens
  misc_feature: GZ8MTXP01AKUTN.13.39.D06.1.454.CMB.2.raw
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctctcagcagtgtagtttctacgtggagctggacgtcccggcgacggccccggaccggggaagggacgtgggaggtgggtagtttggggctttagtcaagtggacccgagggtcgggggccaaccgacgcctaacccaaccccccccctccctacgaacgacgcccgtacgtacccaaccgtatttaccgaagtacgaccacgtaccaaacgaacccagcctacctcccgtagaacgtcctgtacgtttcgcggtacgaccccggccgacgaacgggacgtaccgggtcccgttagttaacgttacgtggtcggccggacgacggtagggtcgggccggttcgggtacgggggaccgaaacgggggaccccgaaccgggttcccacccgggttccttccccgtcgaaccgtccccgtacccgaacccggaccggggtccccttaacggtttcccccggg

SEQ ID NO: 426664 - DNA, 695 bp, Homo sapiens
  misc_feature: GZ8MTXP01E2GAI.13.39.D06.1.454.CMB.2.raw
tcagtcacgtactacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaacgcagtgattcgttgggtacttatagtacttgtctccgtacggtaacccaaccacccacccgaggaccaaccggccccagacgtacatctagtttaggtggggactaagtacggcggccgtacgacggtactttccaccgtccgtcttcgtcgtcggtacctaccgtaacgtccgtacgggacccaaccgaccggtcccctacccgtacgtaacctaacttccgtcgttcggtaccgtaccgacggtcgtacggaacgggacgacggtcgtacgtaccttaacgtttacgtgtctcgtaccttactaagttacgttcgtcgttacggtttcctttcgttcgggttcggttccggttcggggacggggttaaccgggttaaccgtaaacggttccggttacccggttaccggtaacgggtaccgaaccggtaccccgtaacgggttcccgttccccggttcccccgttcgg

SEQ ID NO: 426665 - DNA, 522 bp, Homo sapiens
  misc_feature: GZ8MTXP01EY4JR.13.39.D06.1.454.CMB.2.raw
  modified_base (302)..(302): a, c, t, g, unknown or other
  modified_base (321)..(321): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgtgtgtataactatgtctctgtatcaacaacacccagcaaagcccccaaatcatcatttangaatcatttatccggcctnaggatttctaaatcgtcttctctggctaccaagtctggcaacacggcctcctgaccatctctgggctccgaggctagaacggacgagggctgattattactgacatctacataataacaacccatacaaacgacaacacggttcttacgggaaggtcgggaaaccctaaaaggtccaccggttccgttaacgggtaacccg

SEQ ID NO: 426666 - DNA, 611 bp, Homo sapiens
  misc_feature: GZ8MTXP01A0399.13.39.D06.1.454.CMB.2.raw
  modified_base (210)..(210): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctnatctgcagtgtctctggtgctcttcagcagtggtagtttctactggagctggactccggcacggccccggccggggaagggacgtggaggtgggagttggggcttagtcaagtcgccgaggtcgggggacaccgagcctaccaacccccccctcctacgaacgacgcccgacgtaccaacctatttcagtacgacacgtaccaaacgaacccagcctcctaccctagaacgtctgtagttctgtcgacccgccgacgacggacgacggtccgtagtattaccgtgtcgcggcgacgagggtcggacgtcggtcgggggaccgaacgggacccgacgggtccacccggttcttcccgtcgacgtcccctaccgaccggaacgggtccccttaagttccccgg

SEQ ID NO: 426667 - DNA, 770 bp, Homo sapiens
  misc_feature: GZ8MTXP01BA7E4.13.39.D06.1.454.CMB.2.raw
  modified_base (263)..(263): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtcccctcatctgcagtgtctctggtgctccttcagcagtggtagtttctacgtggagcnggatccggcgacggccccggaccggggaagggacgtgggaggtgggtagtttgggggtactttaagtacgaaagttcggacccgtagggtcggggggaccaaccgacggtacctaacccaacccccccccttcccctacaaacggacgcccgaccgtaccaacctatttaccgaagtacgaccgacgtacccaaacgaaacccagtcctacctacccgtagaaacgtccgttaggtaacgtttccgtcggtaccgaaccccggccgaccgaacggggaaccgtaaccggggtcccgttagttaaacgtttcgtcggtcggtacccggacgtaaccggtaggggtccgggtaaccgggttccgggtaccgggggaacccggtaaacgggggttaccccgaaccggggttccccgttaaccccggttcccgttaccccgttccgtaacccgccccgtaaccccgaaacccggttaaacccgggggccccttaaccggtttccccccggg

SEQ ID NO: 426668 - DNA, 877 bp, Homo sapiens
  misc_feature: GZ8MTXP01CQ994.13.39.D06.1.454.CMB.2.raw
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacacgaccctgtcccctcatctgcagtgtctcgtggtgctccttcagtctaggttgtagtttctacgtggagtcgtggacgtcccggacgacggccccgggtaccggggaaacggggtacgtggggtaggttcggggtaagtttcgggggtacttttaacgtaccgtaaacgtcggtacccggtaaagggggttccggggggaccaacccgtaaacggtacccctaaacccccggtaaaccccccccccccttacccccgtaaacgaaacgggtacccggtacccccggtaacccggttaaccctaacccgttaacgtttttaacccgaaacgggttaaccggaacccgtaaccgtaaccccgaaaacggtaaaccccacggtcccttacccgtacccgtaacggaaacgtcgttacggtacggttcctacggtccggaaccccggcccgacgaacgggggtacccgtaacccgggtccggttacgttaacgtttaaccggcggttacgggcccgaaccggtacggtaacgggggtccgggtaacccgggtccggggtaacggggggaacccggaaaccgggggttaccccgtaaccgggtacccttacccgggttcccttcccgtaaccgacccgtccccgtacccgacccggaaccgggtccccttaacgggtttccccgg

SEQ ID NO: 426669 - DNA, 638 bp, Homo sapiens
  misc_feature: GZ8MTXP01AK5CY.13.39.D06.1.454.CMB.2.raw
  modified_base (229)..(229): a, c, t, g, unknown or other
  modified_base (251)..(251): a, c, t, g, unknown or other
  modified_base (291)..(291): a, c, t, g, unknown or other
  modified_base (300)..(300): a, c, t, g, unknown or other
  modified_base (305)..(305): a, c, t, g, unknown or other
  modified_base (313)..(313): a, c, t, g, unknown or other
  modified_base (408)..(408): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacgagggtcctgggcccagtctgccctgactcagcctgcctcgtgtctgctctctggacagtcatcatcgtctcctgcactggaccngcactgatgttgtgtataactntgtctctgtatcaacacaccaggacaaacgccccaaactnatcatttangaatntatttacncccgccctagaggtactttactaaactcgtcttcgctggcctacagtctgacactacggccctcgtcgaacctgtcctcgtacgggccttaccgnggtaccgtagaaacggggacgggtaaggtccttagtaaactttctttaacccggtcgtaaccgtacgtacctaaccttaaacttaaaccctaaaccctaaacccttaaactaaacccgaaaccgtaaaccgtaacggttacgggtttaaccgttacggggtaaacggtaacccgggtaaacccgtaaacggttccccgttaacccgggttaacccgttaacggtaacccg

SEQ ID NO: 426670 - DNA, 903 bp, Homo sapiens
  misc_feature: GZ8MTXP01BESV7.13.39.D06.1.454.CMB.2.raw
  modified_base (236)..(236): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttnagctagttggtagtttctacgtggagcgtggacgtcccggcgaacggccccgggaccggggaaacggggtacgtagggaggttggggtagtttgggggtactttaagtacgtaaagtcggacccgtaaggggtcggggggaccaacccgaacggtacccgttaaaccccctaaaccccccccccgttccccgtaacgaaacggacccggtaccccggaacccggttaacccaacccgttaacgtttttaccgaaacgggttaaccggtaaacccgtaacccgggttaaacccgaaaaacccggtaaaccccgtaaacggtccccttacccgttaccccgttacggtaaaccggtacccgttagggttaacggtttcccgttacgggttaccgggaaaccccggtcccgacccgtaaacggggaaccccgggtaacccggggttacccgtttaaggttaaccgtttaaccgtcgggttaccggaccgggtaccgtaacgggtacgggggttacggggtaaccggttccggggtaaccggggggaccgaaaaccgggggttacccgtaacccgggtcccgaaccccgggttccttaccccggtaaccgtaaccggcccctaacccgaacccggttaacccggggtccccgttaacggtttccccccggg

SEQ ID NO: 426671 - DNA, 821 bp, Homo sapiens
  misc_feature: GZ8MTXP01B718W.13.39.D06.1.454.CMB.2.raw
  modified_base (514)..(514): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggccaggactggtgaggccttcacacgaccctgtccctcatctgctagtgtctcgtggtcggtccttccttcgagctaggttggtagtttctaacgtggagtcgtggacgtcccggacgaccggcccgggacggggaagggtacggtagggaggttggggtaacgtttgggggtacctttaagtacgtaaaggttcggacccggtagggggtcgggggaccaacccgtacggtaccctaaccccgtaaacccccccccgtcccgtaacgaacggaccgcccgtaaccgtaccaaccgtatttaccgaacgtacgaccgtaacgtaaccgaaacgtaaccccgngtacccttacccgtacccgtaaggaaaccgtccgttaggtaacgtttcccgtacgggttacccgaacccgggcccgaaccgacgggggaaccccggtaccggggttaccgtttacggttaaacgtttcccgtggttacccggaccgggtaacgaaccgggtagggggttccggaaaccggtttccggggaacggggacccggttaaaacgggcccgtaaaccggtccttaaccccgggttcttcccgtaacgacccggttcccaacccggaacccggttaccggtaaccccttcgggtttcccccgg

SEQ ID NO: 426672 - DNA, 554 bp, Homo sapiens
  misc_feature: GZ8MTXP01DK6YC.13.39.D06.1.454.CMB.2.raw
  modified_base (231)..(231): a, c, t, g, unknown or other
  modified_base (315)..(315): a, c, t, g, unknown or other
  modified_base (378)..(378): a, c, t, g, unknown or other
  modified_base (388)..(388): a, c, t, g, unknown or other
  modified_base (402)..(402): a, c, t, g, unknown or other
  modified_base (436)..(436): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcacgtggaaacngcagtgattcgttgggacttatagtacttgtctcctggtacccaacaccacccaggccaacggcccccagatcatcagtttagngggggacaataggccggcgtcgaggtcttccacctcgcttctctggctcaagtctggccaacnccggcctccngactatctctgtcncgagctgagacgagctgcctagttactgctgctnactagtcgacgtcgtttcttcgtggtcggttcgttcgggcggttacgggtaccaaggttcggcccgttaccgtaagggtacaacggtcccgagggttccctccggcccccgttaacgg

SEQ ID NO: 426673 - DNA, 671 bp, Homo sapiens
  misc_feature: GZ8MTXP01CGZRP.13.39.D06.1.454.CMB.2.raw
  modified_base (230)..(230): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaaacngcagtgattcgttaggtacttatagtacttcgtctcctacggtaacccaaccacccaacccgacggaccaacggaccccagacgtcatactaagtttaggtacgggggactaagtacggccggtaccgtacgaggtactttccgtaccgtccgtcttcgtcgtcggtaccttaccgtaagtcgtacggaccaaccgaccggtccctaccgtacgaacctacttccgtcgtcggtcctaccgaggtctaggacggacggacgtctacgtaccttacgttacgtcgtcgtcgtacctctattacgtcgtacgttacggtttcttcgttcggttcggttccggttcggggtacgggttacgggttaaccgtaacggttcggttacccgttaccgtaacggtaccgaaccggtacccgtacggttcccgtcccggttccccgtcg

SEQ ID NO: 426674 - DNA, 609 bp, Homo sapiens
  misc_feature: GZ8MTXP01A3T8Q.13.39.D06.1.454.CMB.2.raw
  modified_base (210)..(210): a, c, t, g, unknown or other
  modified_base (304)..(304): a, c, t, g, unknown or other
  modified_base (565)..(565): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctnatctgcagtgtctctggtgctctcagcagtgtagtttcacgtggagctggactcggcacgcccggcgggaaggctggagtggattggggcttancaagtgacccgagggtcgggggcaccgagcctaccaaccccccccgtcctacgaagacgcccgaccgtcaacccgtatttcagtacgacacgtaccaaagaccagctccgtccctagaagtctaggtacgttcttgaccgaacccgccgacaacgggtaccgacggtccgttagtaacgttcgtggcgaccggacgtacgagggtcggaaccggtcgtcgggggaccaaacggggttccgaacgggttccacccggttccnccgtcacgtcctaccgaccgttacgggcccttaaggttccccgg

SEQ ID NO: 426675 - DNA, 707 bp, Homo sapiens
  misc_feature: GZ8MTXP01EAY4U.13.39.D06.1.454.CMB.2.raw
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactgggtgaggccttcacagaccctgtcccctcatctgcagtgtctcgtggtcgcttccttcagctaggttggtagtttctacgtggagcgtggactccggcacggcccggcgggaaggctgggagtaggtagttggggtacttaatacgaagtcggacccgtaagggtcgggggaccaaccgtaacgcccgtaaacccaaacccccccccgtcctacgaaacgccgtacccgaccgtacctaaccctagtttccgaacgtacgaaccacgtaacccaaaggtaaacccacgtacctccttacccgagaaacgtcttacggtacgttcgtggtacgacccggcaccgacggaaccgaccggtccgttagttacttacgtgtcgaccgacgtaccgtagggtaccggaacggttcgggcggggaaccgaaacggggttcccgaaccggttccgaaccccggttcttaccccgtccgaacccggccccttacccgaacccgaaccgggtccccttaacgtttcccccggg

SEQ ID NO: 426676 - DNA, 569 bp, Homo sapiens
  misc_feature: GZ8MTXP01BOXQB.13.39.D06.1.454.CMB.2.raw
  modified_base (229)..(229): a, c, t, g, unknown or other
  modified_base (431)..(431): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgattcttgggacttatagacttgtctcctggtacccaacaccacccgaggccaacggcccccagacgtcatcatttagtgggggacaagtacggcggccgtcgaggggtacttccaccgtcgtcttctctggctccaagtctgggacacgacggccctaccgtgactactctcgtgtctccaggcgtagacggacgngctgtcctagttctgtctgctctatatcgtctaggtttcttcgttggtcggttcgttcgggcggacgggtacgaaggttcgccgttcgtaacggtcgtaaccggcccgacggccgtcccggttcccccgttaaccggg

SEQ ID NO: 426677 - DNA, 779 bp, Homo sapiens
  misc_feature: GZ8MTXP01CT8IR.13.39.D06.1.454.CMB.2.raw
  modified_base (207)..(207): a, c, t, g, unknown or other
  modified_base (217)..(217): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctccagatgggtcctgtcccaggtgcagctgcaggagtcggccaggactggtgaggccttcacagaccctgtccctnatctgcagtntctctggtgctccttcagctaggttggttagtttctacgtggagtcgtggactccggcgaacggccccgggaccggggaaggacgtgggaagtgggtagtttggggtactttagtacgaaagtcggaccgtagggtcgggggaccaccgacggtacctaacccgaacccccccccgttccctacgaacggtaccgccccggaaccgttaccctaacctagtttacccgaaagggttaaaccgaacccgtaacccgttaaacccgaaaacgtaaaccccgtaacggtcccttacccgttaccccgaagtaaaaccggtcgtttacgggtaacgtttccgtaggttaccggaccccggaccggacccgaaacgggtaacccgggtaacccggggttccgttaacgtttaaacttcccggttggtcggaccggtacggacggtacgggttacgggcggttaacggcgggggaaccgtaaacggggacccgtaacgggtccttacccggttccttacccgtcaaccgtcctacccgaccgaacgggtccccttaacggttccccgg

SEQ ID NO: 426678 - DNA, 654 bp, Homo sapiens
  misc_feature: GZ8MTXP01DE3EK.13.39.D06.1.454.CMB.2.raw
tcagtcacgtactacacgaccggtgctcgatttagtgacatctcgcagttctttggggacttttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttcagcagttggtagtttctacgtggagctggatccggcacgcccggccggggaagggactgggagtggagttggggcttatcaatggccgaggtgggggcaccgagcctaccgaaccccccctccctacaagacgcccgacgtccaacctatttacgacgtacgtacacgtaccaaacgaaccagcctctccctagaacgtctgtacgttcgtcgtcgaaccgccgacgaacggggaccgaacggggtcccgttaggttaacttaccgtgttcggaccgtcgaaccgtgggtcgggaacgtcggttcgggggacccgaaacggggaccgtaacgggtcccaacccgggttccttacccgtaacgaccggcccctacccgaacccggttaaaccggggtccccttaacgtttcccccggg

SEQ ID NO: 426679 - DNA, 759 bp, Homo sapiens
  misc_feature: GZ8MTXP01AD71P.13.39.D06.1.454.CMB.2.raw
  modified_base (210)..(210): a, c, t, g, unknown or other
  modified_base (236)..(236): a, c, t, g, unknown or other
  modified_base (257)..(257): a, c, t, g, unknown or other
  modified_base (259)..(259): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctnatctgcagtgtctctggtgctccttnagcagtgtagttcacgtggangnggatccggcacggcccggacgggaaggctggagtgggtatgggcttagtcgtaagtcgaccgtagggtcgggggacaccgacggtacctaacccgtaaccccccccttcccgacgaaacggacgcccgaaccgttaccaacctatttacccgaagttacgaccgtaaccgtacccaaaacgaacccgagtacccttaccgtaccccgttagaaaccggtccgtagggttaactttaccgtggttacccgggacccgacccgacgaaccgggttaaaccgccggggttaccccgttagtttaaaccgtttcccggtggtccggaccgggaccggtaacgggtacggggttaccgggtccgggtaaccggggtaccggggaaccggtaaacccgggaccgttacccgggtaaccccggttacccgttcccgttacccgtcccggtacccgtccccgtaaccccggacccgggttaaccggtccccgttaaccggttccccgg

SEQ ID NO: 426680 - DNA, 611 bp, Homo sapiens
  misc_feature: GZ8MTXP01ELZKX.13.39.D06.1.454.CMB.2.raw
  modified_base (232)..(232): a, c, t, g, unknown or other
  modified_base (254)..(254): a, c, t, g, unknown or other
  modified_base (482)..(482): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgcctcctcaccctcctcactcagggcacgagggtcctgggcccagtctgccctgactcagcctgcctccgtgtctgctctcctggacagtcatcatcgtctctgcacgtgaaccngcactgatggttgtgtatactntgtctctgtatacaacaaccaccagacaaaccgaccccaaatcatactattacagtaactctattactccccgtcctagtagtactttactaaacgttcctcttctcgtcggtacctacgtaagtcgtacggacctaaccgccggtccctccgtacaccctagttcctcggtcgggtcctaccgagtacgtaaggaagggacggtaggtctagtaatttacttaccgngactactctactaactaactaaaccaacgttaactaaccgttaaacgtaaccgtacggttacggttcgttaacgggtaaggtaaccgtaaacctaacggtcccgttaccgttccgttaacggtaacccg

SEQ ID NO: 426681 - DNA, 545 bp, Homo sapiens
  misc_feature: GZ8MTXP01AO1WJ.13.39.D06.1.454.CMB.2.raw
  modified_base (229)..(229): a, c, t, g, unknown or other
  modified_base (389)..(389): a, c, t, g, unknown or other
  modified_base (404)..(404): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcttagggacttatagacttgtctcctggtaccaacaccacccaggccaacggcccccagacgtcatcatttagtgggggacaagtacggcggccgtcgagggactttccactccgcttctctggctccaagtctgggccaacgccgcctccngacaatctcgtgtcncgagctgaggacgaggtctgccttagttacgtgtctgctcatagtcgctaggttcttcgtgtggttcgttcgggtcggacgggtacaagttcgccgttccgtaacggtcaacggacccgtacgccgtcccgccccgttccg

SEQ ID NO: 426682 - DNA, 672 bp, Homo sapiens
  misc_feature: GZ8MTXP01C2YOI.13.39.D06.1.454.CMB.2.raw
  modified_base (228)..(228): a, c, t, g, unknown or other
tcagtcacgtactacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcgttaggtacttatagtacttgtctccgtacgtaaccaaccacccaccgacggaccgaaccgaccccagacgtcatactagttaggcggggactaagtacggccggtccgtacgtacggtcttaccgaccgtccgtcttcgtcgtcggtacctacgtaacgtcgtacggaccaaccgacccgtccctaccgtacgtaactacttccgtcgtcgtacctacgacggtacgtagggacggacggacggtctaccgtaccgttacggttacgtcgtcgtacgtcctacgtagttacgtcgtccgttggtttccttcggttcggttcggttcggttcggggtaccgggttacgggttaacccgtaacggttaccggttcccgttaccgtaacggtaccgaaccgtacccgtacggttcccgtccccggttccccgttcgg

SEQ ID NO: 426683 - DNA, 655 bp, Homo sapiens
  misc_feature: GZ8MTXP01CDD7H.13.39.D06.1.454.CMB.2.raw
  modified_base (211)..(211): a, c, t, g, unknown or other
  modified_base (560)..(560): a, c, t, g, unknown or other
tcagtcacgtactacacgaccggtgctcgatttagtgacatctcgcagttctttggggacttttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctnatctgcagtgtctcgtggtgctccttcagctaggttggttagtttctacgtggagtcgtggacgtcccggcacggcccggacggggaagggacgtggagtggagttgggcttagacgaagtgcccgaagggtcgggggaccaccgacggcctaacccaaccccccccgtcctacgaacggtaccgcccgaccgtaccaacctatttaccgaagtacgaccaccgtacaaacgaacccagtcctctacccgtagaacgtctaggtacgttcgtcgtacgaccgcgaccgacgggaaccgtaccgggtccctagtacgttacgtgcgacgcgacgagggtcgcggttcggngggaccaacggggcccgtaacgggtccaacccggttccttacccgaacgaccgtcccgtaccgaccgaacgggtccccttaacggtttcccccgg

SEQ ID NO: 426684 - DNA, 588 bp, Homo sapiens
  misc_feature: GZ8MTXP01D9WBE.13.39.D06.1.454.CMB.2.raw
  modified_base (555)..(555): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagacccctgtccctcatcctgcagtgtctctggtgctccttcagcagtggtagtttctactggagctggatccggcagcccggccgggaaggctggagtggattgggcttatcaagttgcccgaggtcgggggcaccgtagcctaaccaacccccccctccctacaacgacgcccgaccgtccaaccctatttcagttacgaaccacgtacgaacaaccagccttacctcccttggaaactccgtgtacgttcttgacgaccgccgcgtacggggacctaacggccgttcgtattacgtgtacgcgcgacgtaggtcggacgtcgtggggacccgacgggaccgtacggtccacgttcnccgtcacgccctcacgacggtcccaagtccccg

SEQ ID NO: 426685 - DNA, 577 bp, Homo sapiens
  misc_feature: GZ8MTXP01CVJ7T.13.39.D06.1.454.CMB.2.raw
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttcagcagtgtagtttctactggagctggatccggcacgcccggcgggaagggactggagttgagttggggcttatacaagtgccgaggtgggggacaccgagctaccaaccccccctcctacaacgacgcccgcgtaccaacctatttacagtacgacacgtacaaagaccagctctccagaacgctagattctgtcaccgacgcgagggaccgacgggtccgtagtattacgtgtcgcgcgacgagggtcggacgtcggtcgggaccgaagggaccgacgggtccaacccggttccacccgtcgacgcccgtaccgaccgaacgggtcccaacgttccccgg

SEQ ID NO: 426686 - DNA, 690 bp, Homo sapiens
  misc_feature: GZ8MTXP01A7GLB.13.39.D06.1.454.CMB.2.raw
  modified_base (236)..(236): a, c, t, g, unknown or other
tcagtcacgtactacacgaccggtgctcgatttagtgacatctcgcagttctttgggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcagtcaccatctcctgcacgtggaagcaaacngtgattagttgggtggttaatacctatcgtctcctaggtacccaacacgaccaaccccgaggaccaaaccgacccccaaactctaatttatttactgtactttacaacgttaacgaccgtaccctacgacggggtccctgaccttcgtcttctcgtcggtacctaccgtaagtccgtacgggaccaaccgtaccggtccctcccgtacgaccctacttccgtacgtcgggcctccgaggcctagacgagtagacggcttaggtacgggttacttccgtgccgttgtccctagtcgttaccgtaggaccggtaccttaaccccgttatttaaccgtttaaacgttcgggttaccgggaccgggttaaccggtaccccgaacggttcccgttacggttaaccccggtacgttaaccggaccgaccggttacccggaacggttcccgtaacccccgg

SEQ ID NO: 426687 - DNA, 727 bp, Homo sapiens
  misc_feature: GZ8MTXP01CGFBC.13.39.D06.1.454.CMB.2.raw
  modified_base (212)..(212): a, c, t, g, unknown or other
  modified_base (269)..(269): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactgggtgaggccttcacacgaccctgtccctnatctgcagtgtctcgtggtgctcttcagctaggttggtagtttctacgtggagtcgnggactccggcgacggcccggacgggaaggcgtgggaggtggagttgggacttagtacgaagtcggaccgaagggtcggggggaccaaccgacggaccctaaacccgaaaccccccccccttcccgacgaaacggaccgccccgtaaccgttaccaacccttaacgttttaccgaaacggttaacgaacccgtaaccggtaaacccaaaacggaaacccctaacggtcccttacccgtaccccgttaaggaaacgtcgttacggtaacgtttcgtacggttaccgaccccgaccgacgaacggggtaacgaccgggtccgttaggttacttacgtcggtacgcgtacgacggtagggtcggaccgtcggtacggggaccgaaacgggccgtaaccggtccacccggttcttcccgtcgaccgtcccacccgaaccgaccggtcccttaacgttccccgg

SEQ ID NO: 426688 - DNA, 652 bp, Homo sapiens
  misc_feature: GZ8MTXP01B2D4W.13.39.D06.1.454.CMB.2.raw
  modified_base (205)..(205): a, c, t, g, unknown or other
  modified_base (234)..(234): a, c, t, g, unknown or other
  modified_base (251)..(251): a, c, t, g, unknown or other
  modified_base (305)..(305): a, c, t, g, unknown or other
  modified_base (317)..(317): a, c, t, g, unknown or other
  modified_base (398)..(398): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacgagggtcctgggcccagtctgccctgactcagcctgcctccgtgtctggctctcctggacngtcgatcatcgtctcctgcactggaaccngcactgatgtggtgtanactatgtctctgtatacaacaacaccagacaaacgccccaaatcatctatttangaatctattacncccggtcctagaggtattactaaatcgtcttctcgtcgtcctactaagtcgtacggactaaaccgccggcccttcccgtanaaccctacttccgtcgtcgggccttaccgaggcttaggaaacggtacggtacggtaccttaggtaacttaacgtttaccgtgtaccgacggttacctacttaaactaaacctaaaccctaaacccttacgttaaacccaaaccaaaccgtaccgttaacgggtttccgttaaccgggggtaaacggttacgggggaaaacccctaaaacggttccccgttaacccggtttaacccgttaacggggttaaccccg

SEQ ID NO: 426689 - DNA, 629 bp, Homo sapiens
  misc_feature: GZ8MTXP01BRY1S.13.39.D06.1.454.CMB.2.raw
  modified_base (231)..(231): a, c, t, g, unknown or other
  modified_base (323)..(323): a, c, t, g, unknown or other
tcagtcacgtactacacgaccggtgctcgatttagtgacatctcgcagttctttgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactaggaaacngcagtgattcgttaggacttatagtacttcgtctccgtagtacccaaacacccacccgaggaccaacggccccagacgtcatctagtttagngggggactaagtcggcggcgtacgaggtactttccgaccttcgtcttctctcggtacctccgaagtctgggaccaacgaccggtcctcctacgacctaactcttcgtcggtcctacgaggtacgtaggtaacgggacgacggtctcgtaccttaggttacgtcgcttcgtctcattacgtggtctagggtttcttcgttagggttccggtttcggttccgggggtacgggttacggtaccgtaaaggttcgggttcccggttcgtaacgggtcaaccggaccgtacggcctccggttccccgttcg

SEQ ID NO: 426690 - DNA, 581 bp, Homo sapiens
  misc_feature: GZ8MTXP01AVOU7.13.39.D06.1.454.CMB.2.raw
  modified_base (209)..(209): a, c, t, g, unknown or other
  modified_base (426)..(426): a, c, t, g, unknown or other
  modified_base (437)..(437): a, c, t, g, unknown or other
  modified_base (475)..(475): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggccaggactggtgaggccttcacagaccctgtccctnatctgcagtgtctctggtgctcttcagcagtgtagttctactggagctggatccggcacgcccgccgggaaggactggagtggattgggcttatcaatgaccgaggtgggggcaccgacgctaccaaacccccccgttccacaacgacgcccgcgtcaaccatttcaaggtacactacgaccaaagacccagcctctccctgaagcttgaatttcgngtcgaccgcgnacggacgacggcgtagtactcgtgtcgacgacgtacgnggtcggcgtcggtcgggacccgaacgggccgtaccggtccgttacccgttccttaccgtccgtacgtaacccgacccgaccgaccggtcccgttaaccgttcccgg

SEQ ID NO: 426691 - DNA, 607 bp, Homo sapiens
  misc_feature: GZ8MTXP01BL3A0.13.39.D06.1.454.CMB.2.raw
  modified_base (218)..(218): a, c, t, g, unknown or other
  modified_base (229)..(229): a, c, t, g, unknown or other
  modified_base (250)..(250): a, c, t, g, unknown or other
  modified_base (302)..(302): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctcgtgtctggctctctggacagtcgatcatcgtctcngcactgaaccngcactgatggtgtgtatactntgtctctggtactcaacaaccaccagacaaacgccccaaatcatctatttanagaatctatttacgcccgcctgaggtactttctaaactcgtcttctcgtcggcctacgtaaggtctacggaccaaaccgtcccggtcccttacccgtacgaaccctacttccgttcggtcggggaccttcccgaacggtacgttacgggaaagggtaccggtaaggtccgttagtaatttaacgtacgtgactacgtctactactaactaaccaacttactaaccaaacacgtaacttacgggttcttacggggaagttacgggaacctaaacggtccttaacccggttcgttaacggtaacccg

SEQ ID NO: 426692 - DNA, 570 bp, Homo sapiens
  misc_feature: GZ8MTXP01AW98J.13.39.D06.1.454.CMB.2.raw
  modified_base (243)..(243): a, c, t, g, unknown or other
  modified_base (259)..(259): a, c, t, g, unknown or other
  modified_base (324)..(324): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgacgttcgnggtcaagactatgtcncctggtaccaacacacccaggcaacggcccccaaatcataattatgatttcactaatccggcctnaggtgtatctaactcgcttcactggacctcccaagtctacgggacaaacgccggccctccctagaccctatcctcgtggggccctacccgaggccaggaggaccgaggctagattacgtactgcggctccgtggactattacgctacctttatcgttcgttgggacttggtacgaccgtaaagggttcccaccggttcttacgggtccacggccccaaacggccccttaaacccctgttcgtaacc

SEQ ID NO: 426693 - DNA, 581 bp, Homo sapiens
  misc_feature: GZ8MTXP01AWTKL.13.39.D06.1.454.CMB.2.raw
  modified_base (266)..(266): a, c, t, g, unknown or other
  modified_base (275)..(275): a, c, t, g, unknown or other
  modified_base (297)..(297): a, c, t, g, unknown or other
  modified_base (409)..(409): a, c, t, g, unknown or other
  modified_base (418)..(418): a, c, t, g, unknown or other
  modified_base (420)..(420): a, c, t, g, unknown or other
  modified_base (423)..(423): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctgggtgcttccttcagctaggttggttatttctactggagcnggatccggnacgcccgcgggaggactggagnggattgggcttatcaagtgccaggtgggggcaccgagcctaccaaacccccccctcctacgaagacgcccggctacaaccatttccaagtacgacactacgaaacaccctanctctcagancngtntctcgtcgacgacgacgacggacgacgtcgtagtactacgtgtcgcgcgtacgacggtacggacggtcggtacgggaccggaacggaccgtaccgtacgaccgttccttccgtaaccacgaacccgtaccgaaccgaaccgtaaccgttaaccgtccg

SEQ ID NO: 426694 - DNA, 692 bp, Homo sapiens
  misc_feature: GZ8MTXP01DVPU3.13.39.D06.1.454.CMB.2.raw
  modified_base (230)..(230): a, c, t, g, unknown or other
tcagtcacgtactacacgaccggtgctcgatttagtgacatctcgcagttctttgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcatcaccatctcctgcactaggaaacngcagtgattcgttagggtacttatagtacttgtcctcctacggtaacccaaaccaacccaacccgaggacccgaaaccggtccccccaagacgtacaatccgtaagtttaggtcgggggactaagtacgggccgggtaccgtacgtagggtactttccacccgtccgtcttctcgtcggccttaccgtaagtcgtacgggaccaaccgacccggtccctcccgtcgaccctagtcctcgtgggcctacccggaggacgagggacggaccggagtctagtaatttacggtacgtcggtaccggtcttacgtacggaactacgtttacgaccctttaaccgtttagttccggttccggttcgggtacgttacggtacgttaaacccgtaacggtcccttacccgttccgttacggtcccgacgaaccccgtaacggaccccttaacccaacgttccgtaacccg

SEQ ID NO: 426695 - DNA, 667 bp, Homo sapiens
  misc_feature: GZ8MTXP01EIGCV.13.39.D06.1.454.CMB.2.raw
  modified_base (210)..(210): a, c, t, g, unknown or other
  modified_base (254)..(254): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctnatctgcagtgtctctggtgctctcagcagtgtattctagtggancgtggatcggcacgcccggacgggaaggctggagtggacgttgggcttagtcaagtgaccgtaggtgggggacaccgagacctaaccaacccccccctccctacaaagcgcccgacgtaccaaccgatttacgagtacgaacacggtaccaaagaccagtcctctaccctagaacgtctacgtagttcgacgtcgacccggaccgcgaacgggtaaccgacgggtccgttaggttaacttaccgtgttacgaccggaccgtaaccggtaggggtcggtaccggttcggtcgggggaacccgtaaacggggacccgaacgggttccccgaaaccgggtttccttacccgttaacgacccggttcccgaaccccgaaccgggttaaacccgggcccgttaacggtttcccccggg

SEQ ID NO: 426696 - DNA, 698 bp, Homo sapiens
  misc_feature: GZ8MTXP01CKI38.13.39.D06.1.454.CMB.2.raw
  modified_base (191)..(191): a, c, t, g, unknown or other
  modified_base (314)..(314): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacgagggtcctgggcccagtctgccctgactcagcctgcctccgtgtcnggctctcctggacagtcgatcatcgtctcctgcacgtggaaccagcactgtatggttggtgtataactatgtctctggtatacaacaacaccaggacaaacgacccccaaatcatctatttanagaagtctatttactccccggcctgaggtactttactaaacttcgtccttctacgttcggctaccgaagttcgcggtacccaaacgccggtccctacccgtagaccctagttccctcgtcggggccttacccgacggtcgttaacgggaaacggggtacggtaacgggttaccgtaggtttaaactttaaccgtttaccgttacgaccggtaacgttacccgtaacttaaacgtttaaaccaaaacccttaaaccaaaccggttaaacccaaaacctacgtaaccggttacgggtttaccggttaacggggtaaacgggtaccgggtaaaacccgtaaccgggttacccgttaacccggttaacccggttaaggtaacccccgg

SEQ ID NO: 426697 - DNA, 649 bp, Homo sapiens
  misc_feature: GZ8MTXP01C8BAS.13.39.D06.1.454.CMB.2.raw
  modified_base (265)..(265): a, c, t, g, unknown or other
  modified_base (445)..(445): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagacccctgtccctcatctgcagtgtctctggtgctccttcagtcaggttgtagtttctacgtggagcnggactcccggcgaacggcccggccgggaaggactgggagtgggattggggatttagtcgaagtcggcccgtaaggtcgggggacaacccgagtcctaaccaaacccccccctccctacgaagaccgcccgaccgttacaaccctaatttcaagtacgacctacgtaccaaacgaaacccngacctacctcccgtagaaacgcgtacgtaacgttcgtacgttcgaacccgccgacgaagggacctacggggtacccgtgtttaaactcgttgcggccgacgaccgtagggtgcgtcgggtcgggaccgtaacgggaccgtacggcaacccgttcttccgtaacccgcgtaaccctcgaaccgaacgggtccccaagttccccgg

SEQ ID NO: 426698 - DNA, 725 bp, Homo sapiens
  misc_feature: GZ8MTXP01A2B5A.13.39.D06.1.454.CMB.2.raw
  modified_base (210)..(210): a, c, t, g, unknown or other
  modified_base (236)..(236): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctnatctgcagtgtctctggtgctccttnagcagttggtagttctacgtggagcgtggactccggcgacggcccggacgggaaggacgtggaggtggaagtttgggctttaacgacgtaaagtcggacccgtaaggtcggggggaccaaccgacgaccgtaacccaaccccccccttccctacgaaacgtacgcccgtaaccgtacctaaccgtacgttttaccgaagggttaaccgaaccgtaacccgggtaccctaaaacggaaccccgaggtaccctacccgttacccgtaggaaacgtcgttagtaaccgttcgttacggacgaacccgccgtacgaacgggtaccgaccggggtaccttaggttaactttacggcggtaacggccggtacggacgtacgggttacgggacgttcggacggggaccgaacgggaccgtacggtcgttaacccgttcgttcccgtaacgccgtcccgtacccgaaccggaaccgggtcccaacgggttcccccgg

SEQ ID NO: 426699 - DNA, 607 bp, Homo sapiens
  misc_feature: GZ8MTXP01EW80V.13.39.D06.1.454.CMB.2.raw
  modified_base (210)..(210): a, c, t, g, unknown or other
  modified_base (234)..(234): a, c, t, g, unknown or other
  modified_base (253)..(254): a, c, t, g, unknown or other
  modified_base (290)..(290): a, c, t, g, unknown or other
  modified_base (389)..(389): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggacttcacagaccctgtccctnatctgcagtgtctctggtgctctnagcagtgtgttcactgganngatcggcacgccgcggaggctggagtgatggcttanacagtgcaggtgggcacagcctaccaacccccctcctacgaagacgcccgacgtccaacctatttacagtacgaccacgtacaaacgaaccagcctacncccgtagaacgtctagtacgttcgtacgcgacccgcgacgacgggacgacggtccgttagtacgttacgtcggtacgccgacggtaccgtagggtcggtaacggtcgggtacggggaccgaaacggggttacccgaacgggtccaacccggttcttaccccgtaaccgaccggtccccacccggaaccggaaccgggtccccttaacggtttccccgg

SEQ ID NO: 426700 - DNA, 726 bp, Homo sapiens
  misc_feature: GZ8MTXP01ET291.13.39.D06.1.454.CMB.2.raw
  modified_base (217)..(217): a, c, t, g, unknown or other
  modified_base (273)..(273): a, c, t, g, unknown or other
tcagtcacgtactacacgaccggtgctcgatttagtgacatctcgcagttctttgggggacttttctgagagtcctggacctcctgtgcaagaacatgaaacatctgtggttcttcctcctcctggtggcagctcccagatgggtcctgtcccaggtgcagctgcaggagtcgggcccaggactgggtgacggccttcacacgacccctgtcccctnatctgcagtgtctcgtggtgctcctcagctaggttggtagtttctacgtggagcgnggactccgggcacggcccggacgggaagggcgtggaggtgggtagtttggggactttagtacgaagttcggacccgtaggggttcgggggacctaaccgaacggtaccctaaaccccgtaacccccccccgtcccgtacgaaacggaccggtccccgtaccggttaccaacccttagtttaccgaacggttaacgaacccgtaaccggtaaccaaaacgaacccagtcccttacccgtacccgtaagaacgtcgttaggtacgtttcgacggttaccgacccgccgacgacgggacgccggggttctagtacttacgtcggtcgaccggagtacgtaggggtcggtacggtcggtacggggaccgaaacgggttccgtaccggtccgacccgttccttcccgtcgaccgtccccgtacccgacccggaacggtccccgttaacgttcccccgg

SEQ ID NO: 426701 - DNA, 633 bp, Homo sapiens
  misc_feature: GZ8MTXP01ENH1O.13.39.D06.1.454.CMB.2.raw
  modified_base (230)..(230): a, c, t, g, unknown or other
  modified_base (261)..(261): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactaggaaacngcagtgatcttagggacttatagacttgtcncctaggtaccaacaccaccgaggccaacggccccagacgtcatctatttagcgggggacaagtggccggccgtcgagggtactttccgaccttccggtcttcgtcgtcggaccttaccgaagttccgtacgggaccctaaccgaccggtccctccctagacctaactccgttcgtcggtcctacgacggtcgtaggacgggacgacgtcgttacgtacccttagttacgtggtcctcgtctacagttactcggtccgttaggtttccttcgttggttcggttccggttcggggacggttacgggtaccgtaaacggttcgcccgttacgtaacggtcaaccgtacccgacgccgtcccgttccccgttccgg

SEQ ID NO: 426702 - DNA, 697 bp, Homo sapiens
  misc_feature: GZ8MTXP01BD1U0.13.39.D06.1.454.CMB.2.raw
  modified_base (212)..(212): a, c, t, g, unknown or other
  modified_base (477)..(477): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacacgaccctgtcccctnatctgcagtgtctcgtggtgctcctcagctaggttggtacgtttctacgtggagtcgtggacgtcccgggcaccggcccggaccggggaagggctgggagtggagttggcttatcaagtgcgaggtgggggaccacgacgcctacctaacccccccctcctacgaacgtaccgcccgtaccgtacctaacctacgtttaccaagtacgaccaacgttaccgaaaacgaaccacgcctcctaccccgtagaacgtctgtacgttcncggttacgacccggccgtaccacgggaaccgtacggggtaccgttacgttagttaccgtcggtcggaccgggcgtaaccggtaaggggtcggtacccggtcgggtacccgggggacggaaaccggggacccgaccggggtacacccgggttccttaccccgaaccgaccgtaacccccgaccgacccggaaccgggtccccttaacgtttcccccggggg

SEQ ID NO: 426703 - DNA, 846 bp, Homo sapiens
  misc_feature: GZ8MTXP01DJ5GX.13.39.D06.1.454.CMB.2.raw
  modified_base (229)..(229): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactaggaaacngcagtgacgttcggtggtacaagacttatgtctcctaggtaacccaaacaaccacccaggaccaacggacccccaaactctaattaaatttacgtagttaactttacaacttaaacgttcccggccctacgtaggttattacttaccttaaactccgtacttaccgaaccgttcggtaacccttaccgtaaggttcccgtacgggtaacccaaacccgtacccggggtaccccttaccccgtacggtaaccctacgtttcccggtaccggtccgggggtacccttacccggaacggggaccaaacgggggaacgggaacccgggtaagggtaccgttaagggttaaactttttaaacgggttaacccgtcggggtacccgggttaccccgtttaccggtaacggggtaaccgttaacgttttaaaccggtacccctttaacccgtttttaggttaccggtttacccgggtttaaccgggggtaactttacgggttaacccggaaaccggttaaacccgggttcccgttaccccgggtttcccgttaaaccgggtcccgaaaccgtaacccccggaaaccgggacccccttaaaccccgtcgttaaccgttaaccccg

SEQ ID NO: 426704 - DNA, 605 bp, Homo sapiens
  misc_feature: GZ8MTXP01DGO69.13.39.D06.1.454.CMB.2.raw
  modified_base (212)..(212): a, c, t, g, unknown or other
tcagtcacgtactacacgaccggtgctcgatttagtgacatctcgcagttctttggggtgctggggtctcaggaggcagcgctctcaggacgtctccaccatggcctgggctctgctattcctcaccctctcactcagggcatagggtcctgggcccagtctgccctgactcagcctgcctccgtgtctggtctcctggacagtcatcaccntctcctgcactgggaccagcagtgacgttgtggtacaagtactatcgtctccgtagtaaccaacaaccacccgaggacccaaacggacccccaaatcaattaactttatagtaactttcaactaacgtccgcctagaggtctactactaatccgtacttcaacgttgctaccaaagtctacgacaacgacgtcccttaccacgaacctcgtctccgtgggcctcgaggcaaggacgtacgaggctagggtactttactacgcggcgccttaccgtggaacgtagttacgaccttacccgtttagtcgttcggttcggtaacttggtaacgaaccgttacgttccgttaccgttaacacggtccacgacccgttaacgccccgttaaaccctcg

SEQ ID NO: 426705 - DNA, 711 bp, Homo sapiens
  misc_feature: GZ8MTXP01BWUOF.13.39.D06.1.454.CMB.2.raw
  modified_base (211)..(211): a, c, t, g, unknown or other
  modified_base (229)..(229): a, c, t, g, unknown or other
  modified_base (231)..(231): a, c, t, g, unknown or other
tcagtcacgtactacacgaccggtgctcgatttagtgacatctcgcagttcgtttggggggggtcacaagaggcagcgctctcgggacgtctccaccatggcctgggctctgctgctcctcactctcctcactcaggacacagggtcctgggcccagtctgccctgactcagcctgcctccgtgtctggtctccgtggacagtcatcaccntctctgcactaggaaacngntagtgtatcgttaggtacttatacgtcttctctcgtacgaaccaacaccaccgacgaccgaaccgcccagactactatacgtagttaggacgggactaaggtcggccgtaccgtacgtacggttacttaccgtaccgttccgtcttcgtcgtcgtaacctaccgtaacgtcgtacgacctaacccgtcccgtaccctaccgtacgtaacctacgttccgtacgtcggttaccgacggtacggtacggacggaacgggtacggtacggtcttaccgttaccttagttacggtcgtacctcgtacttacgtagttacgtaccggttcgttacggtttccgttcggttgggttccgggttacgggttacggggtaacggttaaccggtaaccggttaacgggttcccggttaccggttaccggtaacggtacccgtaaccggtacccggtacccggttcccgtccccgggttccccgtaacgg

SEQ ID NO: 426706 - DNA, 680 bp, Homo sapiens
  misc_feature: GZ8MTXP01BLKKQ.13.39.D06.1.454.CMB.2.raw
  modified_base (206)..(206): a, c, t, g, unknown or other
  modified_base (211)..(211): a, c, t, g, unknown or other
  modified_base (218)..(218): a, c, t, g, unknown or other
  modified_base (231)..(233): a, c, t, g, unknown or other
  modified_base (249)..(249): a, c, t, g, unknown or other
  modified_base (258)..(258): a, c, t, g, unknown or other
  modified_base (276)..(276): a, c, t, g, unknown or other
  modified_base (289)..(289): a, c, t, g, unknown or other
tcagtcacgtactacacgaccggtgctcgatttagtgacatctcgcagttcgtttgggggggggtcacaagaggcagcgctctcgggacgtctccaccatggcctgggctctgctgctcctcactctcctcactcaggacacgagggtcctgggcccagtctcgccctgactcagcctcgcctccgtgtcgtcggtctccgtgacngtcancacatcnctgcacgtagaannnagtgatcgtgacttanagtcttgcncgtacgaccacaccacgngccaaccgccagntacattcgtagtttaggcgggacaacggtacggccggtacgtacgtacggttacttcccgacttccgtctttacgctacggaacccttacgaacgtcgtacggacctaacccgtccggtaccctcgtaagtaactacgttctacgtcggtaccacggtaggcgtacggaacggccgtacggtcctacggttaccctttaagggttcgttcgaccttacgtacctaactgttacgtcccgggtagtttccgggtttcgttcgggttcgggttaaccggttcgggggttaacgggacccggggtttaagaacccgggttacgttccggaccgtttccggaacgggtccgaaccccggtcgggtacttccccggttcccggttaacccgtccgg

SEQ ID NO: 426707 - DNA, 768 bp, Homo sapiens
  misc_feature: GZ8MTXP01BDV8T.13.39.D06.1.454.CMB.2.raw
  modified_base (194)..(194): a, c, t, g, unknown or other
  modified_base (210)..(210): a, c, t, g, unknown or other
  modified_base (220)..(220): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctccagatgggtcctgtcccaggtgcagctgcaggagtcgggcccaggactgggtgaggccttnacagaccctgtccctnatctgcagtntctcgtggtgctccttcagtctaggttggtagtttctacgtggagtcgtggactccggcgacgccccgggacggggaagggaccgtgggtaaggtggggtaagtttgggggtactttaagtaccgtaaagttcggacccggtaagggggtcggggggaccaaccgtacggacccttaaaccccgaaacccccccctcccgtaacgaaaggaccggcccgaaccgtacctaaccctatttacgaacgttaacgaaccgtaacggtaccaaaacggtaacccaagtcctacttaccccgtaagaaacgtccgttaggtaacgtttccgtacggaccgacccggaccgccgaacggaaccgaacccgggtcccgttaaggttacttaacccgtggttcgaccggtacgtaccgaagggttcggaacgttcggtaacggggacccgttaaacggggacccgaccgggggttaccacccgggttccgttaccctaacgggaaccccgtccccgtaacccgaaccggaccgggtaacccgttaaccggtccccg

SEQ ID NO: 426708 - DNA, 715 bp, Homo sapiens
  misc_feature: GZ8MTXP01AWAMR.13.39.D06.1.454.CMB.2.raw
  modified_base (211)..(211): a, c, t, g, unknown or other
  modified_base (237)..(237): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacacgaccctgtccctnatctgcagtgtctctggtgctccttnagctagttgtagtttctacgtggagcgtggactccggcacgcccggacgggaaggcgtggagtcgggagttgggacttagtcaagtcgacccgaagggtcgggggacaccgagtacctaacccaaccccccccgtcctacgaacgacgcccgtacgtaccaacctatttccgaagtacgactaccgtaaccaaacgaacccgagacccttcctaccctagaaacgtcgtagtacgttccgtgtaccgacccgccgacgaacggggtaccgtaaccgggtccgttacggtaattaccgtcggttcggaccggtccggtaacgtacggggttaccgggacggtcccggtagggggaccccgaaacggggttcccgtaaccggggttcccaaccggtttcccgttacccttaaccggaccgtaacccccgttacccgaaccccggttaaccggggtccccttaacggtttcccccccgggg

SEQ ID NO: 426709 - DNA, 574 bp, Homo sapiens
  misc_feature: GZ8MTXP01DU6UH.13.39.D06.1.454.CMB.2.raw
  modified_base (205)..(205): a, c, t, g, unknown or other
  modified_base (234)..(234): a, c, t, g, unknown or other
  modified_base (308)..(308): a, c, t, g, unknown or other
  modified_base (322)..(322): a, c, t, g, unknown or other
  modified_base (331)..(331): a, c, t, g, unknown or other
  modified_base (394)..(394): a, c, t, g, unknown or other
  modified_base (461)..(461): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacgagggtcctgggcccagtctgccctgactcagcctgcctcgtgtctggctctccgtggacngtcgatcatcgtctcctgcactggaaccngcactgatgttggtagtataactatgtctcctgtatcaacaacaccaggacaaacgaccccaatcatcatttanagtaatctattacnccggcctanaggtatttactaaatcgtctactcgtgctacgtaagtctggaccacgtaccggccctccgtanaccattcctcgtcgggccttacccgaggtacgtagaagggacggtaggtctaggtaattacgttacngtactagtactactaactaactaaaccaacttaactacaaacgtaacgtacgttacggttacgttaacggtaacggacgaacctaacgtcccgaccgtccgttaacgtaaccg

SEQ ID NO: 426710 - DNA, 490 bp, Homo sapiens
  misc_feature: GZ8MTXP02JI4FE.13.39.D06.1.454.CMB.2.raw
  modified_base (332)..(332): a, c, t, g, unknown or other
  modified_base (371)..(371): a, c, t, g, unknown or other
  modified_base (379)..(379): a, c, t, g, unknown or other
  modified_base (428)..(428): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactggtgttggtggttataactatgtctcctggtatcaacaacacccaggcaaagcccccaaaatcatcatttatgaagtcatttatcggccccctnagggtattctaatcgcttctctggctccaagtctgcacncgcctccngacatctctggtctcagctgaggagaggctgcctatactgctgctcatntgctaggttcttctgtcgtctacggcggaggtcaaggtcgaccgtgtacgtcgacgtacccg

SEQ ID NO: 426711 - DNA, 524 bp, Homo sapiens
  misc_feature: GZ8MTXP02GRBGU.13.39.D06.1.454.CMB.2.raw
  modified_base (409)..(409): a, c, t, g, unknown or other
  modified_base (418)..(418): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttcagcagtggtagttctactggagctggatccggcagccccgccgggaaggactggagtggattgggcttatcaatgtcaggtggggcaccagctacaacccccctcctcaagacgccgcgtcaccatttcagtagacacgtccaaagaaccagctctccatgaagctgagttcngtgaccgcncagacacggccgtgtattactgtgcgcgacgaggtggacgtcgtggggccaaggggaccacgggtccaccgtctccgtcgacgccctccaaccgacgggccctacg

SEQ ID NO: 426712 - DNA, 479 bp, Homo sapiens
  misc_feature: GZ8MTXP02IIKKN.13.39.D06.1.454.CMB.2.raw
  modified_base (306)..(306): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgtggtggttatactatgtctcctggtatcaacaacaccaggcaaagcccccaaatcatcatttangaagtcatttatccggcctcaggtatttctaatcgcttctctggctccaagtctgcacacgcctcctgaccatctctggctccaggctgaagcgaggctgattatactgcagctcatactacacatcaaacacacagtctacggaagtcggacaaacgtcacgtaccagtacg

SEQ ID NO: 426713 - DNA, 548 bp, Homo sapiens
  misc_feature: GZ8MTXP02JFL4V.13.39.D06.1.454.CMB.2.raw
  modified_base (229)..(229): a, c, t, g, unknown or other
tcagtcacgtactacacgaccggtgctcgatttagtgacatctcgcagttcgtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcgttgggacttatagacttgtctcctggtaccaacaccaccaggcaacggcccccagagtcatcatttagtggggacaagtaggcggccgtcgagggtatttccacctcgcttctcgtggctcagtctggacaacgccgcctccctgaccatctctcggtctccgagctagacggacgaggctgccttatactgctgcctcatactgctaggtttcttcgtggttcggttcgttcgggcggtagggtaccaaacggttcgtaacccgtcgtaacgggtcaacggcccgtaaggtctccggcccccgttcgg

SEQ ID NO: 426714 - DNA, 546 bp, Homo sapiens
  misc_feature: GZ8MTXP02JA7D2.13.39.D06.1.454.CMB.2.raw
  modified_base (307)..(307): a, c, t, g, unknown or other
  modified_base (360)..(360): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactgggtgaggccttcacagaccccgtcctcatctgcagtgtctctggtggctccttcagcagtggtagtttctactggagctggatccggcagccccgcgggaagggctggagtggattgggcttancaatgccagtggggcacagcacaacccctcccctacaagacgccgcgtcaccntttcagtacgacacgtaccaaagaccagctctccctgaagctagacgttctgtcgaccgccgcacgacacggccgtgtacttactgtgcgcgacgagggtcgacgtcgtcggggaccaaggggacccacggtccaccgtcgtccacgaacgccctaccgaccgaacgggcccaacgtccggtcccc

SEQ ID NO: 426715 - DNA, 530 bp, Homo sapiens
  misc_feature: GZ8MTXP02G3LM2.13.39.D06.1.454.CMB.2.raw
  modified_base (228)..(228): a, c, t, g, unknown or other
  modified_base (433)..(433): a, c, t, g, unknown or other
  modified_base (437)..(437): a, c, t, g, unknown or other
tcagtcacgtactacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcttgggacttatagacttgtctcctggtaccaacaccacccaggcaaggcccccagagtcatcatttatggggcaagtaggcggccgtcagggatttccacctcgcttctctggctccagtctggcaacacggcctccctgacaatcctctggtctccgaggcctgacggacgaggctgccttattactgctgcctnatangactggttctcgtggtcgtcgttcggcggtacggtactaaacggtcgtaccgtcgtaacggtcacggcccgaaggccttccgccccgttccgg

SEQ ID NO: 426716 - DNA, 508 bp, Homo sapiens
  misc_feature: GZ8MTXP02HL5J0.13.39.D06.1.454.CMB.2.raw
  modified_base (445)..(445): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgtggtggttataactatgtctcctggtatcaacaacaccaggcaaacgcccccaaaatcatcatttatgaagtcatttatcccggccctcaggtatttctaattcgcttctctggctccaagtctggcaacacgcctcctgacccatctctgggctccaggctgaacgacgagctgattatactgcagctcatactacaaaccntacaaacaccgacacggtaccttagggaaagtcgggaaccaaagtccaccgtcgtaacggtcc

SEQ ID NO: 426717 - DNA, 510 bp, Homo sapiens
  misc_feature: GZ8MTXP02J1DA7.13.39.D06.1.454.CMB.2.raw
  modified_base (309)..(309): a, c, t, g, unknown or other
  modified_base (321)..(321): a, c, t, g, unknown or other
  modified_base (330)..(330): a, c, t, g, unknown or other
  modified_base (372)..(372): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgttggtggttataactatgtctcctggtatcaacaacacccaggcaaagcccccaaatcatcatttangaagtcatttanccggccctnagggtatttctaatcgcttctctggctccaagtctggcaacncggcctcctgaccatctctggctccgagctagacgacgagctggattactctgcagctcatatacaacatacaaactacacacggttaccttacgggaagttcgggaacccaaggttaccaccggtacctaggacccg

SEQ ID NO: 426718 - DNA, 686 bp, Homo sapiens
  misc_feature: GZ8MTXP02JPT3P.13.39.D06.1.454.CMB.2.raw
  modified_base (228)..(228): a, c, t, g, unknown or other
tcagtcacgtactacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcgttggtacttatagtacttgtctccgtacggtaaccaaccacccaccgacggaccaaccggccccagacgtcatctagttaggtcggggactaagtacggccggccgtacgagggtacttccaccgtcgtcttctcgtcggtcctaccgtacgtcgtacggaccaaccgaccggtccctacccgtacgaacctaacgttcccgttcgtcggtccctacccgacggtccgtacgggaacgggacggtacgggtccgttacggtacctttaacgttacgtcgtccgttcgtacctacgtagtacgttcgtacgttacggtttctttcgtcggttcggttccgttcggggtacgggtaacgggttaccgtaaacggttccggtaacccgttaccggtaacggtaccgtaaccggtacccggtaacggtcccgtacccggtcccccgttacgg

SEQ ID NO: 426719 - DNA, 573 bp, Homo sapiens
  misc_feature: GZ8MTXP02F3O3Q.13.39.D06.1.454.CMB.2.raw
  modified_base (210)..(210): a, c, t, g, unknown or other
  modified_base (259)..(259): a, c, t, g, unknown or other
  modified_base (312)..(312): a, c, t, g, unknown or other
  modified_base (365)..(365): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctnatctgcagtgtctctggtgctccttcagcagtggtagtttctactgganctggatccggcacgccccggccgggaagggactgggagtggagttgggcttancaatgccaggtggggcacgagctaccacccccctccctcaagacgccgcgtcncctattcagtacgacacgtaccaaagaaccagcctactaccctgaaacgtctgtacgttctgtacgaccgccgacacgaccgacggcgttagtattaccgtggtcgcgcgacgagggtcgacgtcggtacggggaccgaaacggggacccacgggtaccaccggttcctcctcgacgccctaccgaccgaacgggcccacgttcccgg

SEQ ID NO: 426720 - DNA, 540 bp, Homo sapiens
  misc_feature: GZ8MTXP02HKBUL.13.39.D06.1.454.CMB.2.raw
  modified_base (362)..(362): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttcagcagtggtagtttctactggagctggatccggcagccccgccgggaaggactgggagtggagttgggcttatcaatgccaggtggggcaccgagctacacccccctccctcacgacgccgcgtcncctatttcagtagacacgtaccaagaccagcctctcctgaagctgattctgtcgaccgccgcacgacgtacggccgtagtattacgtgtcgcgcgacgaggtcgacgtcgtcggggaccaacgggccacggtcgaccgtcctcctcgacgccctaccgaccgaacggcccacgtcccg

SEQ ID NO: 426721 - DNA, 513 bp, Homo sapiens
  misc_feature: GZ8MTXP02FZPXC.13.39.D06.1.454.CMB.2.raw
  modified_base (409)..(409): a, c, t, g, unknown or other
  modified_base (435)..(435): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttcagcagtgtagttctactggagctggatccggcagcccgccgggaaggactggagtggattgggcttatcaatgccagtggggcacagctacaacccccctccctcaagacgccgcgtcaccatttcagtagacacgtccaaagaaccagctctccctgaagctgagttctgtnaccgcgcagacacggccgtgtatacngtgcgcgacaggtgacgtcgtggggccaagggaccacggtcaccgtctctcgacgcctacaccacggcccagtcccgg

SEQ ID NO: 426722 - DNA, 541 bp, Homo sapiens
  misc_feature: GZ8MTXP02IL5OW.13.39.D06.1.454.CMB.2.raw
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagccccgcgggaaggactggagtggattgggcttatcaatgccagtggggcaccagctacaacccccctccctcaagacgccgcgtcaccgtatttcagtagaccacgtccaaagaaccagcctactccctgaagctagagttctgtcgaccgccgcagacacggccgtgtattactgtgcgcgacagggtcgacgtcgtgggggaccaacggggaccacggggtccaccggtctcctcgacgccgtccaccgaacgggcccattcccgg

SEQ ID NO: 426723 - DNA, 578 bp, Homo sapiens
  misc_feature: GZ8MTXP02IM7S8.13.39.D06.1.454.CMB.2.raw
  modified_base (305)..(305): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctctgcactggaaccagcactgatgttggtggttataactatgtctctgtatcaacacaccaggcaaacgcccccaaatcatcatttanagaagtcatttatcccggccctcaggtatttctaattcgcttctctggtctccaagtctgcaacgaccgtcctccctgaccctatcctcgtcgggcctccgaggtctacgaaaggaccgaggtctaggtaactttacttacgtcggaccagtccttacataacttaaaccaacccattaccaaaacaaccacgtaacgggttccttaacggggaaacgttacgggggaaaccctaaaacggtccctaacccggttaccgtaacgggtaacccg

SEQ ID NO: 426724 - DNA, 518 bp, Homo sapiens
  misc_feature: GZ8MTXP02HVT3H.13.39.D06.1.454.CMB.2.raw
  modified_base (333)..(333): a, c, t, g, unknown or other
  modified_base (428)..(428): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactggtgttggtggttataactatgtctcctggtatcaacaacacccaggcaaacgcccccaaaatcatcatttatgaagtcatttatcggccccctnagggtatttctaatcgcttctctggctccaagtctggcaacacggcctccctgacaatctctggtctccagctgaggacgaggctgcctattacngctgctcatactgctaggtttcttcgtgtcggttcgttacgggcggtagggtaacccgaaaggtcgacccggtctacggtcgacgacccg

SEQ ID NO: 426725 - DNA, 515 bp, Homo sapiens
  misc_feature: GZ8MTXP02JH4PO.13.39.D06.1.454.CMB.2.raw
  modified_base (392)..(392): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactggtgttggtggttataactatgtctcctggtatcaacaacacccaggcaaagcccccaaaatcatcatttatgaagtcatttatcggccccctcagggtatttctaatcgcttctctggctccaagtctggcaacacggcctccctgacaatcnctggtctccaggctgaggacgaggctgcctattacctgctgctctatatgtcctaggtttctcgtggttcggtcttcgggcggtagggtccaaaaggtcgaccgtaccgtcggtcaacgcccg

SEQ ID NO: 426726 - DNA, 576 bp, Homo sapiens
  misc_feature: GZ8MTXP02GP4PE.13.39.D06.1.454.CMB.2.raw
tcagtcacgtactacacgaccggtgctcgatttagtgacatctcgcagttctttggggagctctgggagtggagccccagccttgggattcccaagtgtttgttttccgtgatcaggactgaacacacaggactcaccatggagttggggctgagctggattttccttcttgctatgttagaaggtgtccagtgtgaggtgcacctggtggagtcgtgggggaggcttggtacagccgtggggggtccctgagactctcctgtgcagcctctggattcaccttcagtacctacgacatgcactgggtccgccaacctctaaggaaaacggtccggagtgggtctcgaggggattggcaggtgttggtgacactattctattcagactccggtgaacgggccgattccaccatctccagaagaaaatgaccaacaaactccttaccactacttacaaatgaacagacctagagagacggggacacggctgtagtaattacgtgtgacgaaggaggggactaagtttacttaattaacgtacgttacgacgtacgtacggggacgaaacgggaacccg

SEQ ID NO: 426727 - DNA, 525 bp, Homo sapiens
  misc_feature: GZ8MTXP02GN07F.13.39.D06.1.454.CMB.2.raw
  modified_base (439)..(439): a, c, t, g, unknown or other
  modified_base (461)..(461): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagccccgcgggaagggactggagtggattgggcttatcaatgccagtgggggcaccagctacaacccccctccctcaagagccgcgtcaccattcagtagacacgtccaaagaaccagctctccctgaagctgattctgtgaccgccgcagacacgccgtgtattacngtgcgcgacaggtggacgtcgnggggaccaaaggggaccacggtcaccgtctcctcacgcctccaccgaaacgggcccagtcccgg

SEQ ID NO: 426728 - DNA, 527 bp, Homo sapiens
  misc_feature: GZ8MTXP02JW8XT.13.39.D06.1.454.CMB.2.raw
  modified_base (366)..(366): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaaggactggagtggagttgggcttatcaatgccaggtggggcaccgagctaccgaaccccccctccctcaacgacgccgcgtcncctatttcagtagacacgtaccaagaccagctctccctgaagctgagttctgtcgaccgcgcagacacggcctgtattactgtgcgcgacaggtgacgtcgtggggaccagggaccacggtcaccgtctcctcgacgcctccgacgacggcccagtcccgg

SEQ ID NO: 426729 - DNA, 627 bp, Homo sapiens
  misc_feature: GZ8MTXP02FXKVF.13.39.D06.1.454.CMB.2.raw
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgtggtgtataactatgtctcctgtatcaacaacaccaggacaaacgcccccaaaactcactcatttatagaaagtctatttactcccggaccctcgaagggtacttttacgtaaattccgtcttctctggcctccaagtctggacaacgaccggtccctccctacgaccctatcctctcggggccttaccgacggccttaggaaacgacggaggtccgttagtaatttaacgttacctgactaacggtcctacaattaacttaaaccaaaccctattaaccgaaaacctaaccaaacctaacgggttaccctttacgggggaaaacggttacgggggaaaaccctaaaacgggtccctaaccccggttaccgtaacgggtaacccg

SEQ ID NO: 426730 - DNA, 685 bp, Homo sapiens
  misc_feature: GZ8MTXP02H8GCS.13.39.D06.1.454.CMB.2.raw
  modified_base (228)..(228): a, c, t, g, unknown or other
tcagtcacgtactacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgattcgttggtacttatagtacttgtctcctcggtaccaacacccacccgacggaccaaccggccccagacgtcatctagtttaggtggggactaagtacggcggccgtacgagggtactttccacctcgtccttctcgtcggtccttaccacgtcgtcggaccaaccgaccgtccctacctacgacctaactcctcgtcgtcctcccgtacggtcgtacggaacgggacggacggtcgtacggtacctttaacgttacgtcgtaccgttcgtccttacgtacgttacgtcgtaccgttacggtttccgtttcgttcggtttcgggtttccggtttccgggggtacggggttaaccggggttaaccggtaaacggttaccggttacccggttaccgttaacgggtccgtaaccggtacccgtaacgggtcccgtacccggtcccccgtacgg

SEQ ID NO: 426731 - DNA, 589 bp, Homo sapiens
  misc_feature: GZ8MTXP02IXMNJ.13.39.D06.1.454.CMB.2.raw
  modified_base (235)..(235): a, c, t, g, unknown or other
  modified_base (501)..(501): a, c, t, g, unknown or other
tcagtcacgtactacacgaccggtgctcgatttagtgacatctcgcagttctttggggactttctgagagtcctggacctgctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctcctnagcagtggtagttctactggagctggactccggcaccggccccggccggggaagggcgtgggaggtggagttggggtctttagtctaagtgccgaggtcgggggacaccgagcctaaccccaaccccctcctacaagacgcccgcgtccacctatttccagtacgacacgtaccaaagaccagctcctccctagaacgtctgtacgttctgtcgacccgccgacgacgaccgacggtccgtagtacttaccgtgtcgcgacgacgngggtggacgtcggtacggggaccgaaacgggaccacgggtcacccggtctaaccgtcgacgccctaccgaccgacgggtccctaccgg

SEQ ID NO: 426732 - DNA, 532 bp, Homo sapiens
  misc_feature: GZ8MTXP02H8OTU.13.39.D06.1.454.CMB.2.raw
  modified_base (233)..(233): a, c, t, g, unknown or other
  modified_base (272)..(272): a, c, t, g, unknown or other
  modified_base (306)..(306): a, c, t, g, unknown or other
  modified_base (398)..(398): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccngcactgatgttggtgttataactatgtctctgtatcaanaacaccagacaaacgccccaaactcatcatttangaatctatttatcccggcctacgaggtatttactaatcgtctttctctgtctccaaggtctagaccaacacggccctcccgtgacccatccncgtgggcctcagctgaagcgtagctagatttatactgcagtctactattacaaccaaactactacaaactaacacacggttcgttacggaagttacgggaaacccaaagtacccgaccgtacgttacggacccg

SEQ ID NO: 426733 - DNA, 599 bp, Homo sapiens
  misc_feature: GZ8MTXP02HED0N.13.39.D06.1.454.CMB.2.raw
  modified_base (305)..(305): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgcgggaaggctggagtggattgggcttancaatgccaggtggggcaccgagctaccaacccccctcctacaagacgccgcgtacacctatttcagtacgaccacgtaccaaacgaaccagcctcctacccgtagaaacgtctaggacgtttctcggtacgacccgccgcgaacggaccgtaccgggcccgttaggttaacttacgtcgttaggccgacgaccgtaggggtcggaacgtcggtcgggggaccgaaacggggaccgaccggtccacccggtctacccgtcgacgcccgtaccaccgaacggcccacgttccccgg

SEQ ID NO: 426734 - DNA, 593 bp, Homo sapiens
  misc_feature: GZ8MTXP02IWXYK.13.39.D06.1.454.CMB.2.raw
  modified_base (228)..(228): a, c, t, g, unknown or other
tcagtcacgtactacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgattcgttggtacttagtagtacttgtctctcgtaccaacaccaccacggaccaaccggccccagacgtcactactagtttagtggggacaagtacggcggtccgtacgagggtacttccaccgtcgtcttctcgtcgtcctaccgacgtcgtcggacaaccgaccgtcctcctagactactctcgtcgtctcgagtctaggacggacgacgtcgtacgtaccttattacgtgtctcgctactatacgtcgtcgtaggtttcttcgttcggttcggttcgttcgggtcgggtacggtaccgtaacggtcgtaccgttacgtaacggtcgacgtacccgacggtccgtccggtccccgtcg

SEQ ID NO: 426735 - DNA, 536 bp, Homo sapiens
  misc_feature: GZ8MTXP02JOEVS.13.39.D06.1.454.CMB.2.raw
  modified_base (233)..(233): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccngcactgatgttggtgttataactatgtctcctggtatcaacaacacccaggacaaacgcccccaaactcatctatttatgaagtctatttatcccggtccctcgagggtatttctaatcgtcttctctggtcctccaagtctggaccaacgaccggtccctccctagaccctatcctcgtcgggtcctccgaggcctagaagacgaggctagtattatacgtgcagctacataactacaacatacaaacacacacggttctacggaagtacggaaccaacgtaccaccgtacgtacggtaccg

SEQ ID NO: 426736 - DNA, 719 bp, Homo sapiens
  misc_feature: GZ8MTXP02FSMAP.13.39.D06.1.454.CMB.2.raw
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctcgtgtctggctctcctggacagtcgatcatcgtctcctgcactggaaccagcacgtggtgttggtggttataactatgtctctgtatcaacaacaccaggacaaacgacccccaaactcatactatttatagtaagtctatttactcggtcccctacgaggtatttctaatcgtctttcctctggtcctaccgtaagtcgtcgggacctaaaccgaccggtcccctttacccgacgtaacctaaacgttcctcctttcgggtcccttacccgaacggtccgttacgggaaacgggtaaccggaacgggtccgttaccggtaaccccgtttaatttaacccgtcggtacccttacggtccttacctaacgtttaaacgttaggtccgtttaaacggggttttcctttcggtttcgggtttcgggtttaccggttttccgggggaccggggttaaaccggggtaacccgtaaaaacgggtttccggttaaccccggttacccggttaacgggttacccggacggttaaaccccccgggg

SEQ ID NO: 426737 - DNA, 662 bp, Homo sapiens
  misc_feature: GZ8MTXP02G7Q6V.13.39.D06.1.454.CMB.2.raw
  modified_base (236)..(236): a, c, t, g, unknown or other
  modified_base (416)..(416): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttnagcagtggtagtttctactggagctggactccggcacggccccggaccggggaagggacctgggagtgggagttgggcttatcaatggccgaggtggggcaccgagcctaccaaccccccctcccgtacaacgacgccgcgtcacctatttcagtacgacaccgtaccaaacgaaacccngaccctccgtacccgtaggaaacgtcgtacggtacgtttcgtacggtacgacccgccgacgaacgaccgaccgggtacccttaggttaacttaccgtggtcggccgtacgacggaggggtacggtaccggttcggtacgggggacccgtaaacgggggaccctacggggtccaacccggttccttacccgtccgaaccggtcccctacccgaaccggaaaccggggcccctacggtttcccccggg

SEQ ID NO: 426738 - DNA, 502 bp, Homo sapiens
  misc_feature: GZ8MTXP02JXJ4R.13.39.D06.1.454.CMB.2.raw
  modified_base (233)..(233): a, c, t, g, unknown or other
  modified_base (308)..(308): a, c, t, g, unknown or other
  modified_base (320)..(320): a, c, t, g, unknown or other
  modified_base (329)..(329): a, c, t, g, unknown or other
  modified_base (384)..(384): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccngcactgatgtggtgttataactatgtctcctggtatcaacaacaccaggcaaacgcccccaaaatcatcatttangaagtcatttancccggcctnaggtatttctaatcgtcttctctgctcagtctggcacacgcctcctgaccatctntcgggactcaggctgaagcgagctggtaattacgttactgcagctacataactacaacatacaaacacacgtacgtcttacggaagttcggaaccaacgtccacgtaccaggtacccg

SEQ ID NO: 426739 - DNA, 516 bp, Homo sapiens
  misc_feature: GZ8MTXP02I8BTY.13.39.D06.1.454.CMB.2.raw
  modified_base (195)..(195): a, c, t, g, unknown or other
  modified_base (366)..(366): a, c, t, g, unknown or other
  modified_base (496)..(496): a, c, t, g, unknown or other
  modified_base (500)..(500): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactgggtgaggccttnacagaccctgtccctcatctgcagtgtctctggtgctccttcagcagtggtagtttctactggagctggatccggcacgcccgccgggaaggactggagtggattgggcttagtcaagtggcaggtggggcacgagctacaacccccctccacaacgagccgcgtcaccgntttacagtagacacgtaccaagaaccagctctcctcgaagactcgagtctcgtacgacgccgcagacgacgccgtagtattacgtgtgcgcgacgagtgacgtcgcggacgacgacgacgcgacgctccncgcncacacgacgcgactcg

SEQ ID NO: 426740 - DNA, 565 bp, Homo sapiens
  misc_feature: GZ8MTXP02GUNXO.13.39.D06.1.454.CMB.2.raw
  modified_base (428)..(428): a, c, t, g, unknown or other
  modified_base (470)..(470): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccatgactggtgaggccttcacagacccctgtccctcatctgcagtgtctctggtgctccttcagcagtggtagtttctactggagctggatccggcacgccccggcgggaaggactggagtggagttgggcttatcaatgccgaggtcggggcaccgagctacccgaccccctcctacaagacgccgcgtccacctatttcagtacgacacgtaccaaagaccagcctctccctagaacgcctaggacgttcnggtcgacccgccgacgacgaccgacggccgtagtacttacgngtcgcgcgacgaggtcggacgtcggtcggggaccaaggggacccacgggtccaccggtctccgtacacgccctaccgaccgaacgggccctacgg

SEQ ID NO: 426741 - DNA, 557 bp, Homo sapiens
  misc_feature: GZ8MTXP02H01EI.13.39.D06.1.454.CMB.2.raw
  modified_base (225)..(225): a, c, t, g, unknown or other
  modified_base (227)..(227): a, c, t, g, unknown or other
  modified_base (250)..(250): a, c, t, g, unknown or other
  modified_base (280)..(280): a, c, t, g, unknown or other
  modified_base (290)..(290): a, c, t, g, unknown or other
  modified_base (294)..(294): a, c, t, g, unknown or other
  modified_base (297)..(297): a, c, t, g, unknown or other
  modified_base (304)..(304): a, c, t, g, unknown or other
tcagtcacgtactacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcacatctcctgcactggaaacngnagtgatcgtggtactatagtctntctctcgacaacaccacagacacgccagcncatctatagngganagnggcgcgngagtctcaccgtcgtctcgtcgtcgctacgagtcgtacgaccacgtccgtccctacctacgaactactccgtcgtcgtcctaccgaggtcgtacggaacgggacggtacgtcgtacgtacttagtacgtgctacgctagtacgtagtcgtcgttacgttcgttcgtcggttcgtacggtcgggtacgtacggtacgtaacgtccgtaccgtacgtaacgtacgacgtaccgacgtcccgtcccgtacccgtcg

SEQ ID NO: 426742 - DNA, 605 bp, Homo sapiens
  misc_feature: GZ8MTXP02G45YQ.13.39.D06.1.454.CMB.2.raw
  modified_base (313)..(313): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctcttcagcagtggtagtttctacgtggagctggactccggcacggccccggacgggaagggactggagtggagttgggcttancaagtgccgaggtcggggcaccgaggacctaaccaaccccccctccctacgaacgacgccgcgtacacctatttcagtacgacacgtaccaaacgaaccagtacctcctacccgtagaaacgtctcgtacgttcgtagtccgaacccgccgacgaagaccgacggtccgtaggtacttacgtgacgcgcgacgaggtcggacgttcggcggggacctaaacggggccctaacgggtccacccgtctacccgcgacggccctaccgaaccgaacggcccctaagttcccccgg

SEQ ID NO: 426743 - DNA, 535 bp, Homo sapiens
  misc_feature: GZ8MTXP02IC7N0.13.39.D06.1.454.CMB.2.raw
  modified_base (305)..(305): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgttggtggttatactatgtctctgtatcaacaacaccaggcaaacgccccaaatcatcatttangaatcattatccgccctgaggtatttctaattcgctttctctggtcctccaagtctcgggacaacgaccggccctccctgacccatcctcgtcgggcctccggggctaggaacgacgacggtctagtattattactgcagctcaatactacaaacatacaaacaacaacgtacgtaccgttaggaaagttcgggaaacctaaacgtccaaccgtcctaacggtacaaccg

SEQ ID NO: 426744 - DNA, 641 bp, Homo sapiens
  misc_feature: GZ8MTXP02HZO19.13.39.D06.1.454.CMB.2.raw
  modified_base (447)..(447): a, c, t, g, unknown or other
tcagtcacgtactacacgaccggtgctcgatttagtgacatctcgcagttctttggggactttctgagagtcctggacctcctgtgcaagaacatgaaaacatctgtggttcttcctcctcctggtggcagctcccagatgggtcctgtcccaggtgcagctgcaggagtcgggcccaggactggtgaggccttcacacgaccctgtccctcatctgcagtgtctctggtgctccttcagcagtggttagttctactggagctggactccggcacgccccggcgggaaggctgggagtggagttgggcttatcaagtcgccaggtggggcacgagcgtaccaaccccccctcccacgaacgacgtcccgcgtccacctactttacacgtacgactaccgtaccaaacgaaacccagcctcctaccctagaacgtctacgtagtttcncgtcgaacccgccgacacggacgtacggccgttaggtattaccgtggtcgccgcggaacgagggtcggaccggtcggtcgggggacccaaaacgggggcccgtaaaccgggttccgaacccgttccgtttcccgtaacgaaccgtcccgttacccgaaaccccgaaacgggggtcccctaacggtttcccccgg

SEQ ID NO: 426745 - DNA, 530 bp, Homo sapiens
  misc_feature: GZ8MTXP02HMGAC.13.39.D06.1.454.CMB.2.raw
  modified_base (317)..(317): a, c, t, g, unknown or other
  modified_base (331)..(331): a, c, t, g, unknown or other
  modified_base (445)..(445): a, c, t, g, unknown or other
  modified_base (451)..(451): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgttggtggttataactatgtctcctggtatacaacaacaccccaggcaaaacgcccccaaaactcaatcaatttangaaagtctatttancccggccctacagggtatttctaaatcgtcttctctggctccaagtctggacaacaccggccctccctgaccatctcgtggcctcgagctagaagacgtagctagattattacngacganctcaatataaccaaccatacaaacaccacgacgtcttaccggaaagtcggaaaccaaaggtccacccgtctaggacccg

SEQ ID NO: 426746 - DNA, 520 bp, Homo sapiens
  misc_feature: GZ8MTXP02GO859.13.39.D06.1.454.CMB.2.raw
  modified_base (233)..(233): a, c, t, g, unknown or other
  modified_base (428)..(428): a, c, t, g, unknown or other
  modified_base (449)..(449): a, c, t, g, unknown or other
  modified_base (452)..(452): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccngcactggtgttggtggttataactatgtctcctggtatcaacaacacccaggcaaacgcccccaaaactcatcatttatgaagtctatttactccggccccctacgagggtactttctaatcgtcttctctcggctccaagtctggcaacacggcctccctgacaatctctggtcctcgagctaggagtaacggngctgaccttatctgtctgctnatntgctgttcttcgtgtcgtcgtcggacggtacggtaaccgaaggtcgtaccgtcgtacggtacacgccg

SEQ ID NO: 426747 - DNA, 697 bp, Homo sapiens
  misc_feature: GZ8MTXP02GK79O.13.39.D06.1.454.CMB.2.raw
  modified_base (233)..(233): a, c, t, g, unknown or other
  modified_base (325)..(325): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccngcactgatgtggtgtatactatgtctctgtatcaacaacaccaggacaaacgcccccaaaatcatactatttactagaaagtctaatttacnccccggtaccctcgaagggtacttttacgtaaacttcgtctttcctcgtcggtaccttaccgtaaagttcgttacgggaccaaaccgtacccggtcccctaccccgttaggaacccctaattcccgttcgtcgggggtcccttaccccgaagggtccttaggaaacggaaccggaagggtcctagggtaatttaacttaacgtggtacaagtcctacaacttaaacttaaaccaaaaccctaacttaacccaaaaaccgaacctaaaccgtaacgggttacccgtttaacggggaaaacggttaaccgggggaaaaccctaaaaaacggggttcccctaaacccggttacccgttaacggttaaacccccgg

SEQ ID NO: 426748 - DNA, 547 bp, Homo sapiens
  misc_feature: GZ8MTXP02F1A2Z.13.39.D06.1.454.CMB.2.raw
  modified_base (228)..(228): a, c, t, g, unknown or other
tcagtcacgtactacacgaccggtgctcgatttagtgacatctcgcagttctttggggggggtcacaagaggcagcgctctcgggacgtcaccaccatggcctgggctctgctgctcctcactctcctcactcaggacacagggtcctgggcccagtctgccctgactcagcctgcctccgtgtctgggtctcctggacagtcgatcaccatctctgcactggaaacngcagtgatcgttgggacttatagacttgtctcctggtaccaacaccaccagcaacgccccagagtcatcattagtggggcaagtaggcggcgtcaggtattccactcgcttctctgctcagtctggacaaccacgcctcctgactaatctactggtctcgagctagaggacgagctgacctattactgctcgctacatatcgtacgtaggttcttcgtggttcggttcgttcgggcggtacgggttacctaaacggtcgtacccgtccggtaaggtacctaacggaccccgaaggtccctacccggtcccccgttccgg

SEQ ID NO: 426749 - DNA, 546 bp, Homo sapiens
  misc_feature: GZ8MTXP02GWXC7.13.39.D06.1.454.CMB.2.raw
  modified_base (233)..(233): a, c, t, g, unknown or other
  modified_base (320)..(320): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccngcactgatgttggtggttataactatgtctctggtatcaacacaccaggacaaacgcccccaaatcatcatttatgaagtcatttancccggtccctcgaggtatttctaatcgtcttctctggtcctaccaagtctacggacaacgaccggtccctccctgaccctactcctcgtcggggcctccgaggtctaggaaagacggaggtctaggtattaagttacctgacagtctacataactacaaacctatacaacgacactacggtcttacggaagttcggaacaaacgtccaccgtaccgtacggtaccg

SEQ ID NO: 426750 - DNA, 643 bp, Homo sapiens
  misc_feature: GZ8MTXP02GHEM9.13.39.D06.1.454.CMB.2.raw
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttcagcagtggtagttctactggagctggatccggcacgcccgcgggaaggacgtggagtggattgggcttagtcaagtgccgaggtggggcaccgagcctaccaccccccctccacaagacgccgtccgtcaccgtattcgagtacgaccgacgtaccaaacgtaccagtccctcctacccgtagaacgtccgtagtacgtttccgtacggtaccggacccgccgaccgaacgaccggtaccggcccgttagttaacttaccgttggagccgacggacgtaggggtcggtaccggttcggacgggggacccgtaaacggggacccgaacgggtccgacccgttccgttcccgtaacgaaccggtccccttacccgaacccggaaccggggtccccacggtttcccccgg

SEQ ID NO: 426751 - DNA, 610 bp, Homo sapiens
  misc_feature: GZ8MTXP02JREMS.13.39.D06.1.454.CMB.2.raw
  modified_base (425)..(425): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttcagcagtggtagtttctactggagctggatccggcacggccccggcgggaagggacgtgggagtgggagtttggggctttagtcaatcggccgagggtgggggcaccgagccgtaccaacccccccctcctaccgaaacgacgccgccgtacacctatttcagttacgactacgtaccaaacgaaacccnctacctcctccgtagacgtctacgtacgttcgtcgtaccgacccgccgacgaacggaccgtacggtccgttagttaacttcgtgtcggcgcgacggtaggtcgacggtcggcgggaccgacgggaccgacggtccaccgtcctccgtcgaccgtaccctaccgaccggacggtccctacgtcccg

SEQ ID NO: 426752 - DNA, 604 bp, Homo sapiens
  misc_feature: GZ8MTXP02I3ADI.13.39.D06.1.454.CMB.2.raw
  modified_base (236)..(236): a, c, t, g, unknown or other
  modified_base (333)..(333): a, c, t, g, unknown or other
  modified_base (477)..(477): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttnagcagtggtagtttctactggagctggatccggcacgccccggccgggaaggactgggagtggagttgggcttatcaatgccaggtggggccaccgngctaccgacccccctccctacaagacgccgcgtcaccgtatttcagtacgaccacgtaccaaacgaaacccagacctcctacccgtagaacgctagtagttctgtacgacccgccgacacgaccacggtccgtgtacttaccgngtcgcgtacgacgagggtacggaacgttcggtacggggaccgaacggggacccacgggtccgaacccggttcctacccgtcgaccgtacctacccgaaccgaaccggggtccctaacgtttccccgg

SEQ ID NO: 426753 - DNA, 593 bp, Homo sapiens
  misc_feature: GZ8MTXP02F8ZC4.13.39.D06.1.454.CMB.2.raw
  modified_base (233)..(233): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacgagggtcctgggcccagtctcgccctgactcagcctgcctcgtgtctggctctcctggacagtcgatcatcgtctctgcactggaaccngcactgatgtggtgtataactatgtctctgtatacaacaacaccagacaaacgacccccaactcatctatttatagtaatactatttacgtccccgccctacgaggtactttctaactcgtcttctctcgtctcagtctggacacgaccggcctccctgacctatcctcgtcgggtctccgagtcgtagaacgacggaggctaggtacttacttagtcgacaacgtcctactaattaactaaaccaaaacctactaacccaaaacctaacgtaaccgttaacgggttaccgtttaacgggaaacggttacgggaaaaccgtaaacggtacccgtaacccgttaccggtacgtaaaccccg

SEQ ID NO: 426754 - DNA, 607 bp, Homo sapiens
  misc_feature: GZ8MTXP02J2AG8.13.39.D06.1.454.CMB.2.raw
  modified_base (234)..(234): a, c, t, g, unknown or other
  modified_base (307)..(307): a, c, t, g, unknown or other
  modified_base (319)..(319): a, c, t, g, unknown or other
  modified_base (329)..(329): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggcctctcctggacagtcgatcatcgtctcctgcactggaaccngcactgatgttggtgttatactatgtctctgtatcaacaacaccagacaaacgcccccaaactcatcatttanagaagtcattancccggccctnaggtatttctaatcgtcttctctcggctccaagtctgggaccaacgaccggccctccctgacccatcctcgtcgggccttccgaggtcctaggaacgaccggtagggcctagggtaatttacttacgtcggaccgtagcccttaactaacttaactaaaccctaaacccaactaaaccaaaaccctaacgtaaccgtacggtttaccgttaacggggtaacggttaaccgggaaaccgtaaaacggtacccgtaacccggttacccgtacggtacccg

SEQ ID NO: 426755 - DNA, 566 bp, Homo sapiens
  misc_feature: GZ8MTXP02JSQM3.13.39.D06.1.454.CMB.2.raw
  modified_base (471)..(471): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctcttcagcagtggtagtttctactggagctggatccggcacgcccggccgggaaggactgggagtggattgggattatcaatgccaggtggggcaccagctacaacccccctccctacaagacgcccgcgtcaccgtatttcgagtacgacaccgtaccaaagaacccagcctctccctgaaacgctcgacgttctgtcgaccgccgcagacacggccgtgtatacgtgtcgcgcgtacgnggtcggacgtcgtcggggccaacggggaccacgggtccaacccggttctcccgtaacgacgtccctaccgaaccgaaccgggcccacgttcccgg

SEQ ID NO: 426756 - DNA, 735 bp, Homo sapiens
  misc_feature: GZ8MTXP02HENPB.13.39.D06.1.454.CMB.2.raw
  modified_base (281)..(281): a, c, t, g, unknown or other
  modified_base (369)..(369): a, c, t, g, unknown or other
tcagtcacgtactacacgaccggtgctcgatttagtgacatctcgcagttctttggggagctctgggagtggagccccagccttgggattcccaagtgtttgttttccgtgatcaggactgaacacacaggactcaccatggagttggggctgagctggattttccttcttgctatgttagaaggtgtcagtgtgaggtgcaccgtggtggagtcgtgggggagcttggtacagccgtgggggtcctgagactctcctgtgcagcctctggattcaccttnacgtacctacgacatgccacgtcgggtccgccaacctcgtaaggaaaaggtccggaggtgggtctcgagggattggctaggtgttggnacacgtattctattcagtacctccggtagaacggggctagttccaaccgatcctacccgaaggaaacgtaaaactcgaacccaaactaaccttaccccttaccaacttcctttaaaccgaaaattacggtaaaaccacgtacccgttaggaacgggaacgggaaccgggggtaacccaacggggtacccttagggttaacgttaaacggtttaaaccgtgggtttacggaaccggtaaaaggggtaacgggggttaaccctttaaaaggtttttcccttttaaaagttaaccccgtttaacggtttacccggtaaccggtttacggttacggggggaaaccgtaaaaccggggttaaaccccccgg

SEQ ID NO: 426757 - DNA, 576 bp, Homo sapiens
  misc_feature: GZ8MTXP02HLORD.13.39.D06.1.454.CMB.2.raw
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttcagcagtgtagtttctactggagctggatccggcacgccccggcgggaaggacgtggagtggagttgggcttatcaatgccaggtggggcacgagctacacccccctccctacaacgacgccgcgtcacctattcagtacgacacgtaccaaacgaacccagcctacctcccgtagaacgtcctgtacgttcgtcgtcgacccgccgacacgaccgaccggccgttagtacttaccgtgtcgccgcgacgagggtcggacgtcggtcggggaccgaaacggggaccacggtccacccggtctccgtcgacgccctaccgaccgacggccctacgtccccgg

SEQ ID NO: 426758 - DNA, 581 bp, Homo sapiens
  misc_feature: GZ8MTXP02HBW0J.13.39.D06.1.454.CMB.2.raw
  modified_base (228)..(228): a, c, t, g, unknown or other
tcagtcacgtactacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcgttgggacttatagactgtctcctgtaccaacaccacccagcaacggccccagacgtcatctaatttagtgggggacaaagtacggcggccgtacgaggtactttccactcgcttctcgtcggctcagtctcggcaacgaccggcctcctgaactaatctctggtcctccgaggctggacggaccgaggctacgtctaacttactgcttcgcttacatagtcgcctaggtttccttcgtggttcggttccgtttcggggcggtacgggtacccgtaaaaggtcgtacccgtaccgtaacgggtccaccggacccgaacggtcctacccggtcccccgttaccgg

SEQ ID NO: 426759 - DNA, 588 bp, Homo sapiens
  misc_feature: GZ8MTXP02JOU0C.13.39.D06.1.454.CMB.2.raw
  modified_base (233)..(233): a, c, t, g, unknown or other
  modified_base (257)..(257): a, c, t, g, unknown or other
  modified_base (291)..(291): a, c, t, g, unknown or other
  modified_base (302)..(302): a, c, t, g, unknown or other
  modified_base (313)..(313): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacgagggtcctgggcccagtctgccctgactcagcctgcctcgtgtctggcctctcctggacagtcgatcatcgtctctgcactggaaccngcatgatggttggtagtataactntgtctctgatacaacacaccagacaacgcccaancatactattangaatctattanccccgtactgtagtacttacaatcgtcttctctcggacctacgagtccgtacgaccaaccgtacccggtccctccgtacgaccctatccgttcggacgggtccctacgacggtaccgaaggaaacggtaccggtagtacgttagttaaactttacgttacgtacgactacgtctaactaataacctaaacacgtaacaacaaaccacgtagtacggttctaaacgggaagttacggaaccctaaacgtcctaaccggtaccgtaacggtaacccg

SEQ ID NO: 426760 - DNA, 575 bp, Homo sapiens
  misc_feature: GZ8MTXP02G9Z3K.13.39.D06.1.454.CMB.2.raw
  modified_base (370)..(370): a, c, t, g, unknown or other
  modified_base (465)..(465): a, c, t, g, unknown or other
tcagtcacgtactacacgaccggtgctcgatttagtgacatctcgcagttctttggggagctctgggagtggagccccagccttgggattcccaagtgtttgttttccgtgatcaggactgaacacacaggactcaccatggagttggggctgagctggattttccttcttgctatgttagaaggtgtccagtgtgaggtgcacctggtggagtcgtgggggaggcttggtacagccgtggggggtccctgagactctcctgtgcagcctctggattcaccttcagtacctacgacatgcactgggtccgccaacctcgtaaggaaaacggtccggagtggggtctacgagggattggctaggtgttggngacactattctattcgagactccgtagaacggggccgattccaccatcctaccaagaagaaaatgaccaacaactcctacatctacaaatcgaanagacctagagaggacggggacacggctagtagtattactgtgactaaaggacgggactaatttcttataaccgtacgttaccgacgtcgtacgggacgtaaacgggaccc

SEQ ID NO: 426761 - DNA, 515 bp, Homo sapiens
  misc_feature: GZ8MTXP02H7XYU.13.39.D06.1.454.CMB.2.raw
  modified_base (438)..(438): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactggtgttggtggttataactatgtctcctggtatcaacacaccccaggcaaagcccccaaatcatcatttatgaagtcatttactcggccccctacagggtatttcgtaattcgtcttctctgctccaagtctggcaacacgcctcctgacatctctgtctcagctagaggacgaggtctgcctattacctgctgccttanatatgctagtttcttcgttgtcgttcgtcggtacggtacggtaacgtaacgtacgtacgtacgtacgtacgacgccg

SEQ ID NO: 426762 - DNA, 699 bp, Homo sapiens
  misc_feature: GZ8MTXP02J0K3C.13.39.D06.1.454.CMB.2.raw
  modified_base (232)..(232): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctcgtgtctggctctcctggacagtcgatcatcgtctcctgcactggaaccngcactgatgttggtgtatactatgtctctgtatcaacacaccagacaaacgcccccaaactcatactatttatagtaagtctaatttacgtccccggcccttacgagggtacttttactaacgttccgtctttcctcgtcggccttaccaaagttcctgggaccctaaacccgtacccggtcccttacccctacggaaccctacttccgttccgtcggggtcccttacccgacggtccgtagggaaacggaccggtagggtccgttacggtaattttaacgttaccgttacggacctaacggtccttacctaacttaaacttaaacccaaaaccccgtactaaccctaaaacctaacccgaaccgtaaccggggtttaccctttaacgggggaaacggttaacccgggggaaaaccctaaaacggttaccccgtaaccccggtttacccggtaacggttaaccccgg

SEQ ID NO: 426763 - DNA, 687 bp, Homo sapiens
  misc_feature: GZ8MTXP02H47L1.13.39.D06.1.454.CMB.2.raw
  modified_base (270)..(270): a, c, t, g, unknown or other
  modified_base (580)..(580): a, c, t, g, unknown or other
  modified_base (639)..(639): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggacgtccgggcccaggactggtgaggccttcacacgaccctgtccctcatctgctagtgtctcgtggtcgcttccttcagctaggtggttagtttctacgtggancgtaggactccggcacggccccggacgggaaaggtcgtgggtagtggtagttggtacttagacgtaagtcgaccgtagggtcggggaccaccgtacgacccttaaccgaaccccccccgtcctacgaaacggtacgtcccgacgttacccacgttatttaccgaagttacgaacctaccgtaaaccaacgaaaccctgtaccttacccgttacccaggaaacgttcgtacgtacgtttcgacgtacggaacccgcgaccgtaacggaccgtaccggtccgttagttacctacgtggacgcggacgacggngggtacgccgttacggacgggaaccgtaacggaccgtacggtccacccggtctacccgngaccccgtaccgtacccgaaccggtaaccggccctaacggtcccccgg

SEQ ID NO: 426764 - DNA, 589 bp, Homo sapiens
  misc_feature: GZ8MTXP02H99UL.13.39.D06.1.454.CMB.2.raw
  modified_base (236)..(236): a, c, t, g, unknown or other
  modified_base (436)..(436): a, c, t, g, unknown or other
  modified_base (477)..(477): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggttcctgtcccaggtgcagctgcaggagtcgggcccaggactggtgaggccttcacagacccctgtccctcatctgcagtgtctctggtgctctnagcagtggtagttctactggagctggatccggcacggccccggccgggaagggctggagtggagttggcttatcaatgcgaggtggggcaccgagctaccaacccccctccctacaacgacgccgcgtccacctactttcaagttacgaaccacgtaccaaacgaacccagcctcctccctagaacgtctagacgtttcngttcgacccgccgcacgacgaccggccgttagtacttacgngtcgcgcgacgaggtcggacgtcggtcggggaccgaacggacccgacgggtccacccggttctcccgtaacgacgtcccctacgaacccgtaccgggccctaacgtccccgg

SEQ ID NO: 426765 - DNA, 534 bp, Homo sapiens
  misc_feature: GZ8MTXP02GYIP7.13.39.D06.1.454.CMB.2.raw
  modified_base (229)..(229): a, c, t, g, unknown or other
  modified_base (365)..(365): a, c, t, g, unknown or other
  modified_base (373)..(373): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcgtggacttatagacttgtctctggtaccaacaccaccaggcaacgccccagagtcatctattagtggggacaagtaggcggcgtcgagggacttccacctcgtcttctctggctcagtctggcaacncgcctccngacatctctggtctccgagctgacggacgaggctagccttaatctgctgctacatactgctagtttctgtgtcggttcgtcgggtacggtacggtaccgaaagttccggaaccgttccgtaacgtcgaccgaccgaacggtcctccggtacccccgttcgg

SEQ ID NO: 426766 - DNA, 523 bp, Homo sapiens
  misc_feature: GZ8MTXP02H6CMO.13.39.D06.1.454.CMB.2.raw
  modified_base (226)..(226): a, c, t, g, unknown or other
  modified_base (232)..(232): a, c, t, g, unknown or other
  modified_base (365)..(365): a, c, t, g, unknown or other
  modified_base (381)..(381): a, c, t, g, unknown or other
  modified_base (393)..(393): a, c, t, g, unknown or other
tcagtcacgtactacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcacatctcctgcactggaaacngcagtnatcttgggacttatagacttgtctctgtaccacaccaccagcacggccccagagtcatctatttagtaggggcaagtaggcggcgtcgagggtactttccacctcgcttctctgctcagtctgcaacacgccncctgacatctctgtcncagctgagacgngctgccttattactgctgctacatattgcgttacggttcttcgtggttcggtcgttacggggacggtacggtaacgtagtaccgtaccgtacgtaacgacgacgtaccgaacgtccgtcccgtcccgtcg

SEQ ID NO: 426767 - DNA, 538 bp, Homo sapiens
  misc_feature: GZ8MTXP02IXHIO.13.39.D06.1.454.CMB.2.raw
  modified_base (376)..(376): a, c, t, g, unknown or other
  modified_base (432)..(432): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaccagcactggtgttggtggttataactatgtctctgtatcaacaacaccaggcaaacgcccccaaaactcatcatttatgaagtcatttatcggcccctcgaggtatttctaatcgcttctctgctccagtctgcaacacgcctccnacaatctctgtctccagctgaggacgaggctcgcctattacgtgtctgactcaatntcgtacgtaggtttctttcgttggttcggttcgttccggggtccgggtaggggttaaccgaaaacggttcggtaacccggttccgtaacggtccgtaacgacccgg

SEQ ID NO: 426768 - DNA, 568 bp, Homo sapiens
  misc_feature: GZ8MTXP02JROBM.13.39.D06.1.454.CMB.2.raw
  modified_base (236)..(236): a, c, t, g, unknown or other
  modified_base (260)..(260): a, c, t, g, unknown or other
  modified_base (319)..(319): a, c, t, g, unknown or other
  modified_base (479)..(479): a, c, t, g, unknown or other
  modified_base (491)..(491): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttnagcagtggtagtttctacgtgganctggatccggcacggccccggacggggaagggacgtgggagtgggagttggggctttancaagtgccgaggtggggacaccgagctaccaacccccctccctacaacgacgcccgcgtacaccctatttcaacgtacgacacgtaccaaacgaaccacgctctaccctgaacgctgacgttctgtcgaccgccgcagacgaccggcgtagtacttacgngtcgcgcgacgngggtgacgtcgtggggaccaacgggaccacggtccaccgtctccaacgcgaccctcaccgaacggccctagtcccgg

SEQ ID NO: 426769 - DNA, 523 bp, Homo sapiens
  misc_feature: GZ8MTXP02HUUBW.13.39.D06.1.454.CMB.2.raw
  modified_base (229)..(229): a, c, t, g, unknown or other
  modified_base (440)..(440): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcgttggacttatagtacttgtctctggtaccaacaccacccagcaacggccccagacgtcatcatttagtggggacaagtacggcggccgtcgagggtactttccacctcgtcttctcgtggcctcagtctggacaccgaccgcctcctgactatcctctcggtctcgagtctgagacgagctgcctattactgctgctcatntgatgttctcgtgtcgtcgttcgggcgtacgggtaccaagtcgaccgtcgtaacggtcacgtaccaggcctcggccccttcgg

SEQ ID NO: 426770 - DNA, 562 bp, Homo sapiens
  misc_feature: GZ8MTXP02HDFEL.13.39.D06.1.454.CMB.2.raw
  modified_base (470)..(470): a, c, t, g, unknown or other
  modified_base (494)..(494): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttcagcagtggtagtttctactggagctggatccggcacgccccggccgggaagggactggacgtggattgggcttatcaatgccaggtggggcaccagcctaccaacccccctccctacaacgacgccgacgtcacctatttcagtacgacacgtccaaacgaaccagcctctccctagaaagctagagtttccgtgtacgacccgccgcaagaccgacggccgttgtacttacgngtcgcgcgacgaggtgacgttcgnggggaccaacgggaccacggtccaccgtctaccgtcgacgccctaccgaccgacggcccagtccccgg

SEQ ID NO: 426771 - DNA, 691 bp, Homo sapiens
  misc_feature: GZ8MTXP02IRK9J.13.39.D06.1.454.CMB.2.raw
  modified_base (308)..(308): a, c, t, g, unknown or other
tcagtcacgtactacacgaccggtgctcgatttagtgacatctcgcagttctttggggagctctgggagtggagccccagccttgggattcccaagtgtttgttttccgtgatcaggactgaacacacaggactcaccatggagttggggctgagctggattttccttcttgctatgttagaaggtgtccagtgtgaggtgcactggtggagtcgtgggggaggcttggtacagccgtgggggtccctgagactctctgtgcagcctctggattcaccttcagtaccctacgacatgcacgtgggccnccaacctcgtaaggaaaacggtccggaggtgggtctcgagggattggcgtagttggttggtgacacgtattaccttaattcgaagtaccttccggtagaaccgggggccgtaagttccaacctactcctacccgaagaaacgtaaaaagtcgaaccccaaaactaaccttaccccttaccaactttacctttaaacctaaacttaacggaaaacctacgtacccttaacgggaaggaacgggaaccgggggacgaaccggggcttaggtagtactttaaccgtgggtacggtacaaagggggacggggtacttaacgtttcctttaaagtttaacctacgtttacggtacggttcggtacggggtaacgaaacggggtacccg

SEQ ID NO: 426772 - DNA, 623 bp, Homo sapiens
  misc_feature: GZ8MTXP02JUNKY.13.39.D06.1.454.CMB.2.raw
  modified_base (236)..(236): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttnagctagtggtagtttctacgtggagtcgtggactccggcacggccccggaccggggaagggactggagtggagttgggcttatcaagtcgccgtaggtcggggcaccgagcctaaccaaccccccctcctacaacgcgccgcgtcacctattcagtacgacacgtaccaaacgtaacccagtcctcctacccgtagaacgtcgtgacgttcctgtacgccgccgacacgacgaccggccgtgtaacttacgtcgtcgccgtcgacgtgggtacggacgtcggtacgggggaccaaacggggtacccaacggggttcccaaccgttccgtacccgtcgaacccgtcccgtacccgaaccggtaaccgggcccctacggtttcccccgg

SEQ ID NO: 426773 - DNA, 661 bp, Homo sapiens
  misc_feature: GZ8MTXP02FW64O.13.39.D06.1.454.CMB.2.raw
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttcagcagtgtagtttctactggagctggatccggcacgccccggaccggggaagggactgggagtgggaagtttggggctttatcaagtcgacccgaggtgggggccaccgagcctaccaaccccccctcctacgaacgacgcccgcgtacacctatttacaagttacgacctaacgtaccaaacgaaacccagacccttccgtacccctagaaacgtcctggtaacgtttcgttaggaccgacccgacccggacgtaacgacccgtaacgggtcccgttaggttaacttaccgtgtcgcgaccggagtagggtcggacgtcggtacgggggacccgtaaacggggaccctacggtacccgaacccggttcctaacccgcgaccggtacccaccgaacccgaacggggccccaacgtttcccccggg

SEQ ID NO: 426774 - DNA, 891 bp, Homo sapiens
  misc_feature: GZ8MTXP02I3SOY.13.39.D06.1.454.CMB.2.raw
  modified_base (224)..(224): a, c, t, g, unknown or other
  modified_base (258)..(258): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctntggtgctcctcagctagtgtagtttctactgganctggactccggcacggccccggacgggaacggacgtgggaggtgggtagtttggggactttagtacgtaagtcggacccgtaggggtcgggggaccaaccgacgtaccctaaaccccaaacccccccccttacccgtaaccgaaacggaccggtcccggacccgttacccgacccttacttttaccgaaacggttaaccgaacccgtaaaccggtacccaaaaaccgggaaacccctacggttacccttacccgtaccccggtaaggtaaaaccggtccgttacgggttacgtttacccgttacgggtacccggaaaccccggtcccgggaaccggtaaaccggtaaaccccgggtacccggggttaccccgggtttaaggttttaaacccgtttaaccgttacggggtccggttaccggggaaaccgggtaaaccggtacggggggttaccggggtaaccccggtttacgggggccggggggttaaaaccccggaaacgggggtaaccccgtaaccggggtccccgtaaaccccggggttcccttaaccccggtccgtacccggtacccccgttaaccccggaaaccccggtaaacccgggggtcccccttaacgggttttcccccccgggg

SEQ ID NO: 426775 - DNA, 502 bp, Homo sapiens
  misc_feature: GZ8MTXP02IAI9I.13.39.D06.1.454.CMB.2.raw
  modified_base (214)..(214): a, c, t, g, unknown or other
  modified_base (238)..(238): a, c, t, g, unknown or other
  modified_base (241)..(241): a, c, t, g, unknown or other
  modified_base (247)..(247): a, c, t, g, unknown or other
  modified_base (251)..(252): a, c, t, g, unknown or other
  modified_base (254)..(256): a, c, t, g, unknown or other
  modified_base (258)..(258): a, c, t, g, unknown or other
  modified_base (262)..(262): a, c, t, g, unknown or other
  modified_base (272)..(272): a, c, t, g, unknown or other
  modified_base (274)..(274): a, c, t, g, unknown or other
  modified_base (276)..(276): a, c, t, g, unknown or other
  modified_base (278)..(278): a, c, t, g, unknown or other
  modified_base (280)..(280): a, c, t, g, unknown or other
  modified_base (284)..(284): a, c, t, g, unknown or other
  modified_base (287)..(288): a, c, t, g, unknown or other
  modified_base (290)..(290): a, c, t, g, unknown or other
  modified_base (292)..(292): a, c, t, g, unknown or other
  modified_base (294)..(294): a, c, t, g, unknown or other
  modified_base (296)..(296): a, c, t, g, unknown or other
  modified_base (303)..(303): a, c, t, g, unknown or other
  modified_base (312)..(312): a, c, t, g, unknown or other
  modified_base (318)..(318): a, c, t, g, unknown or other
  modified_base (324)..(324): a, c, t, g, unknown or other
  modified_base (326)..(326): a, c, t, g, unknown or other
  modified_base (349)..(349): a, c, t, g, unknown or other
  modified_base (351)..(351): a, c, t, g, unknown or other
  modified_base (353)..(353): a, c, t, g, unknown or other
  modified_base (356)..(356): a, c, t, g, unknown or other
  modified_base (358)..(358): a, c, t, g, unknown or other
  modified_base (360)..(360): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccagggactgggtgaggcctttcacagacccctgtccctnatctgcagtgtctctggtgctctnagnagtgtnttcnngnnngncgcncgcgcggagngngngngngtgntannangngngnggcacancacaccccnccacancgcgcncncatcacgagacacacaacacacncncncanantntatctgcgacgcgcacgacgacgacgtagtattacgtgtcgcgcgagaggtaggacggtacggacgggacggaacggaccgacggtaccgtaccgtaccgtacctccgacgaccgaccgaaccgaaccggaccgtacgtccg

SEQ ID NO: 426776 - DNA, 776 bp, Homo sapiens
  misc_feature: GZ8MTXP02FRN05.13.39.D06.1.454.CMB.2.raw
  modified_base (236)..(236): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttnagcagtggtagtttctacgtggagctggatcccgggcacggccccggaccggggaagggacgtgggtaaggtgggtaacgttggggactttagtacaaagttcggacccgagggtcggggggaccaaccgagtaccgtaacccaacccccccccgttccctaccgaaacggacggtcccgaccggttaccaccctacgtttaccgaaacggttaaccgaaccgtaacccggttaacccgaaaacgtaaacccaaggtccccttacccgtacccccgttaggaaacgtccgttaggtaaccgttttcggtaccgggtaccgacccgaccggaccaaacggaccggtaccgggtcccgttaaggttaacgtttaaccgtggtacggcggaccgaacggtacgggtacgggtacggtacgggtaccgggggaacccgaaacggggacccggtaccgggttacccgacccggttcctaacccgttcgaaacccgccccgttacccggaaccggtaaccggggtaaccctacgtttcccccgggg

SEQ ID NO: 426777 - DNA, 613 bp, Homo sapiens
  misc_feature: GZ8MTXP02GVRHJ.13.39.D06.1.454.CMB.2.raw
tcagtcacgtactacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctcgtgtctggtctctggacagtcatcaccatctctgcatggaaacgcagtgattcgttaggtacttatagtacttcgtctccgtacgtaacccaacacccaaccgacggaccgaaccgaccccaagacgtacatacgtaagtttacggtcggggaactaaaggtacggccggtaccgtacgtaggtactttaccgaccgtcgtccttcgtcgtcggtaccttacgagtcgtacgacaaccgaccgtcctcctagaacctactctcgtcgtctacgtacgcgtaggacgacgacgcgtacgaccttattacgtcgctacgctactatactcgacgttacgttcgttcgtacgggttcgttcggtccgggtacggtacggtaacgtacgtaccgtaccgtacgtaacgacgaccgacgacgtcccgtccgtacccgtcg

SEQ ID NO: 426778 - DNA, 680 bp, Homo sapiens
  misc_feature: GZ8MTXP02FZ1DZ.13.39.D06.1.454.CMB.2.raw
  modified_base (465)..(465): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactgggtgaggccttcacagaccctgtccctcatctgcagtgtctcgtggtgctccttcagctaggtggttagtttctacgtggagtcgtggacgtccggcgacggccccggaccggggaacggggacgtgggaggtgggtagtttgggtacttagtacgaagtcggaccgtagggtcgggggaccaccgacgtacctaaccctaacccccccctcccgtaccgaacgaccgcccgaccgtaccaccgtactttacgaagtacgaccacgtaccaaacgaaacccngtcctacctaccgagacgtcgtcgtacgtttctcggtaccgacccgtccgaccgacgaccgaccggtacgttacgttacttaccgtgtacgcggacgacggtagggtcggaccggtcggtacggggaccgtaacgggacccgtacggtaccgacccgtcctaccgtaacgaccgtaccctacccgacccggaccggtaccccacgtttcccccgg

SEQ ID NO: 426779 - DNA, 571 bp, Homo sapiens
  misc_feature: GZ8MTXP02I94BW.13.39.D06.1.454.CMB.2.raw
  modified_base (308)..(308): a, c, t, g, unknown or other
  modified_base (346)..(346): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttcagcagtggtagtttctactggagctggatccgacacgccccggcgggaaggactggagtggattgggcttancaatgccaggtggggcacgagctaccgacccccctccncaagacgccgcgtcacctatttcagtacgacacgtaccaaagaaccagctactccctagaacgctgagttctgtcgaccgccgacagacacggccgtagtacttacgtgtcgcgcgacgagggtcggacgtcgtacgggggaccaaaggggaccctacgggtaccacccggtctcccgtaacgacggccctacccgaccgtaacggggcccctacgtttccccgg

SEQ ID NO: 426780 - DNA, 739 bp, Homo sapiens
  misc_feature: GZ8MTXP02JPV7W.13.39.D06.1.454.CMB.2.raw
  modified_base (209)..(209): a, c, t, g, unknown or other
  modified_base (255)..(255): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctccagatgggtcctgtcccaggtgcagctgcaggagtcgggcccaggactggtgaggccttcacagaccctgtccctnatctgcagtgtctctggtgctccttcagcagtgtattctactgganctggatccggcagccgcgggaggactggagtggagttcgggcttagtcaagttcgcctaggtggggctaccgagcgtaccaaccccccgtccctacgaacgacgccgcgttacaccgtactttcgaacgttacgacctaccgtaccaaacggtaacccaggtaccctaccgtaccccgtaggaaaccgtcgttacggtaacgtttccgtaggttaccgaacccggtaccggtaccgtaacggtaacccgtaccggggtacccggttagggttaacctttaaccggtcggttaccggtaccggtaccgggtaaccgttaacgggggttacgggtaaacccggttcggttaccgggggaacccgtaaacgggggtaccccgttaaacggggttcccgtaaacccgggttcctacccggtttaacgaacccggtcccgttaacccgaaccggttaaccggggtccccctaaacggtttacccccggg

SEQ ID NO: 426781 - DNA, 578 bp, Homo sapiens
  misc_feature: GZ8MTXP02JC86E.13.39.D06.1.454.CMB.2.raw
  modified_base (310)..(310): a, c, t, g, unknown or other
  modified_base (411)..(411): a, c, t, g, unknown or other
  modified_base (420)..(420): a, c, t, g, unknown or other
tcagtcacgtactacacgaccggtgctcgatttagtgacatctcgcagttctttggggagctctgggagtggagccccagccttgggattcccaagtgtttgtttccgtgatcaggactgaacacacaggactcaccatggagttggggctgagctggattttccttcttgctatgttagaaggtgtccagtgtgaggtgcacctggtggagtcgtgggggaggcttggtacagccgtggggggtccctgagactctcctgtgcagcctctggattcaccttcagtacctacgacatgcacgtgggtccnccaacctcgtaaggaaaacggtccgggagtggggtctacgaggggattggctaggtggttggtgacgatattctattcagactccgtagaaggcgatcacntctccaganaaatcaccaacactcctacatctacaaatgaacagacctagagacggacgggacacggctagtagtattacgtgtgacgaaaggacggggtactaaacgtttcttaattaacgttacttacggacgtacggttacggggaccgtaaaacgggaccccg

SEQ ID NO: 426782 - DNA, 544 bp, Homo sapiens
  misc_feature: GZ8MTXP02FPRB4.13.39.D06.1.454.CMB.2.raw
  modified_base (511)..(511): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttcagcagtggtagtttctactggagctggatccggcagccccgccgggaaggactggagtggattgggcttatcaatgccagtggggcacgagctacaacccccctccctcaacgcgccgcgtcaccattcagtagacacgtaccaaagaaccagcctctaccctgaaacgctgagttctgtcgaccgccgcagacacggccgtagtattaccgtgtgcgtcgacgagggtggacgtcgtcggggaccaacggggacccacggtccaccgtctaccncgacgccctaccaccgaacggcccagttcccgg

SEQ ID NO: 426783 - DNA, 813 bp, Homo sapiens
  misc_feature: GZ8MTXP02F9Q0H.13.39.D06.1.454.CMB.2.raw
  modified_base (237)..(237): a, c, t, g, unknown or other
  modified_base (308)..(308): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactgggtgaggccttcacagaccctgtccctcatctgcagtgtctctggtgctccttnagcagtggtagttctactggagctggatccggcacgcccggcgggaagggcgtggagtggagttggcttanacaagtcgaccgaggtcggggaccaccgagaccgtaacccaaccccccctccctacgaacgacggcccgtccgtacacctatttacgaagttaccgaccaaccgttacccaaagtaaacccgacgtaccctacctaccccgtagaaacgtcgtacggtaacgtttccgtcggttacggaccccggtacccgaccgtaaacggacccggtaaccggggtcccgttacgggtttaaacctttaccgggttcgggttaccggaccgggaccgggtaaccggtaacgggggttaccggggtaaaccgggtttccggggttacccggggggtaaacccggaaaacccggggggtaaacccccgtaacccgggggttaacccctaaaccccggggtttcccccgtaaccccggtttaaccgaaaccccggggttaccccccgttaaaacccccggaacccccgggaaaacccgggggtacccccctttaaccggttttacccccccggggg

SEQ ID NO: 426784 - DNA, 612 bp, Homo sapiens
  misc_feature: GZ8MTXP02I7K29.13.39.D06.1.454.CMB.2.raw
  modified_base (370)..(370): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttcagcagtggtagtttctactggagctggatccggcagccccgcgggaggactggagtggattgggcttatcaatgccaggtggggcacagctaccaacccccctcctcaagacgccgcgtcacctatttcagtanaccacgtaccaagaaccagcctctccctagaagctgagtttctggtcgacccgccgacacgaccgacggtcccgtagttaacttaccgtgtcgcggcgacgtagggtcggacgttcggtacgggggtacccgaaacgggggacccgtaaccgggttcctaacccgggttcccttcccgtaaccgaccggtaccccgttaccccgaacccggaaacggggtccccctaacgtttcccccgggg

SEQ ID NO: 426785 - DNA, 629 bp, Homo sapiens
  misc_feature: GZ8MTXP02F2CY7.13.39.D06.1.454.CMB.2.raw
  modified_base (231)..(231): a, c, t, g, unknown or other
  modified_base (308)..(308): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctcgtgtctggctctcctggacagtcgatcatcgtctctgcactggaaccngcactgatgttggtggttatactatgtctctgtatacaacaacaccaggacaaacgaccccaaactcatcattatanaagtctatttactcccgcctcgaggtactttactaatcgtcttctctggtcctcaagtctggacaacacggccctccgtcacctatcctcgtcgggtcctaccgaggtaccgtagaaacgggacggaacggtccttaagggtaactttaacttacgttacggtaccaaggtcctaactaacttaacttaaaccgaaaaccctaacttaaacctaaaaccgaacctaccgtaaacggtttaccgtaacggggttaaacggtaaccggggtaaaaccgtaaaaccgtaccgttaacccggttacccgtaacggttaaccccgg

SEQ ID NO: 426786 - DNA, 580 bp, Homo sapiens
  misc_feature: GZ8MTXP02GPSNS.13.39.D06.1.454.CMB.2.raw
  modified_base (211)..(211): a, c, t, g, unknown or other
  modified_base (237)..(237): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactgggtgaggccttcacagaccctgtccctnatctgcagtgtctctggtgctccttnagcaggttggtagtttctactggagctggatccggcacggcccggacgggaaggcgtggagtggagttggcttatcaatgccgaggtggggcacgagctaccacccccctcctacaagcgccgcgtcacctattcagtacgacacgtacaaagaaccagctcctccctagaacgtctagtacgttcgtgacgacccgccgacaacgaccgacggccgttagtacttacgtgtcgccgcgacgagggtcgacgtcggacgggaccgaacgggacccgtacggtcctacccggtcttacccgcgaccgccctacccgaaccgaccgggacccctagttcccccgg

SEQ ID NO: 426787 - DNA, 578 bp, Homo sapiens
  misc_feature: GZ8MTXP02HW162.13.39.D06.1.454.CMB.2.raw
  modified_base (416)..(416): a, c, t, g, unknown or other
  modified_base (483)..(483): a, c, t, g, unknown or other
  modified_base (492)..(492): a, c, t, g, unknown or other
  modified_base (510)..(510): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgtatggttggtaggttataaactatgtctcctggtatacaacaaccacccaggaccaaaccgacccccaaaactcactatatttatagtaaagttctaatttacgtccccggtccctagagggtacttttctaacttcgtctttcttcgtcggtctaccaagttctacggtccaaacnccggacccttccacgacctactcctcgtacgggcctccgagtcctagaagcgagctagacttatacngtcagctanaactaactaccaaactanacaaacacacgtacgttacgttacggaacggtacgaaacgtaacgacctaccgtacgttacggacccg

SEQ ID NO: 426788 - DNA, 858 bp, Homo sapiens
  misc_feature: GZ8MTXP02IIV02.13.39.D06.1.454.CMB.2.raw
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactgggtgacggccttcacagaccctgtccctcatctgcagtcgtctcgtggtgctccttcagctaggttggttagtttctacgtggagtcgtggacgtccggcgacggccccggacggggaagggacgtgggaggtagggtagttgggtactttaagtacgtaaacgtcggacccgtaaggggtcgggggacctaacccgacgtaaccgttaaccccctaaacccccccgttacccccgtaccgaaacggtaccggtaccccggtaccgttacccgacccgttacgttttacaaacgggttaaaccgaacccgtaaccggttaaacccaaaaccggaaaccctacggaccctttacccgtaccccgtaaggtaaaccgtccgttacggttaacgtttccgtacggttaccggaccccgacccggaccgaaaccggtacccggtaacccggggtaccgtttacggttaaacctttaccggtcggttacggaccggtaaccggtaacggtaacgggggttacgggtaacccgggttcgggtacccgggggaaaccggaaaccggggtaacccggtaaccggggtcccgtaaaccccgggttccttacccggtaaccgtacccgggtcccctaacccggaaacccggtacccggggtaccccttaccgggtttacccccgg

SEQ ID NO: 426789 - DNA, 690 bp, Homo sapiens
  misc_feature: GZ8MTXP02I738F.13.39.D06.1.454.CMB.2.raw
  modified_base (236)..(236): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttnagcagtgtagttctactggagctggactccgggcacggccccggacggggaagggacgtgggagtggagtttgggcttatacgaatcggccgtaggtcggggacctaccgacgcctacccaaccccccctccctacaacgaccgccgaccgtccacccgtatttcgaagttacgacctaaccggtaccaaacgaaacccagcccttacccgtacccctaggaaaccgtctacgtaagttttccctaggtaccgaaccccgcccggaccgaaggaaccccgtacggtccccggtttaggttaaaccttaccgtcggttacggcccgacggaccgtaaggggtcggacggttccgacgggggacccaaacggggacccgtaccggtaccgtaaccggtccctacctcgaccggtaccctacccgaacccgaaccgggacccctacgtttcccccgg

SEQ ID NO: 426790 - DNA, 600 bp, Homo sapiens
  misc_feature: GZ8MTXP02JVLMV.13.39.D06.1.454.CMB.2.raw
  modified_base (229)..(229): a, c, t, g, unknown or other
tcagtcacgtactacacgaccggtgctcgatttagtgacatctcgcagttcgtttgggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcatggaaacngcagtgattcgttgggacttatagtacttgtctcctggtaccaacaccacccaggcaacggcccccagacgtcatctaatttagtgggggacaagtacggcggccgtcgtagggtactttccacctcgcttctcgtggctccagtctaggccaaacgccggccctccgtagactaactcctcgtcggtcctcccgaggtcctgaacggacgaggcctaggtccctttaagttaccgtgtctcgtctaccgtatacgtagcttaggtttcttcgtggttcggtcgttcgggacgggtacgggtaccctaaaggtcggtaacccgtcgtaacggttccacggacccgtaacggccgtcccgtcccgttaccgg

SEQ ID NO: 426791 - DNA, 608 bp, Homo sapiens
  misc_feature: GZ8MTXP02JDDKN.13.39.D06.1.454.CMB.2.raw
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttcagcagtgtagtttctactggagctggatccggcagccccgcgggaaggctggagtggattgggcttatcaatgccaggtggggcaccgagctaccgaacccccctccctacaagacgccgcgtcacctatttcagtacgacacgtaccaaagaacccagcctactccctgaacgctacgagtttctcgtacgacccgccgacacggaccgacgggtcccgtaggttaacttacgtggtacgcggcgtacgagggttcggaccgttcggtcgggggaccaaacgggggaccctaacgggtcctacccggttctaccccgttaacgaccggtcccctacccgaaccgaaccggggcccccaaggtttcccccgg

SEQ ID NO: 426792 - DNA, 748 bp, Homo sapiens
  misc_feature: GZ8MTXP02FS7DF.13.39.D06.1.454.CMB.2.raw
  modified_base (210)..(210): a, c, t, g, unknown or other
  modified_base (240)..(240): a, c, t, g, unknown or other
  modified_base (440)..(440): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctnatctgctagtgtctcgtggtcgcttccttnagctaggttggtagttttcactggagctggactccggcacggcccggacggggaaggacgtgggagtggagtttgggtacttatcaagtgtcgaggtggggaccaccgaggacctaaccaaccccccccttccctaccgaaacgacgcccgaccgttccaccgtatttacagtacgacctaacgtaccaaacgaaacccngtccctctaccccgtgaaacgtcgtaggtaacgtttcgtggtaccgacccggccgacgaacggacccgaaccgggtcccgttaagtaccgtttacgtcggttcggtaccgcggaaccggtaacgggggttcggtaaacccgggtttccggggtaaaccgggggacccggtaaaaccgggggtaccccgaaccgggggttacccgtaaaccccgggttcccttacccgttaaccggaacccccggtaccccgttacccccgaaaacccggaaaccggggtccccccgtaaacggttttcccccccgggg

SEQ ID NO: 426793 - DNA, 577 bp, Homo sapiens
  misc_feature: GZ8MTXP02GD9OJ.13.39.D06.1.454.CMB.2.raw
  modified_base (370)..(370): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagacccctgtccctcatctgcagtgtctctggtgctccttcagcagtggtagtttctactggagctggatccggcacggccccggccgggaggacgtggagtgggattgggcttatcgaatgccgaggtggggcaccgagctaccaacccccctccctacaagacgccgcgtcnccatttcagtagacacgtaccaaagaaccagcctctcccgtagaacgctgtagttctgtcgacccgccgacagaccgacggtccgtagtacttacgtgtcgcgcgaccgagggtgacggtcgtacggggaccaacgggacccgacggtaccacccggttctccgtaacgcgtccctaccgacccgtacggaccctacgtttccccgg

SEQ ID NO: 426794 - DNA, 869 bp, Homo sapiens
  misc_feature: GZ8MTXP02IOKRT.13.39.D06.1.454.CMB.2.raw
  modified_base (231)..(231): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatcaccatcctcctgcactaggaaacngcagtgattcgttagggtacttagtcgtaccttgtccttccgtacggtaaccgaacaaccaccccgaggaccaaaccgaccccctaaactctaacgtttacgttacggggtacaaagtaacgccggtaccctacgtacggtctttacgtgtactcgtccttccgtcgtcggtcctacgtaacgttccgtacgggaccaaaccggtacccggtcccccttaccccgtacgaaaccttaaacgtccgttacgtaccggtaacccttacccggaacggggtaccccgggaaaggggtaaccgtaacgggttaccgtttacgggtttaacttttttaaccggttggttttacgtttaccgtaagtttaacgtacgggtaaaccgggtaaaggggtaacggtaggtttaacgttacggttttaaaggtttcgggtttaaccgggttttaaagggggtaaaacgggtttaccgggggtaaaacccgtttaaacggggtttccccgttaaacccgggggttttaccggtttaccggggttaaacccgtaaacccgggttaacccccggaaaacccgggtaccccctaaaacccccgttcggtaccggttaacccctttaccgtttaccccgttttaaccccccgg

SEQ ID NO: 426795 - DNA, 808 bp, Homo sapiens
  misc_feature: GZ8MTXP02IFOPH.13.39.D06.1.454.CMB.2.raw
  modified_base (442)..(442): a, c, t, g, unknown or other
tcagtcacgtactacacgaccggtgctcgatttagtgacatctcgcagttctttggggagctctgggagtggagccccagccttgggattcccaagtgtttgttttccgtgatcaggactgaacacacaggactcaccatggagttggggctgagctggattttccttcttgctatgttagaaggtgtccagtgtggagtgcacgtggtggagtcggtgggggagtcgttggtacgaggtccgggtcgggggtccctggacgtactcctccgtggtcgcgacgtcctcgtggtacttcctaccttcacgtaccctacgacatcgacctacgttcgggtccccgacctaaccgtacgtaaaacgggaaaacggtccgggaaggttcgggtacctacggaaggggtagttcggacgtaggttcggttaggtacgaactaacgtntttaccttagttccgaacggtaccgtaccggtaaggggaaaccgggtccgtaacttacccgaaccctacttacccgtaccgaaacggtaaaagaaaaacgttcgaaaccccaaaaacctaacccttacccctttaccaacgtttacccttaaaccgtaaaattaacgaaacgaccgtaccgtaaggaaacggaacggggaaccggggaaccggacgggtacgttacgggttattaacgtttacgtaggttaggaaccggtaaaaggggacggggttaacctttaactttttaccgtttaaagttaaccgtttaaccgttaccggtaacggttcggtaaccgggggaacggtaaaaccgggaccccg

SEQ ID NO: 426796 - DNA, 668 bp, Homo sapiens
  misc_feature: GZ8MTXP02G5MU4.13.39.D06.1.454.CMB.2.raw
  modified_base (227)..(227): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcaccatctcctgcactggaaacngcagtgatcgttggacttatagtacttgtctcctggtaccaacaccaccagccaacggccccagacgtcatctattagtggggacaagtacggcggtccgtagacgggtactttccaccgtcgtctttctcgtcggcctaccgagtccgtggaccaaccgaccggtccctccgtcggactaactccgtcgtcggtcctcccgagtccgtaggaacgggacggacggtccgttacggtacccttaaagtttccgtggtccctttcggcccttaacgtaattacgtcggtaccgttacgggtttcctttcgtcggtttcgggttccggtttccggggacgggttaacgggttaccgtaaaacgggttccgtacccggtttaccgtaacgggttacccgaccggaccccgtaacggtccccgttcccggtaccccccgtttcgg

SEQ ID NO: 426797 - DNA, 590 bp, Homo sapiens
  misc_feature: GZ8MTXP02JEXZ6.13.39.D06.1.454.CMB.2.raw
  modified_base (405)..(405): a, c, t, g, unknown or other
tcagtcacgtactacacgaccggtgctcgatttagtgacatctcgcagttctttggggacttttctgagagtcctggacctcctgtgcaagaacatgaaacatctgtggttcttcctcctcctggtggcagctcccagatgggtcctgtcccaggtgcagctgcaggagtcgggcccaggacctggtgaggccttcacagaccctgtccctcatctgcagtgtctctggtgctccttcagcagtggtagttctactggagctggatccggcagcccgcgggaggctggagtggattggcttagtcaatgccgaggtggggccaccgagcctaccaaccccccctccctacgaacgacgacccgccgttcacctatttcagtacgaacacgtaccaacgaaacccngacctctccctgaaagtcctgtagttctgtcgacccgccgcaacgaccgaccggccgtacgtattaccgtgtcgcgcgacgagggtcgaacgtcgtacgggggacctaaacggggacccaacggttccgaacccgtcgtcccgtcgacggccctaccaacccgaacgggccccacgtttccccgg

SEQ ID NO: 426798 - DNA, 551 bp, Homo sapiens
  misc_feature: GZ8MTXP02GM5SU.13.39.D06.1.454.CMB.2.raw
  modified_base (204)..(204): a, c, t, g, unknown or other
  modified_base (234)..(234): a, c, t, g, unknown or other
  modified_base (436)..(436): a, c, t, g, unknown or other
  modified_base (466)..(466): a, c, t, g, unknown or other
  modified_base (470)..(470): a, c, t, g, unknown or other
  modified_base (477)..(477): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacgagggtcctgggcccaggtctgccctgactcagcctgcctcgtgtctggctctctggacngtcatcatcgtctcctgcacgtggaaaccngcactgtagtggttggttagttaataatatcgtctacgtagtactacaacaaccaccgacgaaccaaccacccaactcatactattatagtatatattcgcccgtctacgtagtacttactacttctctctcgtcgtactacgtagtcgtacgaccaaccgtcccgtccctaccgtacgacctactccgtcgtcgtccacgngtagagaagacgtagtctagtaatactacncganactctanatacaacacacaacaacactacgtacgtacgtaacggaagtacgaaccgtacgtccgtaccgtacgtacgtacg

SEQ ID NO: 426799 - DNA, 652 bp, Homo sapiens
  misc_feature: GZ8MTXP02JUGW1.13.39.D06.1.454.CMB.2.raw
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctcgtccctcatctgcagtgtctctggtggctccttcagcaggtggttagtttctactggagctggatcccggcgacggccccggaccggggaagggaccgtgggaggtcgggtagttggggcttagtacgaagtcggccgagggtcggggctaccgagacctaccaaccccccctccctacgaacgacgccgaccgtaccacctactttacacgttacgacctacgtaccaaacgtaacccagtcctacctcccgtagaacgcttagacgtttcaggtcgacccgtcgagacgacgcggtccgttaggtacttacgtggtcggccggcggtacgaggggtcgaccggtcggtacgggggaccgaaacggggcccgaacgggtcccaacccggtccttaccgccgtaaccgcccctaccgaacccgaaccgggcccctacggtttccccgg

SEQ ID NO: 426800 - DNA, 570 bp, Homo sapiens
  misc_feature: GZ8MTXP02I0BX1.13.39.D06.1.454.CMB.2.raw
  modified_base (228)..(228): a, c, t, g, unknown or other
  modified_base (320)..(320): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcaccatctcctgcactaggaaacngcagtgatcgttggacttatagtacttgtctcctcggtaccaacaccacccgaggccaaccggcccccagacgtacactactaagtttaggnggggacaagtacggcggaccgtagaggtactttccaccgtcgtcttctcgtcgtcctcgacgtctcgaccaccgaccgtccctccagacctacgtcctcgtcgtctccgagtctaggacggacgaggtctcgtaccttatacgtgctgctacatctgtactgttctgtcgttcggttacgtcggacggtacgtacgtaacgtcgtaaccgtcgtaacgtacgaccgaccgtacgcctcccggcccgttcg

SEQ ID NO: 426801 - DNA, 605 bp, Homo sapiens
  misc_feature: GZ8MTXP02HHI5H.13.39.D06.1.454.CMB.2.raw
  modified_base (229)..(229): a, c, t, g, unknown or other
  modified_base (305)..(305): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcgtggacttatagacttgtctcctgtaccacaccaccgaggcaacggccccagacgtcatctattagnggggacaagtaggcgcggtcgagggtactttcacctcgtcttctcgtcgctacagtctacggacaaccgaccggtccctacccgtacgaacctaacttccgtcgtcggtaccctcccgaggtcctaggacggacgacggtctcgtacccttaagttactgtctgtctacaatagtcgtcgttaggttcttcgtcggttcggtaccgtttcggggacgggtaacggtaccgtaaacggtccggtacccgttacgtaacggtccgaacggacccgtaaggtcccgtaccgtcccccgttcgg

SEQ ID NO: 426802 - DNA, 784 bp, Homo sapiens
  misc_feature: GZ8MTXP02GEVME.13.39.D06.1.454.CMB.2.raw
  modified_base (542)..(542): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagacccctgtccccactctcgtcgacgtgttcgtcctggttgggtcgtccttcctagacgtagtaggttaggtttacgttactaggtggacgtggtaggtaccggtccggacgacccggaccccgggaacggggaacggtcggtaggtagggtaggttagggttacgttagttacgtaacgtaggtccgacgggtaggggtccgggacccaaccggtacgtaccccgtaacccccgtacccccccccgttaccgaaaccgaaaccggcccgtcccggtacccgtacctacctttacgtaacggtaaacgtaccgaaacccgttaccgaaaccgaaaacccgtaacnccgttaccctcccgttacggaaagtccgtcgtacggtttcgtcgtacgggacccgaccccggagacgaaccgaccgggttcccggtatttaacggttactcgggtggcgacccggtaaggcgggttacgggaccggtccggttacgggggacccggaaacggggtaaccgacccggtacgtacccgcgttcctacccgaagcccccgttaccaccgacgggacccctcttccggttcccccg

SEQ ID NO: 426803 - DNA, 615 bp, Homo sapiens
  misc_feature: GZ8MTXP02HRN2F.13.39.D06.1.454.CMB.2.raw
  modified_base (235)..(235): a, c, t, g, unknown or other
  modified_base (492)..(492): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctcctnagcagtgtattctacgtggagctggatccggcacggccccggacgggaaggacgtgggaggtgggagtttggggcttagtcaagtcgccgaggtcggggacaccgagccgtaaccaaccccccctcccgtacaagacgcccgtcgtacacctagtttcagtacgaccacgtaccaaacgaacccagcctccgtaccctagaacgtcttgagtttctgtcgaccgccgacgaacgacgacggtccgtagtacttacgngtgcgacgacgacgggtggaccgtcggtacggggaccgaaacgggtcccgtaacggttccgacccggttcctaccgtccgaaccggccctacccgaaacctaacgtcccggtaccctacccgg

SEQ ID NO: 426804 - DNA, 749 bp, Homo sapiens
  misc_feature: GZ8MTXP02HY71P.13.39.D06.1.454.CMB.2.raw
  modified_base (244)..(244): a, c, t, g, unknown or other
tcagtcacgtactacacgaccggtgctcgatttagtgacatctcgcagttcgtttggggggggtcacaagaggcagcgctctcgggacgtctccaccatggcctgggctctgctgctcctcactctcctcactcaggacacgagggtcctgggcccagtctgcccctgactcagcctcgcctccgtgtccgtgggtctccgtggacagtcactccacctactcctcctgacaacgtaggaaacngctagtgtattcgtaggtacttagtacgtacttcgtcctaccgtacggtaacccaaccacccaccccgacggaccgaaccggtcccccaagacgtacagttactaaggttaggaggggtaactaacggtacggggccggtaccggtacgtaacgggtacctttaccgacccgttccgtcctttcgtccgtacggtccttacgtacgtcgtacgaccaacccgtaccggtccctaccgtacgaaccgtacttccgtcgtacggtacctaccgtaggtccgtaagggaacgggaaccgtacgggtccttaacggttacccttaaacgtttaccgtcggtccttacggtaccctaagtacgttacgttcgtacggtttacggtttcttcggttcgggtttcgggtccggttacggggtaccggggtaacggtaaccgtaacgggtccgtacccggttacgaaccggtacgaaccggtaccgaacgtcccgtacccggtaccccgtccg

SEQ ID NO: 426805 - DNA, 664 bp, Homo sapiens
  misc_feature: GZ8MTXP02JUUT8.13.39.D06.1.454.CMB.2.raw
  modified_base (227)..(227): a, c, t, g, unknown or other
  modified_base (306)..(306): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcaccatctcctgcactggaaacngcagtgatcttgggacttatagacttgtctcctggtaccaacaccacccaggcaacggccccagacgtcatcatttagnggggacaagtaggcggccgtcgaggggtactttccgacctcgcttctctcggcctcagtctacggaccaacgaccgccctccgtagacctaacttcctcgtcggtcctacccgaggtccgtacggaacggggaccggtacggtccgttacggtacctttaacgttaccgtcgtaccgttcggtccttacctaagttacgtcggtaccgtttaacgggttttcctttcgttcgggtttcggttcccgggtttcggggaccggggttaacgggtaccgtaaaacgggttccgtaccccggttaccgttaacggtaccgaccggtacccgtacggtcccgtacccggtcccccgttaccgg

SEQ ID NO: 426806 - DNA, 659 bp, Homo sapiens
  misc_feature: GZ8MTXP02IAFR1.13.39.D06.1.454.CMB.2.raw
  modified_base (319)..(319): a, c, t, g, unknown or other
  modified_base (524)..(524): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactgggtgaggccttcacagaccctgtccctcatctgcagtgtctcgtggtgccttccttcagcaggttggttagtttctacgtggagcgtggactccggcacgccccggacgggaaggcgtggagtggattggcttaancaatcgcgaggtggggcacgagcctaaccaaccccccctcctacgaacgacgtccgcgtaccacctatttacaacgttaccgaacaccggtaccaaacggaaccccaagcccttcccgtaccccgttaggaaacgtcgttacgtacgtttaccgcggttacgaacccgccgacgacggtacgaccggtccgttagtactttacgnggtacgccgtacgacgacggggtacgaaccggtcggtacgggggaccgaaaacgggaccgaccgggttacccacccggtttccacccgtcgaaccgtcccctaccgaacccggacccggcccttacgtcccccgg

SEQ ID NO: 426807 - DNA, 617 bp, Homo sapiens
  misc_feature: GZ8MTXP02FY3X7.13.39.D06.1.454.CMB.2.raw
  modified_base (229)..(229): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgattcgttgggacttatagtacttgtctctacggtaaccaacaccacccgaggaccaacggcccccaagacgtcatctagtttagtggggacaagtacgggccggtaccgtcgagggtactttccacctccgtcttctctcggcctacgagtctacggaccaaacccgccggtccctccctagaaccaattcctcgtcggtcctcgacgtcgtaggacggtacgaggtctacgtaccttagttacgtgtcctggtctactagtagtcgtacgttggttctttgtggttcggttcgttacggggcggtaaggggtaaccctaaaggtccgtaccggtacgttaacggaccgacggacccgaggtccctcccggtccccgttcgg

SEQ ID NO: 426808 - DNA, 575 bp, Homo sapiens
  misc_feature: GZ8MTXP02JP0ST.13.39.D06.1.454.CMB.2.raw
  modified_base (236)..(236): a, c, t, g, unknown or other
  modified_base (321)..(321): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttnagcagtggtagtttctacgtggagctggactcccggcacggccccggccggggaagggacgtgggagtgggtagttggggcttancaatcgccgaggtggggcaccgagcctaccaaccccccctcctacaacgcgccgcgtcacctattcagtacgacacgtacaaacgaaccagacctctccctagaacgctagacgttctgtcgaccgccgcacgcgacggccgtagtacttacgtgtcgcgacgacgagggtcgacgtcggtcggggaccaaacgggccacggtccaccggtcctcctcgacgccctaccgaccgaccggccctacgttccccgg

SEQ ID NO: 426809 - DNA, 690 bp, Homo sapiens
  misc_feature: GZ8MTXP02JIRNM.13.39.D06.1.454.CMB.2.raw
  modified_base (228)..(228): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcatcaccatctcctgcactggaaacngcagtgattcgttaggtacttagtagtacttcgtctccgtacgtaacccaaccaacccgaacccgacggaccgaaccggaccccagacgtactactactaagttaggtaggggacaagtacggcggccgtacgacggtacttccacccgtccgtcttctcgtcgtcctaccgtacgtcgtacgaccaaccgaccgtccctaccagtaacctacttccgtccgtcggtccctaccgacggtaccgtagggaacgggaacggacggtccgttacgtaccttaagttacgtgtccgttacgtcctacgtagttacgtcgtacgttacgtttcgttcgttcggttacggttccggttaccggggtaccgggtaacgggttaccgtaaacggtacccgtaaccggttaccgtaacggtacccgaaccggtacccgtacggtcccgttacccggtacccccgttacgg

SEQ ID NO: 426810 - DNA, 556 bp, Homo sapiens
  misc_feature: GZ8MTXP02FUC54.13.39.D06.1.454.CMB.2.raw
  modified_base (226)..(226): a, c, t, g, unknown or other
  modified_base (232)..(232): a, c, t, g, unknown or other
  modified_base (438)..(438): a, c, t, g, unknown or other
  modified_base (443)..(443): a, c, t, g, unknown or other
  modified_base (452)..(452): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcatcacatctcctgcactggaaacngcagtnatcgttggacttatagactgtctctggtaccaacaccaccagcaacggccccagagtcatcattagtggggcaagtaggcggacgtcgaggtactttccacctcgtcttctcgtcggcctaccagtctggacaaaccgccggccttcccagaactaactctctcggtctacccagggcctggacggacgagctagacctagttacngctcnctcatacgngtcgtagttcgtcgtggttcggtacgtcggacggtacggtaaccgtaacgtcgaccgtacgtaacgtaccgacgacccgtacggtccgtacccgtaccccgtcg

SEQ ID NO: 426811 - DNA, 604 bp, Homo sapiens
  misc_feature: GZ8MTXP02FL70G.13.39.D06.1.454.CMB.2.raw
  modified_base (210)..(210): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctnatctgcagtgtctctggtgctccttcagcagtggtagtttctactggagctggatccggcacgccccggccggggaagggacgtggaggtgggagttggggcttagtcaagtcggccgaggtcgggggaccaccgagccgtaaccaacccccccctccctacaacgacgcccgcgtacacctattcagtacgacacgtaccaaacgaaacccagccctacctcccgtagaacgtctagtacgttcgtgtacgacccgccgaccgagaccgacgggtccgtagttacttacgtgtcgcgacgacgagggtcgacggtcgtcggggaccaaacggggacccgacggtccgacccgtctccgtcgacgccctaccgaccgacggcccacgttcccgg

SEQ ID NO: 426812 - DNA, 573 bp, Homo sapiens
  misc_feature: GZ8MTXP02H5XRU.13.39.D06.1.454.CMB.2.raw
  modified_base (235)..(235): a, c, t, g, unknown or other
  modified_base (305)..(305): a, c, t, g, unknown or other
  modified_base (354)..(354): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctcctnagcagtgtagttctactggagctggatccggcagccccgccgggaagggactggagtggattgggcttancaaatgccaggtggggcaccagcctaccaacccccctcctacaacgacnccgcgtcacctatttcaagtacgaccacgtaccaaagaaccagcctctccctagaagctgattctgtcgaccgccgcagaccgacggccgtgtacttaccgtgtcgcgcgacgaggtcggacgttcggtcggggaccaaacgggggacccacgggtccaacccggttcctaccgtccgaacggccctacccgaccgaacgggccccaacgtttccccgg

SEQ ID NO: 426813 - DNA, 574 bp, Homo sapiens
  misc_feature: GZ8MTXP02IRE1C.13.39.D06.1.454.CMB.2.raw
  modified_base (330)..(330): a, c, t, g, unknown or other
  modified_base (337)..(337): a, c, t, g, unknown or other
  modified_base (346)..(346): a, c, t, g, unknown or other
  modified_base (407)..(407): a, c, t, g, unknown or other
  modified_base (436)..(436): a, c, t, g, unknown or other
tcagtcacgtactacacgaccggtgctcgatttagtgacatctcgcagttctttggggagctctgggagtggagccccagccttgggattcccaagtgtttgttttccgtgatcaggactgaacacacaggactcaccatggagttggggctgagctggattttccttcttgctatgttagaaggtgtccagtgtgaggtgcacctggtggagtcgtgggggagcttggtacagccgtggggggtccctgagactctcctgtgcagcctctgggtcaccgtcagtcacacctacatgagctgggtccgccaggctcgagggagggctggngtgcgtntctttattntagtagtgtagtacatacctcgcagtcctccggtgagggggccattcacctatctccaganaacaatccaaagacaacgctgtttactanaaatagaactagactacggagacgaccgtatacgacgacgggccgttagttacgttacgtggttcgacggaggagtacggtccggggaacccaacggtaaccgttaactacggtactacgttcgggaacgttccgggg

SEQ ID NO: 426814 - DNA, 583 bp, Homo sapiens
  misc_feature: GZ8MTXP02IGM8Z.13.39.D06.1.454.CMB.2.raw
  modified_base (312)..(312): a, c, t, g, unknown or other
  modified_base (359)..(359): a, c, t, g, unknown or other
  modified_base (365)..(365): a, c, t, g, unknown or other
  modified_base (447)..(447): a, c, t, g, unknown or other
tcagtcacgtactacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaacagcagtgatcgttgggacttatagtacttgtctcctaggtaccaacaccacccaggccaaccggccccagacgtcatctatttagngggggacaagtggcggcgtcgaggacttccactcgcttctcgtgccncagtcnggacacgaccgctcctgacatccgtctggtcctcaggtcctaggacggacgacggtctacggtaccctattacgtgtcgttnactcgaagttatcgtacgttcgtttccgtttcgtcgggttcggtttcggtacggcggggttaacggtaaccgtacggtacgtcccgttacggtaacggtacgaccgaccgtaacggtcctaccggtcccccgttcg

SEQ ID NO: 426815 - DNA, 727 bp, Homo sapiens
  misc_feature: GZ8MTXP02IEGNU.13.39.D06.1.454.CMB.2.raw
  modified_base (220)..(220): a, c, t, g, unknown or other
  modified_base (238)..(238): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcggcccaggactggtgaggccttcacacgaccctgtccctcatctgcagtntctcgtggtgcctccttnagcgaggtggttacgttcacgtggagcgtggactccggacacggccccggacgggaaggtacgtgggagtgggtagttcgggcttaatcgaatcggaccgtaggggtcggggaccaaccgtacgaccctaacccaacccccccctcctaacgaacgaccgccgcgtaccaccttatttacgaacgttacgaaccctaccggtaaaccaaaacggaaccctagacccttacccgtacccgtaaggaaccgtcgttacggtacgtttaccgcggttaccgaaccccggccgaccgaaacggtacccggtaccgggtccgttaacgttaaacgtttcgtacggtacgaccggtacggaaccggtgggtacggaccggtttccggacggggtaccgaaacgggaccccgtacggtaccccgtcccgtacctcccgtaacgaacccgccccgttacccgaaaaccggtaccggacccccttacggttcccccgg

SEQ ID NO: 426816 - DNA, 542 bp, Homo sapiens
  misc_feature: GZ8MTXP02FH0RV.13.39.D06.1.454.CMB.2.raw
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattggggcttatcaatgccaggtgggggcaccagctacaaccccccctccctcaagcgccgcgtcaccatttcagtagacacgtccaaagaaccagcctctccctgaagctgagttctgtcgaccgccgcagacacggccgtgtattactgtagcgcgacgagggtggacgtcgtggggccaacggggaccacgggtccacccggtctcctcgacgccctaccaccgaacgggcccagtccccgg

SEQ ID NO: 426817 - DNA, 654 bp, Homo sapiens
  misc_feature: GZ8MTXP02F7QUK.13.39.D06.1.454.CMB.2.raw
  modified_base (233)..(233): a, c, t, g, unknown or other
  modified_base (334)..(334): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtcctgccctgactcagcctgcctcgtgtctggctctcctggacagtcgatcatcgtctcctgcactggaaccngcactgatgttggtgttatactatgtctcctgtactcaacaacacccgagaccaaacgacccccaaaactcactactatttatagtaagtctattttaacnccccggtccctacgagggtactttcgtaacttcgtctttctcgttcggaccttaccgtaagttcctacggaacccgaaaccgtacccgggtaccctaccccgtacgtaaccctacgtcccgttcgtaccggggtcccaccgtacggtccgtaacggaaacggtaaccggagtacgttacggtaatttaaccgtacgtcggtcggtacctccgtacggtaacgtacgtacgtacccttaaccctttgtacggttccgttacggtactacgtacgaaccgtaacggtcccgtaaccgtccgtaacggtccacggaacccccg

SEQ ID NO: 426818 - DNA, 651 bp, Homo sapiens
  misc_feature: GZ8MTXP02ICDQ7.13.39.D06.1.454.CMB.2.raw
  modified_base (461)..(461): a, c, t, g, unknown or other
  modified_base (561)..(561): a, c, t, g, unknown or other
  modified_base (576)..(576): a, c, t, g, unknown or other
tcagtcacgtactacacgaccggtgctcgatttagtgacatctcgcagttctttggggagctctgggagtggagccccagccttgggattcccaagtgtttgttttccgtgatcaggactgaacacacaggactcaccatggagttggggctgagctggtattttccttcttgctatgttagaaggtgtcagtgtgaggtgcacctggtgagtcgtgggggagtcttggtacagccggtggggggtccctgacgtactctcctgtcgcacgcctcgtggcttcctaccttcacgtacctacgacatgctacgtcggtcccgaccaaccgtacgtaaaggaaacggtccggaggtgggtactcgagggtagttggcgtaggttcgttggtacgacactagtttactactttcgaacgttccgttaccggtaggaacggggtacccaatttcccaacccttancctaccgaagtaaacgaaaactacgaaccctaaactaaaccttcccgttacaacttacttaactaaacagtaacacgtcaggaagacggacggcacggtntagtacgtattacgngtagaacgaggacggtacttaattttactaacttaacgttacgtacgtacgtacggacggaaacgaaacggcccg

SEQ ID NO: 426819 - DNA, 710 bp, Homo sapiens
  misc_feature: GZ8MTXP02HISU0.13.39.D06.1.454.CMB.2.raw
  modified_base (203)..(203): a, c, t, g, unknown or other
  modified_base (229)..(229): a, c, t, g, unknown or other
  modified_base (232)..(232): a, c, t, g, unknown or other
  modified_base (251)..(251): a, c, t, g, unknown or other
  modified_base (295)..(295): a, c, t, g, unknown or other
  modified_base (301)..(301): a, c, t, g, unknown or other
  modified_base (306)..(306): a, c, t, g, unknown or other
  modified_base (313)..(313): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacgagggtcctgggcccagtctgccctgactcagcctgcctcgtgtctggctctctggacngtcgatcatcgtctctgcagtgaccngcntgatggtgtgttataactntgtctcgtgtatacaacacaccgagacaaaccgcccaaatcatntattangtatntattacnccggtaccctgacggtactttactaacgttcctcttacctcgtacggtacccttaccgtaaacggtttcgacggaccctaaaccgtaccccggttccccttaccccgtaggtaaacccctacgttccgttcggtaccggggtcccttaccgtacggggaccttaacgggaaacggtacccggtaggtaccttagggtttaaactttacgttaaccggtcgaccggtacgtaaccttacgtaaaacttaaaccgttaaaacccacccctaaattaaacccggaaaccaaacccgtaaagttaccggtttaccggtaacgggtaaaaccggttcggggtaaaaacccttaaccggtacccgtaaacccccggtttacggttaaaccggtaaacccccgg

SEQ ID NO: 426820 - DNA, 748 bp, Homo sapiens
  misc_feature: GZ8MTXP02FJBSK.13.39.D06.1.454.CMB.2.raw
  modified_base (210)..(210): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctnatctgcagtgtctctggtgctccttcagcagtggtagtttctacgtggagcgtggacgtccggcacggccccggaccggggaacgggacgtgggaaggtgggtaagtttggggactttaagtaccaaaagttcggacccgtaaggggtcggggggaccaaccgacggtacctttaaacccaaaccccccccccgttcccctaacgaaaacgaccggccccggtaccgttaccacccttaacgttttaccgaaacggttaaacgaaccgtaaccgttaaaccgaaaacggtaaaacccaggtacccttacccttaccccgtaggaaacgtccgtagtaacgtttctaggtcgaaccccgccgacgaacgaccgaaccgggccgttagtaacttacctggtcgcggacgacggaggtcggacgtcggtacggggacccgtaaaggggacccgtacggtcccgtaacccgttccggtacccttaacgacccgacccgtaccccgaacccggtaaacggggccccctaacgtttcccccggg

SEQ ID NO: 426821 - DNA, 637 bp, Homo sapiens
  misc_feature: GZ8MTXP02G6WXL.13.39.D06.1.454.CMB.2.raw
  modified_base (236)..(236): a, c, t, g, unknown or other
  modified_base (523)..(523): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacacgaccctgtccctcatctgcagtgtctcgtggtgctctnagcaggtggtagttctacgtggagcgtggactccggcacggccccggacggggaagggacgtggaggtgggtacgttgggacttagtcgaatcgcccgagggtcggggacaccgagcctaaccgaaccccccctcctacgaacgacgcccgtcgtaccacctactttacgacggttaacgaaccgtacgtaaccgaaaacgaaacccacgtcctaccctacccgtagaaacgtctaggtacttccgtgccgacccgcgacgacgaccgtaccggcgtgtacttacgngtcgcgacgacgagggtcgaccgttcggacgggaccgaaacgggacccacgggtaccacccgtcctccgaaccgcggacccctacgaacccggaacggcccctacgttccccgg

SEQ ID NO: 426822 - DNA, 695 bp, Homo sapiens
  misc_feature: GZ8MTXP02G1QCT.13.39.D06.1.454.CMB.2.raw
  modified_base (211)..(211): a, c, t, g, unknown or other
  modified_base (225)..(225): a, c, t, g, unknown or other
  modified_base (236)..(236): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctccagatgggtcctgtcccaggtgcagctgcaggagtcgggcccaggactgggtgaggccttcacacgaccctgtccctnatctgcagtgtctntggtgctcctnagcagtgtagttctacgtggagcgtgactcccggcaccggccccggaccggggaaggacgtgggaggtgggtagtttcggggacttagtacgtaatcggaccgaggggtcggggaccaccgacgacctaaccgaacccccccctccgtacgaaacgcgcccgtacgtacctacctattacgagtaaccgacctaaccgtaaccaaaacgaaacccacgtaccctacccgtacccgtagaaaccggtctacggtaacgttcgtggtacccgacccggcccgacgacggaaccgtaccgggtccgttagttaacgttaccgtggcggacgaccggaggtacgggtcggaacggttcggaccgggggaaccgaaacggggacccgtaaccggtaccgacccgtccgtacccgaacgaccgaccccgtacccgaaccggtaccgggaccctacggtcccccgg

SEQ ID NO: 426823 - DNA, 811 bp, Homo sapiens
  misc_feature: GZ8MTXP02GUE12.13.39.D06.1.454.CMB.2.raw
tcagtcacgtactacacgaccggtgctcgatttagtgacatctcgcagttctttggggagctctgggagtggagccccagccttgggattcccaagtgtttgttttccgtgatcaggactgaacacacaggactcaccatggagttggggctgagctggattttcctcttgctatgttagaaggtgtccagtgtggagtgcacgtggtggagtcggtgggggagtcgttggtacgacgccggtcgggggtccctggacgtactctccgtgtcgcacgcctcgtggacttcctaccttcgacgtaacctacgactatcgaccacggtcgggtccccgaccctaacccgttacggtaaaacggggaaaacgggttcccgggtaaagggttcggggttaccgtacgggtaacggggtaagtttcggggaccgttaaggttcggggtttggggtacggtaacctaaccgttaacgtttaccttaacgtttccgaaacggttaccgttacccgggttaaggggaaccggggtacccgttaactttacccgaacccgtacgttccctaaccgaaaggtaaacgaaaaacgttcgaaaccctaaactaaccttacccttaccgtaacttaccttaacaaaacttacgaaacgacgttaccgtaggaacggaacggggaccgggacgtaacggtcgtagtagttaacgttacgtaggtacgaacggtaagggaacggggtacttaaacggttttacgttaacttaacgttacgttacggtaacggttcggtaacggggaaccgtaaaccgggtaacccg

SEQ ID NO: 426824 - DNA, 554 bp, Homo sapiens
  misc_feature: GZ8MTXP02IP8QY.13.39.D06.1.454.CMB.2.raw
  modified_base (211)..(211): a, c, t, g, unknown or other
  modified_base (235)..(235): a, c, t, g, unknown or other
  modified_base (238)..(238): a, c, t, g, unknown or other
  modified_base (246)..(246): a, c, t, g, unknown or other
  modified_base (248)..(248): a, c, t, g, unknown or other
  modified_base (250)..(252): a, c, t, g, unknown or other
  modified_base (254)..(254): a, c, t, g, unknown or other
  modified_base (257)..(258): a, c, t, g, unknown or other
  modified_base (267)..(268): a, c, t, g, unknown or other
  modified_base (270)..(271): a, c, t, g, unknown or other
  modified_base (273)..(273): a, c, t, g, unknown or other
  modified_base (277)..(277): a, c, t, g, unknown or other
  modified_base (279)..(280): a, c, t, g, unknown or other
  modified_base (282)..(282): a, c, t, g, unknown or other
  modified_base (286)..(286): a, c, t, g, unknown or other
  modified_base (289)..(289): a, c, t, g, unknown or other
  modified_base (296)..(296): a, c, t, g, unknown or other
  modified_base (306)..(306): a, c, t, g, unknown or other
  modified_base (310)..(310): a, c, t, g, unknown or other
  modified_base (315)..(315): a, c, t, g, unknown or other
  modified_base (321)..(321): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactgggtgaggccttcacagaccctgtccctnatctgcagtgtctgtggtgctctngcngtgtattnangnnngncgnngccgcgagnngnngngtgntnnangcgnggnggcacgncacacccccnctanacgcncgctcnctattcacgtacgacacgaccaaacaaccacgcctctaccgtagaacgctagtacgttcaggtaccgacccgcgacgacgacggtaccggcgttacgttaacgttacgcggtagccggtacgtacggtagggtcggacggttacgggccggggaccggaaaccgggtcgtaaccggtcccaccgtccgtacctcgacgccccgaccgaaccggaccggtcccgtacgtccccg

SEQ ID NO: 426825 - DNA, 721 bp, Homo sapiens
  misc_feature: GZ8MTXP02JEF9A.13.39.D06.1.454.CMB.2.raw
  modified_base (236)..(236): a, c, t, g, unknown or other
  modified_base (256)..(256): a, c, t, g, unknown or other
  modified_base (266)..(266): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactgggtgaggccttcacagaccctgtccctcatctgcagtgtctcgtggtgctctnagcagtgtattcacgtggantggatccgcncgccggcgggaaggctggagtggagttggcttatacgaagtcgacgaggggtcggggaccaaccgagaccgtaaccctaaccccccccgtacccgtacgaaacggaccggcccggaccgttaccacccgtactttaaccgaacggttaaaccgaccgtaacccgtaccgaaaacggtaacccaagtcccttacccgtaccgtacgtaaacgtcctaggtacgtttacgtacggtaccggaccccgacccggacaaaccgggaacccgaccgggtacgttacggttaacgttaccgtggcggaccgtacggacggtaggggtcgtacccggtcggtacgggggaacccgaaacggggtacccaacgggtccctaacccgttcccgtaccaaccggtacccgtacccgtaaaccccggaacccggtaaaccgggtccccctacgtttaccccccggg

SEQ ID NO: 426826 - DNA, 624 bp, Homo sapiens
  misc_feature: GZ8MTXP02HIEDG.13.39.D06.1.454.CMB.2.raw
  modified_base (211)..(211): a, c, t, g, unknown or other
  modified_base (236)..(236): a, c, t, g, unknown or other
  modified_base (255)..(255): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactgggtgaggccttcacagaccctgtccctnatctgcagtgtctctggtgctcctnagcagtgtattcactggantggactccggcacggcccgcgggaggacgtggagtggagtggcttatcaagtgaccgagggtcggggcaaccgagcctaaccaaccccccctccctacgaacgacgccgcgtaccacctacgtttacagtacgaccaccgtaaccaaacgaacctagcccttaccgtcccgtagaaccgtcgtgacgttcgtacgcgacccgccgacgacgaccgtacgcgtagttactacgtgtcgcgacgtacggtaggtacggacggttccggacgggggcccgaaaacggggtcccgtacggtacccgtacccggttcctcccgtaacgaaccgtcccaccgaacccggtaaccgggccctaacggttcccccgg

SEQ ID NO: 426827 - DNA, 832 bp, Homo sapiens
  misc_feature: GZ8MTXP02IHBT2.13.39.D06.1.454.CMB.2.raw
  modified_base (210)..(210): a, c, t, g, unknown or other
  modified_base (224)..(224): a, c, t, g, unknown or other
  modified_base (235)..(235): a, c, t, g, unknown or other
  modified_base (257)..(257): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctnatctgcagtgtctntggtgctcttnagcagtgtagttctacgtgganctggatccggcacggccccggacgggaagggacgtggaggtgggagtttggtcttaatcaagtcggacccgagggtcgggggaccaaccgacggtacctaacccgaacccccccccttacccgaccgaaaacgccgacccccggtaccggttacccacccgttacttttaccgaaacggttaccgaacccgtaacccggtaacccaaaaacgtaaacccgaacgtcccttaccctacccccgtaaggaaaccgtcgttacggtaacgttccggttacggtaccggaaccccggtcccgaccgaaaggaccccgtacccggggtaccgtttacgggttaaactttaccggtcggttacggccggaaaccgggtacgtaaacgggggttcggggaacccgggtttaccgggtaccggggggaaacccccggtaaacggggtaaacccccggtaaaccggggttcccccgtaaaccccgggtttccccttaccccgttaaccgaaaccccgggtacccccttaaccccgaaaccccgggaaaaccgggtccccccgtaacggttttacccccccgggg

SEQ ID NO: 426828 - DNA, 622 bp, Homo sapiens
  misc_feature: GZ8MTXP02IBSYM.13.39.D06.1.454.CMB.2.raw
  modified_base (240)..(240): a, c, t, g, unknown or other
  modified_base (551)..(551): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactgggtgaggccttcacacgaccctgtccctcatctgcagtgtctcgtggtgcttccttnagctagtggttagtttctacgtggagcgtggactccggcacggcccggacgggaaggacgtgggagtgggtagttgggacttagtcgtaagtcgaccgagggtcggggcaaccgacgacctaccaccccccctcctacgaacgacgcccgtcgtaccacctctttacagtaacgaccgactacaaaacgacctagcccttacctccgtagaacgtctagtacgttcgtgcgaccgcgacagaccgacggtctagtactacgtgcgcgacgagaggtcggtacgtcggtacggggaccaacggggtaacccncgggttcccaccggttctacccgtaacgaccgacctaccccgacgaaccggggtccctacggttcccccgg

SEQ ID NO: 426829 - DNA, 650 bp, Homo sapiens
  misc_feature: GZ8MTXP02J06EY.13.39.D06.1.454.CMB.2.raw
  modified_base (210)..(210): a, c, t, g, unknown or other
  modified_base (526)..(526): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctnatctgcagtgtctctggtgctctcagctagtggtacgttctacgtggagctggactccggcacggccccggaccggggaagggcgtgggaggtgggtagttggggtacttatacgaagtcggaccgtagggtcgggggaccaccgacgtcctaaccaacccccccctcctacgaacgacgccgcgtacaccgtattacagtacgacaccgtaccaaacgaacccagtccctaccctcccgtaggaactcgtacggtacgtttcgtacgggtccgacccggcccgaacaggaacccgcggccgttagttacttacgnggtacgcgacgacggtagggtcggtacgtcggacggggaccgaaacggggaccccacgggtccaacccggttcctacccgtcgaccgtccccaccgaacccggacgggcccctacgttccccgg

SEQ ID NO: 426830 - DNA, 663 bp, Homo sapiens
  misc_feature: GZ8MTXP02H4PP4.13.39.D06.1.454.CMB.2.raw
  modified_base (283)..(283): a, c, t, g, unknown or other
tcagtcacgtactacacgaccggtgctcgatttagtgacatctcgcagttctttggggagctctgggagtggagccccagccttgggattcccaagtgtttgttttccgtgatcaggactgaacacacaggactcaccatggagttggggctgagctggattttccttcttgctatgttagaaggtgtccagtgtgaggtgcaccgtggtggagtcgtgggggagcgttggtacagccgtgggggtccctgagactctcctgtgcagcctcgtggtcaccgtnacgtcaccactacatgagcgtcgggtccgccgaggccgtaccggaagggggaacggggcgttaggggaggttcgccggttctttacgtttttaagtttaagtaaggttaggttaggttagtaactacttaccgtccgcacggtacctccggtagggacgggggacctagtttacccacctactacctaccgacgaacgaactaacttaaccgaaacgaaacgaaccgtacttacgtttactttaactaaatagaaacacgaccgtagagacgaccgagtacgaacgaccggtaccgtagttacgttacgtgtacgacggagacccccgagtaccggaccgaacgtaacgtaacgtacgtacgtacgtacggacgtaccgg

SEQ ID NO: 426831 - DNA, 614 bp, Homo sapiens
  misc_feature: GZ8MTXP02JXZSH.13.39.D06.1.454.CMB.2.raw
  modified_base (203)..(203): a, c, t, g, unknown or other
  modified_base (232)..(232): a, c, t, g, unknown or other
  modified_base (257)..(257): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctctggacngtcgatcatcgtctcctgcactggaaccngcatgtagtggtggtagttaatatntctctcgtagtacacaacaccaccgacgaccaaccacccaactcatactattatagtagtatattacgcccgtctagtagttactactactcttcttctcgtcgtactacgtacgtcgtacgaccaccgtcccgtccctccgacgtaccctctccgtcgtcgtccgaccgtacgtacgaggaacggtacgtagtgttagttaattacgtacgtcgacactactaactaactaaccgtaaacccaacctaactaaacccgaaaccgtaacgtaccgtaacggttaaccggttaacgggtaaacggtaaccggtaaaaccgtaaccgtaacccgtacccggtaaccggtaccgtaaccg

SEQ ID NO: 426832 - DNA, 758 bp, Homo sapiens
  misc_feature: GZ8MTXP02G21IT.13.39.D06.1.454.CMB.2.raw
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctctcagcagtgtattctatggagctggatccggcacggccccggacgggaaggacgtggagtggtagttggggacttagtcaagtcgccgtaggtcggggaccaccgacgaccgttaaccaaaccccccccttcccgacgaaacggaccgcccgaccgtccacccgttactttaccgaacggttacgaacccgtaaccgttaacccaaaacggaaacccctaacggtcccttacccgttaccccgttaaggaaaccgtcttaacggtcgtttacgtacggtaccgaccccggtaccgacgacggaacccgaccgggtacccgttagttaaacgttccgtggtcggaccggaccggtacgtacgggggtcgtaacggttccgggacgggggaaccccgtaaaccgggggaaacccgtacccgggtaccggtaaccccggttccttacccccgttaaggaaacccccggtcccttaacccccggaaacccgggtaaaaccggggtcccccttaacgggtttccccccggg

SEQ ID NO: 426833 - DNA, 946 bp, Homo sapiens
  misc_feature: GZ8MTXP02IOJZH.13.39.D06.1.454.CMB.2.raw
tcagtcacgtactacacgaccggtgctcgatttagtgacatctcgcagttctttggggagctctgggagtggagccccagccttgggattcccaagtgtttgttttccgtgatcaggactgaacacacaggactcaccatggagttgggctgagctggtattttccttcttgctatgttagaaggtgtcagtgtgagtgcacgtggtggagtcgtgggggagtcgttggtacaggtccggttgggggtccctggagtactctcctgtgcagcctcgtggacttccgtaccttcacgtaccctacgacatcgcctacgtcgggtcccgaccctaaaccgtacgtaaaggaaaacggtccggaggtcgggtacctacggaggggtacgtttgggacgtaggttcgggtttagggtacgtaacgtaacgttactttacgttaacgtttccgaacggttaaccgttacccggggtaaggtaaaccgggggtaccccttaacgtttaaccccgaaacccttaacgttaccccgttaaacccgaaaaggtaaaaacggtaaaaaaccgttcccggaaaaccccctaaaaacccgttaaacccccgtttaccccccgtttaacccgtaaaaccttttaacccgtttaaaacccaaaaaagtttaaccccggtaaaaaccgaaccgggtaaccccgttaaaggggtaaaaccggaaccgggggtaaacccgggggaaacccgtacggggttacccgtttaaggggtttaactttaaaaccgtttacggtttaccgggaaaggttaaaccggaaaagggggttaccggggttaaacttttaaaaccggtttttaacctttaaaaccgttaacccggtttaaccgtttaacccgggtaacgggttaccgggttaaaccgggggaaaaccgttaaaacccgggggttaaaccccccg

SEQ ID NO: 426834 - DNA, 600 bp, Homo sapiens
  misc_feature: GZ8MTXP02GXJBU.13.39.D06.1.454.CMB.2.raw
  modified_base (233)..(233): a, c, t, g, unknown or other
  modified_base (322)..(322): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccngcactgatgttggtgttatactatgtctctgatacaacacaccagacaaacgaccccaaatcatctaattatagaaagtctaatttacncccggtcctacgaggtactttactaatcgtcttctcgtcggcctacaagtctcggaccaaacacccggtccctaccgtacgaccctacttccgtcgtcgggtcctaccgaggtacctaggaaacgacggtaggtacttaggtaattaacttacgtacgactagtccttactaataaactaaaccaaacctactaaccaaaccaacaaccgttacggttcgttaacgggaaacgtacgggaaacctaaacgtacctaacccggtaccgtaacgtacccg

SEQ ID NO: 426835 - DNA, 651 bp, Homo sapiens
  misc_feature: GZ8MTXP02JGU06.13.39.D06.1.454.CMB.2.raw
  modified_base (210)..(210): a, c, t, g, unknown or other
  modified_base (236)..(236): a, c, t, g, unknown or other
  modified_base (258)..(258): a, c, t, g, unknown or other
  modified_base (416)..(416): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctnatctgcagtgtctctggtgctccttnagcagtgtagtttctactgganctggactccggcacgccccggacgggaaggcgtgggagtggagtttgggctttatcaagtcgccgaggtcggggccaaccgagcctaaccgaaccccccctccctacgaacgacgccgacgtccactatttacagtacgacacgtaccaaagaacccngtccctcctaccctagaaacgtctacgtacgtttccgtaggtaccgacccgccgacaacggacccgtaccgggtccttagttaacttccgttcggcgccggacggtaacggtacgggtacgggaccgtacgggtacgggggacccgaaacggggtacccacgggttacccacccggtcctaccgtccgaccgtcccgtacccgaacccggaacggtcccctacggtttcccccgg

SEQ ID NO: 426836 - DNA, 912 bp, Homo sapiens
  misc_feature: GZ8MTXP02IRO9Z.13.39.D06.1.454.CMB.2.raw
  modified_base (193)..(193): a, c, t, g, unknown or other
  modified_base (234)..(234): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggccaggactggtgaggccttnacagaccctgtccctcatctgcagtgtctctggtgctcctnagctagttggtagtttctacgtggagctggactccggcacggccccggccgggggtaagggacgtgggaggtgggtagtttcggggtacttaatcgtaaagtcggtacccggtaggggttcgggggaccctacccgacggtaccccgttaaaccctaaaccccccccccgtttcccccgtaaccgtaaacggaacccggcccccggtaccccgttacccctaacccgttacgtttttacccaaacgggtttaaccgaacccgtaacccgttaaacccgaaaacggtaaccccacggtacccttaccctaccccggtagtaaaccgtcgttcgtaacggtttccgttacggtaccggaccccggacccggtaaccgaaccggggaacccgtacccgggggtacccccggttttaaggttaaacccgttttaccgggtttccgggtcggggtaccccggaaacccggggtaaaccggttggggggtaccggggttaacccgggtttcccgggggtaccggggggtaacccgtaaaaacccgggggggacccccttaaaccgggggttccccgtaaacccccggttccgtttacccctaacccgggaacccggttccccctaaaccccgggaaacccccggtaaacccgggggtccccctaaaccggttttccccccgggg

SEQ ID NO: 426837 - DNA, 671 bp, Homo sapiens
  misc_feature: GZ8MTXP02HX6UM.13.39.D06.1.454.CMB.2.raw
  modified_base (208)..(208): a, c, t, g, unknown or other
  modified_base (233)..(233): a, c, t, g, unknown or other
  modified_base (498)..(498): a, c, t, g, unknown or other
  modified_base (614)..(614): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcggccaggactggtgaggccttcacagaccctgtccctnatctgcagtgtctctggtgctcttnagctaggtggttagtttctacgtggagctggactccggacgacggccccggaccggggaaggacgtgggaggtggtagtgggtacttagtactaagtcgaccgagggtcggggaccacgacgacctaccgaaccccccctccgtacgagacgccgtaccgctaccgtatttacgaagttaaccgaaccgtaccgtaccgaaaacgaaccctagtcccttccttaccgacgtaagtctagtacgtttcgacgacgacccgcgaacncgaaccggtcggtccttaggtaactttcgcgttcggacgcgaacggttagggcggtccggttacgggccgggggaaaccgaaccgggtaacccgtcggtaccccgaaccggttccncccgttaacgccccgtacctacccggaaccgaaccgggtacccttacgttcccccgg

SEQ ID NO: 426838 - DNA, 587 bp, Homo sapiens
  misc_feature: GZ8MTXP02HILXA.13.39.D06.1.454.CMB.2.raw
  modified_base (236)..(236): a, c, t, g, unknown or other
  modified_base (311)..(311): a, c, t, g, unknown or other
  modified_base (518)..(518): a, c, t, g, unknown or other
  modified_base (552)..(552): a, c, t, g, unknown or other
  modified_base (562)..(562): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttnagcagtgtagttctactggagctgatccggcacgccccggaccgggaaggacctgggagtgggagttgggcttancaatgccaggtggggcacgagctaccacccccctccctacaacgacgccgcgtcaccgtatttcagtacgaccacgtaccaaacgaaccagcctctccccgtagaaacgtctacgtacgtttacgtcgtacgaacccgccgaccgagaacccgtacggcccgttaggtaacttaccgtgtcgcgcgacgagggtacggacgttcggnggggaccaacgggaccgacggtcaccgtctaccncgcgtacccnccgaaccgacggccctacgtcccgg

SEQ ID NO: 426839 - DNA, 696 bp, Homo sapiens
  misc_feature: GZ8MTXP02GM8NY.13.39.D06.1.454.CMB.2.raw
  modified_base (205)..(205): a, c, t, g, unknown or other
  modified_base (236)..(236): a, c, t, g, unknown or other
  modified_base (260)..(260): a, c, t, g, unknown or other
tcagtcacgtactacacgaccggtgctcgatttagtgacatctcgcagttctttgggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacngtcgatcatcgtctcctgcacgtcggaaccngcactgatgttgtggttataactntgtctactggtatacaacaaccaccgaggacaaaccgacccccaaactcatacgtatttagtagtaagtactatttaacgtcccggtaccccctgacgggttaacttttactaaattccgtctttccgtacgtcgggtcctaccgtaacgtcgtacgaccgaaaccgacccggtccctaccctacggaccctacgttccttcggttcggccgtaccgtacgggtacgttaaggaaacggtacggacggtcgttaaggttaactttaactaccgttggaccaggtacctacctaaattaaactaaacccaaaaccattaaccctaaaaccggacctaacgttaaccggttacgttaaacccgggtaacggggtttaaccggaaacccggttaaaacgtaccccggtacccggttaacccgtaggggttaaacccccg

SEQ ID NO: 426840 - DNA, 730 bp, Homo sapiens
  misc_feature: GZ8MTXP02HI68M.13.39.D06.1.454.CMB.2.raw
  modified_base (485)..(485): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacacgaccctgtccctcatctgcagtcgtctcgtggtggcttccttcagcgtagtggttagtttctacgtggagctggactccggcacggcccggcggggaaggacgtgggagtgggtacgtttggggactttagtctaagtcggacccgaaggggttcgggggaccctaaccgacggaccttaaaccccgaaccccccccgtcccccgtaacgaacggacggcccccgtacggttacccaccgttactttacgacggtaacgaaccgtacgtaaaccaaacggaaacccncgtacctacctccccgtagaacgtcgtacgtacgttctgtaccgcccggacccacggagaccggacggtccgtttagtaaccttagttcggacggccgccggtaagacggggtacgaccgggttcggtacgggggacccgtaaaacggggaccttaaccggccggtacccttcggttccccgtaaacgccggtaccccgttacccgaaacccggtaacccggggccttaaccgtttcccccgggg

SEQ ID NO: 426841 - DNA, 623 bp, Homo sapiens
  misc_feature: GZ8MTXP02HVLB6.13.39.D06.1.454.CMB.2.raw
  modified_base (231)..(231): a, c, t, g, unknown or other
  modified_base (331)..(331): a, c, t, g, unknown or other
  modified_base (431)..(431): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctcgcctcgtgtcgtggtctccgtgacagtcgatcaccatcctctgcaacgtaggaaangcagtgtagtcgttggggaacttgcgtaccttgtacctcgtacggtacccgaacaacccaccgaggacaaaccgaccccaattctagtaacgttacgganaaacgtaacgccggccctgacggttctttacgagtactcgcctttcgcgtggtacctacacggtcgtgaactaaccgccgtccctacctacgactaactntccgaacgtccgacgcgaccggaagacgtagtcttagtttattcgtagttcgtataagtcgagacgggtaggacgtagtcgtaattcgtagttgttaggagttacggaacgtacgcgtaaccggttcgtacgaccacggacccgaaccgaccccgttaacgacttaccgtaacttacccgtcgttacccccg

SEQ ID NO: 426842 - DNA, 733 bp, Homo sapiens
  misc_feature: GZ8MTXP02J0YH8.13.39.D06.1.454.CMB.2.raw
  modified_base (546)..(546): a, c, t, g, unknown or other
tcagtcacgtactacacgaccggtgctcgatttagtgacatctcgcagttctttggggagctctgggagtggagccccagccttgggattcccaagtgtttgtttccgtgatcaggactgaacacacaggactcaccatggagttggggctgagctggattttccttcttgctatgttagaaggtgtccagtgtgaggtgcacctggtggagtcgtgggggaggcgttggtacaggccgtggggggtccctgacgactctcctgtgcagcctctggattccaccttcacgtacctacgacatcgctacggtcggtcccaccctaaccgtacgtaaggaaaacgggtccggaggttacgggtctcggagggtacgttgggacgtaggttggttaggtgaactactattcttaattccgagtaccgtccggtaggaacgggcctaattcccaaccctatcctacccgaaaggaaacaaaacgtcgaaccctaaacctaacccgttcccttaccaactttaccttaaacctaaaagttccggaaaaccncggtaccgtaaggaacggaacggggtaccgggaacgtacgggttacgttacggttacgttaacgttacgtagggtacggaaacggtaaacggggtacggttaaactttaacgtttacgtttaacgttaaccgtttaaccgttacggtacggttacgggtaacggggtaaaccggaaaccggtacccg

SEQ ID NO: 426843 - DNA, 684 bp, Homo sapiens
  misc_feature: GZ8MTXP02JMO14.13.39.D06.1.454.CMB.2.raw
  modified_base (235)..(235): a, c, t, g, unknown or other
  modified_base (321)..(321): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcacccctgtcactcagggcacagggtcctgggcccagtctgccctgactcagcctgcctccgtgtctggcctctcctggacagtcgatcatccgtctcctgcactggaaccngcactgatgttggtagttataactatcgtctctggtatacaacaaccaccaaggaccaaacgacccccaaactcattctagtttanagtaatctattactcccgcctagaggttacttacgtatctcttccgtctacggtctacgtacgtcgtacgacaaccgtaccggtccctaccgtactaccctacgtccgtcgtccgggtcctaccgtaacggtcgaacggaacggtacggtaccgtagttaccggttaatttacgttaacgttcggaccgtaacgttcctactaaaacttaaccgttaaaacccaaaaccttcggaaaaccttaacccggtaaaccaacggttaaccttaaccggggtaaacgtttaaccgggggaaaaaccgtccccggggttaaaacctaaaaccgggtttccccgaaaacgggtttacccgaaaaccccgg

SEQ ID NO: 426844 - DNA, 775 bp, Homo sapiens
  misc_feature: GZ8MTXP02FQNRI.13.39.D06.1.454.CMB.2.raw
  modified_base (220)..(220): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtntctcgtggtgctccttcagctagttggtagtttctacgtggagtcgtaggacgtccggcgaccggccccggaccggggaagggacgtgggaggtgggtagtttggggctttatacgtaagtcggcccgaggggtcgggggaccaaccgacggtaccctaaccccgtaaccccccccccttaccccgtaccaaacggtaccggccccggtacccgttacccgtacccgttaacgtttaccgaaacggttaaccgaaacccgtaaccggtaaacccgaaaaccggtaaaaccccgacggtaacccttcccttacccccgttaggaaaaccgtcttacgggttaacgtttccgtaggtaccggaaccccggtcccgacgaaccggacccgaccgggtcccgttagttaacttaccgtggtacgccggacgaaccggtagggtcggtaaccggtcggtacggggaccgaaacggggaccctacgggtaccaacccgttcgtacccgtaacgaccgaccccgtacccgaaccggtaaacccggccctacgtttcccccgg

SEQ ID NO: 426845 - DNA, 680 bp, Homo sapiens
  misc_feature: GZ8MTXP02HAMB6.13.39.D06.1.454.CMB.2.raw
  modified_base (201)..(201): a, c, t, g, unknown or other
  modified_base (231)..(231): a, c, t, g, unknown or other
  modified_base (237)..(238): a, c, t, g, unknown or other
  modified_base (250)..(250): a, c, t, g, unknown or other
tcagtcacgtactacacgaccggtgctcgatttagtgacatctcgcagttctttggggggggtcacaagaggcagcgctctcgggacgtctccaccatggcctgggctctgctgctcctcactctcctcactcaggacacgagggtcctgggcccagtctgccctgactcagcctgcctcgtgtcgtggtctccgtggacngtcgatcaccatcctctgcacgtaggaacngcagtnntcgttggacttntcgtacttgtctcgtacgtaccgaacaacacccaggaaccaaaccgacccccaaatactaagtttacgttaaccgggacaaagtacggccgtaccctcggacggttctttcgtagtacttccgtcccttcgtacgtcggtacccttaccgtaaacgttcgtacggaccctaaccgaccggtccctaccgtagactaactctcgtacgtccacgacggcgtaggaccgagtcgttagttacttttcgtatttgttactagttatgacgtaagggaaggtgtaaagttagtttagttggtttacgttaagggaaccggttacggaaccggttacggttacccgtaccggtttaccgtacggttacccgaacggtacccccgaacggaacccctaacccggtctaaccgtccctaccgtttccgtaacccccg

SEQ ID NO: 426846 - DNA, 573 bp, Homo sapiens
  misc_feature: GZ8MTXP02ID4QA.13.39.D06.1.454.CMB.2.raw
  modified_base (198)..(198): a, c, t, g, unknown or other
  modified_base (242)..(242): a, c, t, g, unknown or other
  modified_base (247)..(247): a, c, t, g, unknown or other
  modified_base (253)..(253): a, c, t, g, unknown or other
  modified_base (282)..(282): a, c, t, g, unknown or other
  modified_base (300)..(300): a, c, t, g, unknown or other
  modified_base (305)..(305): a, c, t, g, unknown or other
  modified_base (310)..(310): a, c, t, g, unknown or other
  modified_base (320)..(320): a, c, t, g, unknown or other
  modified_base (388)..(388): a, c, t, g, unknown or other
  modified_base (396)..(396): a, c, t, g, unknown or other
  modified_base (458)..(458): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctcgtgtctggctctccnggacagtcgatcatcgtctcctgcatggaaccagcatgatgtgngttanactatnctctgtatacaacaacaccgagacaaacnccccaaatcatcatttanagatnattancccgcctagnggtatttcgtaatcgcttctactgtacctacctaagtctacggaccaaacgaccggtccctacccgtnaaaccctnttcctcgtcggcctcgagcgtagaagacgtaaggctagtatttatacgttcgacgatcttanaacgttaataaccaaccgtataacaaaacctacggacgtacggttaccttaacgggggaaaagttcggggaaaacctaaaacggtccttaacccggtaccgtttaacgggaaccc

SEQ ID NO: 426847 - DNA, 670 bp, Homo sapiens
  misc_feature: GZ8MTXP02IFOJR.13.39.D06.1.454.CMB.2.raw
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctcgtggtgctccttcagctagttggtagtttctacgtggagcgtggactccggcacggccccggacggggaagggacgtgggagtgggtagttggggcttaagtcaagtcggaccgtggtcggggaccaccgacgacctaaccaacccccccctccctacgaacgacgcccgcgtaccaccgtactttacgaagttaacgacctaacgtaccaaaacgaacccgagtcccttcctacccgtagaaacgtctcgtacgtttcgtgtccgacccgaccgacgacgacccgaccggtcccgttagttacgttacgtcgtacggccggacggaacgtggggtcggacggttcgggacgggggaccgtaaacggggacccgtaacgggtcctacccgtcctcccgtcgaccgtcccctaccgaacccggtaacggcccctacgtttcccccgg

SEQ ID NO: 426848 - DNA, 775 bp, Homo sapiens
  misc_feature: GZ8MTXP02IB3UQ.13.39.D06.1.454.CMB.2.raw
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactgggtgaggccttcacacgacccctgtccctcatctgcagtgtctcgtggtgctccttcagcaggttggttagtttctacgtggagtcgtggactccggcacggccccggacggggaagggacgtgggaggtgggtagttcggggtacttaagcgtaaagtcggaccgtaaggggtcgggggaccaacccgacggaccctaaaccccgtaacccccccccctccccgtaaccgaaacggaccggccccggtaccggttaccctacccgttacgttttaccgaacggttaacgaacccgtaacccggtaacccaaaacgggaaacccctacggacccttcccgttaccccgtaggtaaaccgtcgttacggtacgtttccgtcggttaccggaccccgacccggacgaacggaaccgtaaccggggtccgttaggttaactttaccgtggttacggaccggtacggaacggtcgggggtacggaaccggttcggggtaccgggggaccgaaacgggacccgtaacggtcccgtaccggttccctccgtcgaccgtaccctacccgaaccggtaccgggtccctacggttccccgg

SEQ ID NO: 426849 - DNA, 675 bp, Homo sapiens
  misc_feature: GZ8MTXP02G55UB.13.39.D06.1.454.CMB.2.raw
  modified_base (360)..(360): a, c, t, g, unknown or other
tcagtcacgtactacacgaccggtgctcgatttagtgacatctcgcagttctttggggagctctgggagtggagccccagccttgggattcccaagtgtttgttttccgtgatcaggactgaacacacaggactcaccatggagttggggctgagctggattttccttcttgctatgttagaaggtgtccagtgtgaggtgcacctggtggagtcgtgggggaggcttggtacagccgtggggggtccctgagactctctgtgcagcctctggattcaccttcacgtaccctacgacatcgcacgtgggtcccaccaacctcgtaaggaaaacggtccgggaggtcgggtctggagggtnttgggctagtcggttggtgactactattactagttcagtaccgtccgtaggaacggggcccgtattcccgaacctactcctacccgaagaaacgaaaactcggaacccctaaactaaccttcccctttaccaacttaccttacaaaagttcgaaacacgtccgtagaacggacggacggggaaccacgggtctaggtagttaacttacggtgtacgacgaaagggacgggtactttaaagtttccttaacgtttaaccgttacgtttaccggtaccggttacggtacggggtaaccgaaaccgggggtaaccccg

SEQ ID NO: 426850 - DNA, 727 bp, Homo sapiens
  misc_feature: GZ8MTXP02GZ7Q7.13.39.D06.1.454.CMB.2.raw
  modified_base (211)..(211): a, c, t, g, unknown or other
  modified_base (222)..(222): a, c, t, g, unknown or other
  modified_base (240)..(240): a, c, t, g, unknown or other
  modified_base (300)..(300): a, c, t, g, unknown or other
  modified_base (454)..(454): a, c, t, g, unknown or other
tcagtcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgacggccttcacagaccctgtccctnatctgctagtntctcgtggtcgctccttnagcagtggtagtttctactggagcgtgacgtccggcacgcccggacgggaggcgtggagnggtagtggacttatgaagtcggaccgtagggcggggacctaaccgagtacctaccaaccccccccttccgagaaaccggacgcccgtccggtacctacccgtatttccggaaacgtaccggaccttaaccgggtacccaaaagtaaaaccccgngtcccttaccggtaccctaggaaaccttcgttaccgtaaggttccgttaaggtacccgccgaccgaccgttacggaacccgtcggggtaaccttgttaaaacgtttccgtcgacgggtccgtacggacggtacgggttaacggtaccccgggttgggtacggggaaaccgtaaacccggggcgtaaacccgggtaccgtcccggtaaccttccccggaacttaccggtacccccacggaaccccgacgggtaacccctaggtttccccccggg

SEQ ID NO: 426851 - DNA, 705 bp, Homo sapiens
  misc_feature: GZ8MTXP02F0G57.13.39.D06.1.454.CMB.2.raw
  modified_base (320)..(320): a, c, t, g, unknown or other
tcagtcacgtactacacgaccggtgctcgatttagtgacatctcgcagttctttgggggagctctgggagtggagccccagccttgggattcccaagtgtttgttttccgtgatcaggactgaacacacaggactcaccatggagttggggctgagctggtattttccttcttgctatgttagaaggtgtccagtgtgaggtgcacgtggtggagtcggtgggggagtcgttggtacgcggtcccggtggggggtccctggacgtaccttcctccgtggtcgcacgtccctgtggtacttcctacctttgattgtatttncgtccagtcgcgtacggtcgggtaccgcgaacgtccgtacggaagggtacgggcgtggggtaggtcggtctagtaggttagtttaggtaggaagttagtggacgtacgtagtaggctagtcggtacggtatcggtaggtagggaaccgggtcctacttacccgacctagtcccgtacgaaggaccgtaaccaacccgacgtaaaacggtccctaccgttagtctacggtaacaacgtaaaactcggaaactacgtaccgagtaggagtacggaacggacgtaccgtacggttacgtttaagttacgtttaggtaggtaacgtaaaaccgtaacgtaacccttaacccgttaaaccgtttacggtttaaggtttaggttaaccggg

SEQ ID NO: 426852 - DNA, 540 bp, Homo sapiens
  misc_feature: GZ8MTXP02JK2IM.13.39.D06.1.454.CMB.2.raw
  modified_base (226)..(226): a, c, t, g, unknown or other
  modified_base (237)..(237): a, c, t, g, unknown or other
  modified_base (243)..(243): a, c, t, g, unknown or other
  modified_base (256)..(256): a, c, t, g, unknown or other
  modified_base (258)..(258): a, c, t, g, unknown or other
  modified_base (306)..(306): a, c, t, g, unknown or other
  modified_base (313)..(313): a, c, t, g, unknown or other
  modified_base (393)..(393): a, c, t, g, unknown or other
  modified_base (402)..(402): a, c, t, g, unknown or other
  modified_base (418)..(418): a, c, t, g, unknown or other
  modified_base (449)..(449): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcgagggcacgagggtcctgggcccagtctgccctgacctcagcctgccctcgtgtctggctctccgtggaccagtcgatcatcgtctctncactcgaaccngcatgntgtgtgtatactntntctcgtgtacacaacacaccgagacaaacgccccaatcactctattanagtaatntacttacgccccgtcctagtaggttactttacaagtcgtcttctcgtcgactacgtagtctacggaccacgaccgtcccnctacacctntcctggtcgactcggngtacgagagacgatcgtattaagttctacgnactcactataactacaaaccgacacaacaacgtacgtacggtacgtacgtaacggaagtaccggaacgtacgtccgtaccgtacgacgacg

SEQ ID NO: 426853 - DNA, 822 bp, Homo sapiens
  misc_feature: GZ8MTXP02JFHAI.13.39.D06.1.454.CMB.2.raw
tcagtcacgtactacacgaccggtgctcgatttagtgacatctcgcagttctttggggactttctgagagtcctggacctcctgtgcaagaacatgaaacatctgtggttcttcctcctcctggtggcagctcccagatcgggtcctgtcccaggtgcagctgcaggagtccgggcccaggactggtgacggtccttcacacgaccctcgtccctcatctgctagtcgtctcgtggtgtccttccttacagtctaggtaggttacgtttctacgttggagtcgtaggtacgtccggcgaccggccccgggacggggaacgggtcgtagggaacgtgggtaacgttgggtacttagacgtaacgtcggaccggtaaggggtcggggaccaccgacgtacctaaacccccgtaccccccttacccacgaacgtaccggcccggtacccgtacctaccgttaacgtttaccgaagttaaacccgaaccttaaccgtaaacccgaaaccgaaacccgtcgtccctacccgttacccgtaggtaaacccgtctaacggttctttccggtacgtacccggacccgaccgttaccgaaccggtaccggtacccggtaccgttacggtttacgttaccgtcggtaccgcggtaacgtaacggtacgggtacggtacccggttacgggtaccgggggaacccgaaaccgggggtaccgaaacccgggtttcccgtaaaccccgttccgttacccggaacccgttaccggacccccgttaaacccggaccccggtttaaaaccggcccccgtttaaccggtttccccccggg

SEQ ID NO: 426854 - DNA, 731 bp, Homo sapiens
  misc_feature: GZ8MTXP02ITUJX.13.39.D06.1.454.CMB.2.raw
  modified_base (239)..(239): a, c, t, g, unknown or other
tcagtcacgtactacacgaccggtgctcgatttagtgacatctcgcagttctttggggacttttctgagagtcctggacctcctgtgcaagaacatgaaacatctgtggttcttcctcctcctggtggcagctcccagatgggtcctgtcccaggtgcagctgcaggagtcgggcccaggactgggtgaggccttcacagaccctgtccctcatctgcagtgtctcgtggtgctccttnagcagttggtagtttctacgtggagcgtggactccggcacgccccggacgggaaggacgtggaggtggtagttggtcttagtacgaagtcgtcgaggtcgggggccaaccgagacctaacccaacccccccttaccctacgaacgacgccgaccgtccacctattacaagtacgaaccgtacgtaaccgaaacgaaccacgccttaccctcccgtagaacgtctaggtaacgttctagtccgaaccgccgtaacgcgaacgaccgggtccgttagttaacgttacgtcggttacgcccggacggaacggtacggggtacggggtaaaccggttccggggtacgggggtaaaccccgggaaacgggggtaacccccgtaaacggggtcccccgtaaaccccgggttcccttacccccgtaacccggtaaccgacccccgttacccgaaaacccggtaaccccggtaccccgttaaccggtttacccccccggg

SEQ ID NO: 426855 - DNA, 652 bp, Homo sapiens
  misc_feature: GZ8MTXP02IVFF3.13.39.D06.1.454.CMB.2.raw
  modified_base (235)..(235): a, c, t, g, unknown or other
  modified_base (326)..(326): a, c, t, g, unknown or other
tcagtcacgtactacacgaccggtgctcgatttagtgacatctcgcagttctttggggtgctggggtctcaggaggcagcgctctcaggacatctccaccatggcctgggctctgctgctcctcaccctcctcactcagggcacgagggtcctgggccccagtctcgccctgacctcagcctgcctcgtgtctggctctcctggacagtcatcatccgtctctgcacgtagaccngcatgagttggttggtacgttatactatgtctcgtgtactacaacaactaccaggaccaaaccgacccccaaaatcaacttactaatttanagtaaacttctatttacgtccccgaccttagtaggtatttacctaagtctctttcgtctccggtcctactaacgtctaccggaccaaacgtcccggtcccttccacgtaccctacgttccttcggtacgggccctaccggagtacgttaggaaacgggtcgtacgggtactttagaatttttaacacgttcggaaaccttcgtactaacttaactaaactaaacccaactacgaaacctaaacgtaaccgtacgtaaccggttacggaacggtaacggtaaacggaaaccttaaaccggtacccgtaccgttaccggtacgaaccg

SEQ ID NO: 426856 - DNA, 693 bp, Homo sapiens
  misc_feature: GZ8MTXP02FM03U.13.39.D06.1.454.CMB.2.raw
  modified_base (299)..(299): a, c, t, g, unknown or other
tcagtcacgtactacacgaccggtgctcgatttagtgacatctcgcagttctttggggagctctgggagtggagccccagccttgggattcccaagtgtttgttttccgtgatcaggactgaacacacaggactcaccatggagttggggctgagctggattttccttcttgctatgttagaaggtgtccagtgtcgaggtgcaccgtggtggagtcgtgggggagcttggtacagccgtgggggtccctggagctctcctgtgcagccctctggacttcgacttcagtacctacgacngtgcacgtcggtccgccaactcaaggaaaacggtccggaagtgggtcacgagggtatggcagtgttggcgacagtcttacgtacgttcgacgtacgttccgtagaaacgggtccgtattacccgacctagtacccttaccgaagaaaggaaaacttcggaacccgaaaactaaacccggttccttaaaccctacgttacctttacgaaaactttacggaaacctaacggtcccgttaggaaggaaccgggccgggtaaacgcgggtaaccgttgtagtaaaccgtttctaggtcgtaaacggtaacgggaaacggggttctaaaaccgttttgttaacttaaacgttaccgtcgttaacggtacgtcgggggtaaacccaacgggttaaccccg

SEQ ID NO: 426857 - DNA, 529 bp, Homo sapiens
  misc_feature: GZ8MTXP01DSV8F.21.76.G10.1.454.CMB.2.raw
  modified_base (484)..(484): a, c, t, g, unknown or other
  modified_base (491)..(491): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctgggggtccctgagactctcctgtgcggtctctgggttcaccgtcactacaactccatgagctgggtccgcaggctccagggaagggggctggagtgggtctcagttatttatagtggtggtggtgcagatacgcaagactcgtgaagggccgattcacatctccagagacaattccatgacacgctgatcttacaaatagaacagcctgagacgcgacgacacgccgtctactatgtgcgacgggaggtgagggacgggngggacgngtggtaagtaacgtttgaccgaacgttcgggggaacgg

SEQ ID NO: 426858 - DNA, 537 bp, Homo sapiens
  misc_feature: GZ8MTXP01DVXV9.21.76.G10.1.454.CMB.2.raw
  modified_base (389)..(389): a, c, t, g, unknown or other
  modified_base (418)..(418): a, c, t, g, unknown or other
  modified_base (494)..(494): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggttcacgtcactactaactcatgagctgggtccgcaggctccgagggaggggctggagtgggtctcagttatttatagtggtggtggtgcagattacgcaagactcgtgaagggccatcacatctcaganacaattccatagaacacgctgtatcttanaaactggaaacagcctagagacgccgaacgacacggtccgtctattactgtgcggacggggagtggacggggaggnggggacaagtggaattacgttgacccgtaagttgggggaaccg

SEQ ID NO: 426859 - DNA, 534 bp, Homo sapiens
  misc_feature: GZ8MTXP01DXYRW.21.76.G10.1.454.CMB.2.raw
  modified_base (293)..(293): a, c, t, g, unknown or other
  modified_base (461)..(461): a, c, t, g, unknown or other
  modified_base (468)..(468): a, c, t, g, unknown or other
  modified_base (479)..(479): a, c, t, g, unknown or other
  modified_base (493)..(493): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggttcaccgtcactacaactcatgagctgggtccncaggctccgagggaggggctggagtgggtctcgtagtttatttatagtggtggtggtgcagattacgcaagactcgtgagggccatcacatctcagagacattccatagaacacgctgtatcttacaaattggaaactagcctgacgacgccgacgacacggtccgtntattacngtgcgacgggngtggacggggaggngggcaagtgggaatacgttgacctaacggttgggggaaccg

SEQ ID NO: 426860 - DNA, 561 bp, Homo sapiens
  misc_feature: GZ8MTXP01D2KX1.21.76.G10.1.454.CMB.2.raw
  modified_base (482)..(482): a, c, t, g, unknown or other
  modified_base (510)..(510): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagactggaggagacttgatccaaccgtgggggtccctgagactctcctgtgcggtctcgtgggttcaccgtcactacaactccatgagctgggtccgcaggctccgagggaaggggctggagtgggtctcgagtttatttataggtggtggtggtgcagattacgcaagactccggtgaaagggcccgattccgacatctccagagacaattccatacgaacacgctagtatcttacaaatgaacagcctagagacgccgacgaccacggtccgtctattcgngtgcggacgggagtggaacggggagggnggacgaagtgggtaacttacgtttacggaccgtaacggttgggggaacccg

SEQ ID NO: 426861 - DNA, 549 bp, Homo sapiens
  misc_feature: GZ8MTXP01EIJWA.21.76.G10.1.454.CMB.2.raw
  modified_base (438)..(438): a, c, t, g, unknown or other
  modified_base (508)..(508): a, c, t, g, unknown or other
tcagtcgtcgctcgcacgaccggtgctcgatttagtcactcatacaggggctgggagaggagcccagcactgggattccgaagtgtttccattcggtgatcagcactgaacacagaggactcaccatggagttttggctgagctgggttttccttgttactatttcaaaaggtgtccagtgtgaggtgcagctggtggagactggaggagacttgatccgaaccgtggggggtccctgagactctcctgtgcggtctcgtgggttcaccgtcactacaactccatgagctgggtccgccaggctccgagggaggggctggagtgggtctctagttatttataggtggtggtggtgcagattacgcaagactccgtgaagggccgatcacatctcagagacattccatacgaacacgctagtatcttacaaatggaacngcctagagagcccgacgaccgacggtccgtactattactgtggcggacggggagtagggacggggagggngggctaagtgggaattcgttgaccgtcggttgggggaaccg

SEQ ID NO: 426862 - DNA, 491 bp, Homo sapiens
  misc_feature: GZ8MTXP01CYSLO.21.76.G10.1.454.CMB.2.raw
  modified_base (427)..(427): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttggccgggcgggtcaggacattagacattatagcctggtatcagcagaaacaggtaaagtcccaagctcctgatctatgctgcatcctctttgccaatcaggggtcccatctcgttcagtgcagtggatcgtgggacagattcactctcacatcagcagcctgctaggcctgaacgatgtgactaatttatactagtacaaaatataagcagtacnccctctcttacgtttcggacgtcgaagggaacccaagggtcggaactaacgttaacgaaaaccg

SEQ ID NO: 426863 - DNA, 523 bp, Homo sapiens
  misc_feature: GZ8MTXP01BEO0C.21.76.G10.1.454.CMB.2.raw
  modified_base (294)..(294): a, c, t, g, unknown or other
  modified_base (369)..(369): a, c, t, g, unknown or other
  modified_base (388)..(388): a, c, t, g, unknown or other
  modified_base (407)..(407): a, c, t, g, unknown or other
  modified_base (427)..(427): a, c, t, g, unknown or other
  modified_base (435)..(435): a, c, t, g, unknown or other
  modified_base (444)..(444): a, c, t, g, unknown or other
  modified_base (452)..(452): a, c, t, g, unknown or other
  modified_base (459)..(459): a, c, t, g, unknown or other
  modified_base (484)..(484): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtgggttcaccgtcactacaactcatgagcgtggtccncaggctccgagggagggctggagtgggtctcgagtttattagtagtggtggtggtgcagattacgcaagactcgngaacgggccgatcacatcncagagacatccatagaacncgctgatctacaaatgaacngcctgagngccgagacncggtcctntacttcngtgcggacgggagtggacgggaggngggcaagtggaattcgttgaccgtcggttgggggaaccg

SEQ ID NO: 426864 - DNA, 556 bp, Homo sapiens
  misc_feature: GZ8MTXP01EYVUW.21.76.G10.1.454.CMB.2.raw
  modified_base (494)..(494): a, c, t, g, unknown or other
  modified_base (511)..(511): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctctgggttcaccgtcactacaactccatgagctgggtccgccaggctccgaggggaaggggctggagtgggtctcagtttatttatagtggtggtggtgcagattacgcaagactccgtgaagggccgattcacatctccagagacaattccatagaacacgctgtatcttacaaatgggaacagcctagagacgccgacgacgccggtccgtactacttacgtggtcgcgggacgggnggtggaacggggagggngggcgaagtggtaacttacgttcggaccgtcggttgggggaaccg

SEQ ID NO: 426865 - DNA, 558 bp, Homo sapiens
  misc_feature: GZ8MTXP01BVGFP.21.76.G10.1.454.CMB.2.raw
  modified_base (294)..(294): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtgggttcaccgtcactacaactccatgagctggtccncaggctcgagggagggctggagtgggtctcagtttatttagtagtggtggtggtgcagattacgcaagactcggtagaagggcccgattcacatctcagagacattccatacgaacacgctagtactcttacaaattggaaacacgcctaggaacgacgcccggaacgaaccgaccggtccgttactattacgtggtcgcgggacggggagtggacggggaggcgggcaagtggaattacgttggacctcggttgggggaaccg

SEQ ID NO: 426866 - DNA, 629 bp, Homo sapiens
  misc_feature: GZ8MTXP01D3RAF.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtgggttcaccgtcactactaactccatgagctgggtccgcaggctccgagggaggggctggagtgggtctcgtagttattagtagtggtggtggtgcagattacgcaagactccggtgaaacggggccattccacatctacagacgacaattccatagaacacgctgtactcttacaaatggaaacagccctaggaacgacgcccgaacgaaccgaccgggtcccgttacttaacgttaaccgtggttcgggaccgggaacgggggttaggttacggggaaccgggggaaggggacggggacgtaagggttacggggtaatttaacccggtttaggaaccccggttaacgggttcggggggggtaaccccgg

SEQ ID NO: 426867 - DNA, 642 bp, Homo sapiens
  misc_feature: GZ8MTXP01BT4JB.21.76.G10.1.454.CMB.2.raw
  modified_base (296)..(296): a, c, t, g, unknown or other
  modified_base (538)..(538): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccgaaccgtgggggtccctgagactctcctgtgcggtctcgtgggttcaccgtcactacaactccatgagctggtccncaggctccgagggagggctggagtgggtctgtagttatttagtagtggtggtggtgctagtagttacgcgaagacgtccggtagaaacggggcctattccaacctagtccctaccaagaacgaactaacttccaattacggaaaccacgtcttaagtaacttccttaaacaaagtacggaaactacgtaccgtaggaacgaccgacccgaacgaaccgccggtaccttacttaacgttacgnggtacggacgggtaacgggttacggtacgggaacggggagggcggttactaaggtacggtaacgttaccggtacggaacccggtaacggggttcgggggaaccg

SEQ ID NO: 426868 - DNA, 560 bp, Homo sapiens
  misc_feature: GZ8MTXP01DXAZ3.21.76.G10.1.454.CMB.2.raw
  modified_base (520)..(520): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtgggggtccctgagactctcctgtgcggtctcgtgggttcacgtcactacaactccatgagctgggtccgcaggctccgaggggaaggggctgggagtgggtctcgtagtttatttataggtggtggtggtgcagattacgcaagactccggtgaaaggggcctattccaccatcctcagagacaattccatagaacacgctgtactcttacaaattcgggaaacagcctagagacgccgaacgaccaacggtccgtactacttacgtgtcgcggacgggagtgggacgggaggngggcaagtggaacttcgttgaccgtcggttgggggaaccg

SEQ ID NO: 426869 - DNA, 502 bp, Homo sapiens
  misc_feature: GZ8MTXP01DGXY9.21.76.G10.1.454.CMB.2.raw
  modified_base (437)..(437): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctcctgtctgcatctgtaggagacagagtcaccatcacttggccgggcgggtcaggacattagacattatagcctggtatcagcagaaaccaggtaaattcccaagctcctgatctatgctgcatcctctttgcccaatcgaggggtcccatctcggttcagtgcagtggatcgtgggacagtatttcactctcaccatcagcagcctgcaggcctgaagtatgtttgactaacttattactataacaaaatataagcttagtacncccctactcttacgtttcggcgtccgagggaacccgaagggtcggaactaagttaactaaaaccg

SEQ ID NO: 426870 - DNA, 591 bp, Homo sapiens
  misc_feature: GZ8MTXP01DSKJA.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgactccgaaccgtgggggtccctgagctctcctgtgcggtctcgtgggttcaccgtcactactaactccatgagctggtccgcaggctccgagggagggctggagtgggtctctagtttattagtagtggtggtggtgcagtattacgcaagactccggtagaacgggcctagttccacatcctaccagacgactaacttccaatacgaacacgtctagtactacttaacaaagttggaaactacgacctagaacggacgcccgaacgaccgacggtcccgttactattacgtgtgcgggacgggagtacgggaacggggaggcgggacgtaagtaggtaacttacgttacgacccgtaacggttgggggaacccg

SEQ ID NO: 426871 - DNA, 640 bp, Homo sapiens
  misc_feature: GZ8MTXP01BYO1E.21.76.G10.1.454.CMB.2.raw
  modified_base (545)..(545): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctcgtgggttcaccgtcactacaactccatgagcgtgggtcccgcaggctccgagggaggggctgggagtgggtctcgtagttatttagtagtggtggtggtgcgagtattacgcaaagaccttccggtgaaacggggccctaatttccaacccgattccctacccgaagaacgtaactaaactttcccgaattacggaaacctaccggcttagttaacttcttaacaaatggggaaactggtccctaggaacgcgaccgacgaccgtacggtccgttactatttaccggnggtcggacgggacgggttaggacgggaacggggagggcggactaaggtacggtaactttaccggtacggacccggtaacgggttcgggggaaccg

SEQ ID NO: 426872 - DNA, 625 bp, Homo sapiens
  misc_feature: GZ8MTXP01CWEWD.21.76.G10.1.454.CMB.2.raw
  modified_base (194)..(194): a, c, t, g, unknown or other
  modified_base (306)..(306): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagagtcacatcacgttggccgggcgggtcaggacattagactattatagctaggtatcagacaagaaacaggtaaactccaagctctagatctatgctgactacttcctntttgacctagtcgtacgggtccctagttccgttacggttcaggtcggctaggtaggacgttcgtagggatagttacttactactcctaccaacctactacgacgaccgacgcccgtgacccgtacggtacccgtaagtaaagtacgttacggttacgtaaccttaaacgtttaaactttaacttaaacgtaaaactaaaaacttaagtaacggtaccttaacggtcccttccccttacgtacccgttaccgtttccgggacccggtaacggaacgggtaaccgtaagggttacgaaccgtaacgttaaccgtaaaacgg

SEQ ID NO: 426873 - DNA, 546 bp, Homo sapiens
  misc_feature: GZ8MTXP01AC2Y2.21.76.G10.1.454.CMB.2.raw
  modified_base (366)..(366): a, c, t, g, unknown or other
  modified_base (390)..(390): a, c, t, g, unknown or other
  modified_base (511)..(511): a, c, t, g, unknown or other
  modified_base (514)..(514): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtggggggtccctgagactctcctgtgcggtctcgtgggttcaccgtcactactaactccatgagctgggtccgcaggctccgagggaggggctggagtgggtctctagtttattagtagtggtggtggtcgcagattacgnaagctcgtgaacgggcgattcacntctccagagactaaattccatagaacacgtctagtatcttacaaatcggaacagccctagacgcgaccgacgacgaccggtccgtactataccgtgtcggcggacgggagtggaacggggnggnggcaagtgaatcgttgactcgttggggaaccg

SEQ ID NO: 426874 - DNA, 598 bp, Homo sapiens
  misc_feature: GZ8MTXP01BI5E1.21.76.G10.1.454.CMB.2.raw
  modified_base (278)..(278): a, c, t, g, unknown or other
  modified_base (510)..(510): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtgggggtccctgagactctcctgtgcggtctcgtggtcaccgtcactacaacncatgagcgtgggtcccgcgaggccgtccggagggaggggctgggagtgggtctgtagttatttagtagtggtggtggtcgcgagtatacgcaagactcggtgaaacgggccatccacatcctacagacactaacttccaatacgaaacacgtctagtacttacttaacaaagtggaaactcgacctaggaacgacgcccgaagaaccgccggtcccgttataacgttaccgnggtcggacggaacggggttagacggggaacgggggaggcgggactaaggtcgggtaacttcgttggaccgtcgggttcgggggaaccg

SEQ ID NO: 426875 - DNA, 615 bp, Homo sapiens
  misc_feature: GZ8MTXP01BM3X7.21.76.G10.1.454.CMB.2.raw
  modified_base (365)..(365): a, c, t, g, unknown or other
  modified_base (392)..(392): a, c, t, g, unknown or other
tcagtcgtcgctcgcacgaccggtgctcgatttagtcactcatacaggggctgggagaggagcccagcactgggattccgaggtgtttccattcggtgataagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggttcaccgtcactactaactccatgagctgggtccgccaggctccgaggggaagggctgggagtggtctcgagtttatttataggtggtggtggtgcagattacgnagaactcgtgaagggccgatcacatcncagagacattccatgaacacgctgtactcttacaaaatcgaaacgagccctaggaacgaacgaccccggaacgaaccgaaacccgggtcccgttactaacgtttaaccgtggttaacggccggaacgggggaacgttggggaaaccgggggaagggaagggggcaaggtgggaacttaacgtttacggacccgttaacggtggggggaacctaaacccggggg

SEQ ID NO: 426876 - DNA, 531 bp, Homo sapiens
  misc_feature: GZ8MTXP01BIICR.21.76.G10.1.454.CMB.2.raw
  modified_base (283)..(283): a, c, t, g, unknown or other
  modified_base (291)..(291): a, c, t, g, unknown or other
  modified_base (480)..(480): a, c, t, g, unknown or other
  modified_base (493)..(493): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggttcacgtcactacaactcatganctggtccncaggctccgagggaaggggctgggagtggggtctcagtttattagtagtggtggtggtgcagatacgcaagactcgtgaagggccgattcacatctcagagacaattccatagaacacgctagtatcttacaaatggaaacagcctagagacgccgacgacacggcgtactattactgtgcggacgggngtggacggggagngggcaagtggaatacgttcgactaagttcgggggaacg

SEQ ID NO: 426877 - DNA, 643 bp, Homo sapiens
  misc_feature: GZ8MTXP01C6MNP.21.76.G10.1.454.CMB.2.raw
  modified_base (307)..(307): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacgttggccgggcgggtcaggacattagacattattagctggtatcagcaagaaacaggtaaacgttcccaagtctacctgatctatgctgcattcctntttcgacctaatcgaggggtccccagttcccgttcgggtttcgagggtcgggacgtaagggtcggattcgtacggggtactaggttatttacacttcctaccaactacttacacgcgacgccgtacgaccgaggtcccgtagtaaacgtagtttacggttacgtaaccttaaactttaaacgtttaaccgttaagttaaactaaaaaactttagtaaacgtacgttacggtacccgttaccccttacgttacccgttaaccggtttccgggaccgtaaccggaaacgggtaacccgtaacggggtacggaacctaacgttaaccgtaaaaaccggg

SEQ ID NO: 426878 - DNA, 538 bp, Homo sapiens
  misc_feature: GZ8MTXP01DMX6X.21.76.G10.1.454.CMB.2.raw
  modified_base (280)..(280): a, c, t, g, unknown or other
  modified_base (329)..(329): a, c, t, g, unknown or other
  modified_base (481)..(481): a, c, t, g, unknown or other
  modified_base (493)..(493): a, c, t, g, unknown or other
  modified_base (497)..(497): a, c, t, g, unknown or other
tcagtcgtcgctcgcacgaccggtgctcgatttagtcactcatacaggggctgggagaggagcccagcactgggattccgaggtgtttccattcggtgataagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctctgggttcaccgtcactactaacnccatgagctgggtccgccaggctccgaggggagggctggagtgggtctntagtttatttagtagtggtggtggtgccagattacgaagactccgtgaagggcattcacatctcagagacaattccatgaacacgctgtatcttacaaatgaacagggcctggagacgccgaacgacacggcctctatactgtgcgacgggngtgacgggaggnggcngttggaatacgttgaccacggttggggcaacggggtaaccc

SEQ ID NO: 426879 - DNA, 728 bp, Homo sapiens
  misc_feature: GZ8MTXP01ELU2J.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagcgtggtggagacgtggaggagacttgactccgaaccgtgggggtcctgagactctctgtgcgtctcgtggtcacgtcactacaactcatgacgcgtcgggtccgcgaggccgtaccggaggggaggggctgggaggtgggtctacgtagtttagtttagtaggttgggtggtggtgcgtagtacgttacgcgaaacgaccgttccgggtaggaaacggggcctaactttacccaaccgtattcccaccaaggaacgtaacctaacgttcccaaagttaccggaaacctacgtcttagttaacttaccttaaacaaaagttcggggaaaacctcgggtaccctaagggaaacggacccggaccccggaaacggaaacccgtaccggggtcccttaacttaacgttaaccggtgggtaccgggacgggggtaaaccgggggttggtaccgggggaaccggggggaagggcgggggactaagggttcggtaactttaccggttacgggaacccggtaacgggggttcgggggaaacccg

SEQ ID NO: 426880 - DNA, 629 bp, Homo sapiens
  misc_feature: GZ8MTXP01DM9IK.21.76.G10.1.454.CMB.2.raw
  modified_base (291)..(291): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaggtgtcagtgtgaggtgcagctggtggagacgtggaggagacttgatccaaccgtgggggtcctgagactctctgtgcggtctcgtggttcacgtcactacaactccatgagctgggtccncaggctccgagggaaggggctgggagtgggtctctagtttatttagtaggtggtgggtcggtgcagattacgcaagactccggtaggaacgggcccgattcacctatctacccagagactaacttccaatagaacacgtactgtactctttaacaaatcgggaaacacgtacctagaacggacgacccggaacgaaccgaccggcccggttacttaacgttaaccgtggtcggaccgggaacggggacgggtacggggaacgggggaaggggaccggggacgtaaggtcgggtaagttacggtttacggacccggtaacggttcggggggaacccggg

SEQ ID NO: 426881 - DNA, 531 bp, Homo sapiens
  misc_feature: GZ8MTXP01BS5UD.21.76.G10.1.454.CMB.2.raw
  modified_base (292)..(292): a, c, t, g, unknown or other
  modified_base (428)..(428): a, c, t, g, unknown or other
  modified_base (471)..(471): a, c, t, g, unknown or other
  modified_base (484)..(484): a, c, t, g, unknown or other
  modified_base (494)..(494): a, c, t, g, unknown or other
  modified_base (499)..(499): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaggtgtcagtgtgaggtgcagctggtggagactggaggagacttgatccaaccgtgggggtccctgagactctcctgtgcggtctctgggttcaccgtcactacaactccatgagctgggtccnccaggctccgaggggaaggggctgggagtgggtctcgagttatttagtagtggtggtggtcgcagattacgcaagactcgtgaaagggccatcacatctcagagacaattccaatcgaacacgctagattcttaanaaatacgaacacgcagagacgaccgacgacgacgtcctatatntgcgcggaggagnggagggaggnggacngtgtaacttacgtagaccgtgggttcggggcg

SEQ ID NO: 426882 - DNA, 532 bp, Homo sapiens
  misc_feature: GZ8MTXP01DVTHC.21.76.G10.1.454.CMB.2.raw
  modified_base (221)..(221): a, c, t, g, unknown or other
  modified_base (413)..(413): a, c, t, g, unknown or other
  modified_base (461)..(461): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatccctccctgtctgcatctgtaggagacagatcaccatcacgttggccgggngggtcaggacatagacattatagcctggtatcagcaagaaaccaaggtaaacgttacccaagctacctgatctatgctgctactcctctttgaccctaatcgacggggtcccaacttccgtcggttcagtgggccagtggtatcgtagggacagtattcactctcaaccatccagcagctgcaggctagagntgtagctaacttaatactagtaaactaaaatataagtcttaaggtccncccgttactcttaccggtttcggccgcgaaacgggaaccctaagggtcggactaacttaacgtaaaaccgg

SEQ ID NO: 426883 - DNA, 558 bp, Homo sapiens
  misc_feature: GZ8MTXP01C6IRR.21.76.G10.1.454.CMB.2.raw
  modified_base (360)..(360): a, c, t, g, unknown or other
  modified_base (405)..(405): a, c, t, g, unknown or other
  modified_base (472)..(472): a, c, t, g, unknown or other
  modified_base (490)..(490): a, c, t, g, unknown or other
  modified_base (523)..(523): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccaaccgtgggggtccctgagactctctgtgcggtctcgtggtcacgtcactacaactccatgagcgtggtccgcaggctccgaggggaagggctggagtgggtctcgtagttattagtagtgggtgtggtcgcagatacgntaaagacctccggtagaacggggcctattccaacatcctcaaganaacaattccatagaacacgctagtatcttaacaaataggaaacaggtccagagacgaccgacgaccncggtccgtctaacttacngtggcggtacggggagtggacggggaggagggnaagtagaactacgttgaccgtggttcggggaaccg

SEQ ID NO: 426884 - DNA, 688 bp, Homo sapiens
  misc_feature: GZ8MTXP01DCPRD.21.76.G10.1.454.CMB.2.raw
  modified_base (268)..(268): a, c, t, g, unknown or other
  modified_base (281)..(281): a, c, t, g, unknown or other
  modified_base (285)..(285): a, c, t, g, unknown or other
  modified_base (301)..(301): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggttcacgtntactactactacncagngcgtcggtccggtccncggcgtccgtacgggagggggacggtcgtggtagggtcggtctagttagtttagttagtaggttgggtggtggtcgtagtagtacgtcgaacgacgtccggtacgggtaagggaccgggtacgttacctaccgacctactcccgtaacgaaggtaacaactaccttacaagtaacaaccgtcgtacttagtacttactaaacaagtaacgaacgacgtaccgagaaccggaccggacccggtaaacgaccggtacccggtaccttaacgttacgttaacgtgggttacgggacggggttacgggtagggtacgggggaacgggggttaggggacgtaacggtaggtaacgttacgttacggttacgaaccggttgggggaacccggg

SEQ ID NO: 426885 - DNA, 791 bp, Homo sapiens
  misc_feature: GZ8MTXP01CLXAV.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgactccgaacgtgggggtccctgagactctcctgtgcggtctcgtgggttcacgtcactacaactccatgacgcgtcgggtccgcgaggcctacccggaaggggaacggggcgtagggagtcgggtctacgtagtttagtttagtaggtggtggtggtcgcagtagttacgcgaaagtaccgtcggtacgggaaacggggtccgtaacgtttccgaaccgtacgtccgttaacccgaaggtaacggtaaaccttaaacgtttccccgaaagttacgggaaaacccgttacggtacccgttagggtttaaccttaccgttaaacgtaaaaacgtttcggggaaacccgtaacggttccccgttaagggaaaccggtaaccggttaccccggaaaacggttacccggaaccggggttccccgttaaccgtttaaacgttcccgttaagggttaccggaccgggggtaaacgggttacggtttaacggggaacggggttacgggacgggggttacttaagggtacgggtaactttaccgggtttacgaaccccggttcgggttcgggggtaaaccccgg

SEQ ID NO: 426886 - DNA, 639 bp, Homo sapiens
  misc_feature: GZ8MTXP01CYRD0.21.76.G10.1.454.CMB.2.raw
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatccctccctgtctgcatctgtaggagacagagtcaccatcacgttcggccggggcggtacagggacattagactattatacgctggtatcagacagaaacaggtaaactccaagctacctgtatctatcgtctcgctacttccttctttcgacctaacgtcgacggggtcccagttccgtcggtttcgagttgggacgtaggtggacttcggaggggtactagttactttcactcctacaaccctagtacacggtccacgtcctcgaccgacggtccgtaaggtaacgtacgttacgttcgtaacgtttaaactttaacttaaaccttaacgtaaaaccttaaaaagttacgtaaacgtcgttaaaccggtccccttccccgtttactccgttaccggttcccgggacggtaaccgggtacgggtaacccggtaaggggtacgaacctaacgttaaaccgtaaaaccggg

SEQ ID NO: 426887 - DNA, 576 bp, Homo sapiens
  misc_feature: GZ8MTXP01EL5M0.21.76.G10.1.454.CMB.2.raw
  modified_base (444)..(444): a, c, t, g, unknown or other
  modified_base (453)..(453): a, c, t, g, unknown or other
  modified_base (488)..(488): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagactgggaggagacttgatccgaaccgtgggggtcctgagactctcctgtgcggtctcgtgggttcacgtcactacaactccatgagctggtccgcaggctccgagggaagggctggagtgggtctcgtagtttattagtaggtggtggtggtgcagtatacgcaagactccggtagaaacggggccgtattccaccgatcctaccagaagactaattccaatacgaacacgctagatctaaanaatggaacngcagacgcgaccgacgaccgcggtcttctagtcgnggtcggacgggacgggttggacggggaacgggagggcggttacgtaaggtacggtaacgttacggtagaccggtcggggcggggaacg

SEQ ID NO: 426888 - DNA, 577 bp, Homo sapiens
  misc_feature: GZ8MTXP01BCMMQ.21.76.G10.1.454.CMB.2.raw
  modified_base (268)..(268): a, c, t, g, unknown or other
  modified_base (372)..(372): a, c, t, g, unknown or other
  modified_base (484)..(484): a, c, t, g, unknown or other
  modified_base (505)..(505): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaggtgtccagtgtgaggtgcagctggtggagactggaggagacttgatccaaccgtgggggtccctgagactctcctgtgcggtctcgtggttcaccgtnactacaactccatgagctgggtccgccaggctccgagggaaggggctggagtgggtctcgagttatttatagtggtggtggtgcagattacgcaagacttccgngtaaacggggccattccaccatcctccagagacaattccatacgaacacgctgtatcttacaaatgggaaacagccctgacgcgcccgacgaaccacgggccctatacttancggtagcgggtaaacgggggngtaggggacggggaggcgggacgtaaggtcggtaacgttacgttacggaccggtaaggggttcggggaaccg

SEQ ID NO: 426889 - DNA, 564 bp, Homo sapiens
  misc_feature: GZ8MTXP01AOF30.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctcgtgggttcaccgtcactacaactccatgagctgggtccgccaggctccgagggaaggggctggagtgggtctcagtttatttagtagtggtggtggtcgcagattacgcaagactccgtgaagggccattcaccatctccagagacaattccatacgaacacgctgtactcttacaaatggaaactagcctaggagacgccgaacgacgccggtacccgtctacttacgtggtggcgggaacggggagtgggaacggggagggcggggcaagtggaactcgtttggacctaacggttgggggaaccg

SEQ ID NO: 426890 - DNA, 539 bp, Homo sapiens
  misc_feature: GZ8MTXP01BK96H.21.76.G10.1.454.CMB.2.raw
  modified_base (296)..(296): a, c, t, g, unknown or other
  modified_base (497)..(497): a, c, t, g, unknown or other
  modified_base (502)..(502): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctctgggttcaccgtcactactaactccatgagctgggtccncaggctcgagggaggggctggagtgggtctcgagtttatttagtagtggtggtggtgcagatacgcaagactcgtgaagggccgatcacatctcagagacatccatagaactacgctgtatctacaaatgggaacagcctagacgagccgacgacgcggtccgtctattactggtcgcggacgggagtgggacggggaggnggganaagtggtaatacgttggacctaaggttgggggaaccg

SEQ ID NO: 426891 - DNA, 626 bp, Homo sapiens
  misc_feature: GZ8MTXP01BCEFH.21.76.G10.1.454.CMB.2.raw
  modified_base (313)..(313): a, c, t, g, unknown or other
  modified_base (316)..(316): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatcgaccagtctccatcctcctgtctgcatctgtaggagacagagtcacatctacgttggccgggcggtacaggacattagactattattagctggtatcagacaacgaaacaggtaaacgtacccaagtctctagactctatcgctgactactccgtnttnaccactacgtacggggtccctagtcgttccgggttcgacggtcgggacgtaggtggtactcggtagggactagttaactttcacttacctactaaccctatccgaacggtcaacgcctaggacctacgggggacccttaggtaaagttacgttacgggttaaccgactttaaaacgtttaacttaacgttaaacgtaaactaaaacgttaagtaacgtacgttacgttacccgttccccttacgtccgttaccggtttccggacgtaacgacggggtaacctaagggacgttacaacgttaacgaaacgg

SEQ ID NO: 426892 - DNA, 550 bp, Homo sapiens
  misc_feature: GZ8MTXP01D6LMK.21.76.G10.1.454.CMB.2.raw
  modified_base (462)..(462): a, c, t, g, unknown or other
  modified_base (505)..(505): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctcgtgggttcaccgtcactacaactccatgagcgtgggtcccgccaggctccgagggaagggctggagtgggtctctagtttatttatagtggtggtggtgcagattacgcaagactcggtgaagggccgattcacatctccagagacaattccatcgaacacgctgtatcttacaaatgaaacaggcctaggagacgccgacgacncggtccgtctatcgtgtgcggacgggagtgggacggggagggngggactaagtggtaattacgttgaccgtaacggttgggggaaccg

SEQ ID NO: 426893 - DNA, 605 bp, Homo sapiens
  misc_feature: GZ8MTXP01APURV.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctctggttcaccgtcactacaactccatgagctgggtccgcaggctccgagggagggggctgggagtgggtctcgagtttattagtaggtggtggtggtgcagattcgcaagactccggagaacggggccgtattccgacatcctaccagagacaattccgatacgaacacgctagtactacttacaaatcgggaaacacgcctagacgaacgcccggaacgaccgaccggtccgtacttaacttaccgtggtcggcgggtaacgggagggtacgggacgggggagggacggggacgtaaggtacggggtaacttaccggtttcgaaccggtcgggttcggggggaacccg

SEQ ID NO: 426894 - DNA, 579 bp, Homo sapiens
  misc_feature: GZ8MTXP01E0VE8.21.76.G10.1.454.CMB.2.raw
  modified_base (295)..(295): a, c, t, g, unknown or other
  modified_base (507)..(507): a, c, t, g, unknown or other
  modified_base (533)..(533): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagactggaggagacttgatccaaccgtgggggtccctgagactctcctgtgcggtctcgtgggtcaccgtcactacaactccatgagcgtggtccncaggctccgagggagggctggagtgggtctctagttattatagtggtggtggtgcagagttacgcaaacgactccggtaggaaacggggtcctattccaaccattccctaccgaagaacgaactaattccaagtacgaacacgtctagtactcttaacaaatggaaacaggcctaggaacgacgaccgacgacgacgggtcctatattacgnggtcgcggacgggagtcgggaggggngggaggcaagtggaacttacgttcgacccgtggttcgggggaaccg

SEQ ID NO: 426895 - DNA, 614 bp, Homo sapiens
  misc_feature: GZ8MTXP01B9V5W.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtcctgagactctcctgtgcggtctcgtgggttcaccgtcactactaactccatgagctgggtccgccaggctccgagggaggggctgggagtgggtctcgtagtttatttagtagtggtggtggtcgcagattacgcaagactcgtagacgggcatcacatcctcagagacaagttccagtacgaactacgtctagttaacttacttaaccaaagttacggaaacacggtaccctaggaacgaccgcccgaacgaccgaccggggtccctacttaacttaccgtggtcggacggtacggggaggtacgggacgggggaagggcggggactaaggtagggtaacttaccggtttcggaacccgtaacgggttcggggggaacccg

SEQ ID NO: 426896 - DNA, 621 bp, Homo sapiens
  misc_feature: GZ8MTXP01CM681.21.76.G10.1.454.CMB.2.raw
  modified_base (284)..(284): a, c, t, g, unknown or other
  modified_base (299)..(299): a, c, t, g, unknown or other
  modified_base (362)..(362): a, c, t, g, unknown or other
  modified_base (428)..(428): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagtcttgggttttccttgttactatttcaaaaggtgtccagtgtgaggtgcagctgggtggagacgtgggaggagacttgatccgaacggtgggggtccctgagactctcctgtgcggtctcgtggttcaccgtcactacaacncatgagcgtggcccncgaggctcggagggagggctggagtggtctctagtttatttagaggtggtggtggtcgcagtntacgcaagacttcggagaacgggcctatcaactatctacaagacaactaattcccaagacgaaacncgtccttagtaacttaccgttaaaagaaacgtacggaaacgtacgtaccgaacggaacgaaccgacccgtacgaaccgtccgtaccttacttacgtcggtggaacggacgggtaacgggaggtaacggggaagggacggcgacgtaaggtacgttaacgtacgtaccggaccggtcggggttcggggaacccg

SEQ ID NO: 426897 - DNA, 605 bp, Homo sapiens
  misc_feature: GZ8MTXP01ADRNV.21.76.G10.1.454.CMB.2.raw
  modified_base (532)..(532): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtgggggtccctgagactctcctgtgcggtctctgggttcaccgtcactactaactccatgagctgggtccgcaggctccgaggggaagggggctgggagtgggtctcgtagtttatttagtaggtggtggtggtcgcagtattacgcaaagacctccggtagggaaacgggccgtattccgaaccatccctaccagaacgaacctaaattcccaatacgaaacacgctagttactcttaacaaatcgggaaacagcctagacgcgccgacgacacgggtcctctaacttcgtgtcggcggacggggngtgggaacggggagggacgggctaaggtgggtaacttcggttacggacccgtaacgggttcggggggaacccg

SEQ ID NO: 426898 - DNA, 592 bp, Homo sapiens
  misc_feature: GZ8MTXP01B1GOA.21.76.G10.1.454.CMB.2.raw
  modified_base (449)..(449): a, c, t, g, unknown or other
  modified_base (547)..(547): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggtttttccttgttactatttcaaaaggtgtccagtgtgaggtgcagctgggtggagacgtgggaggagacttgactccgaaccggtgggggtccctgacgactctcctgtgcggtctcgtgggttccaccgtcactacaactccatgagctgggtccgcaggctccgagggaggggctgggagtgggtctctagttatttagtaggtggtggtgtcgcagtatacgcaaagactccggaggaaacgggcctattccaccatcctacagagaactattccatacgaacacgtctgtatcttanaaacgtcgaacagccctagacgacgcccgacgaccgaccggtccgtacttacttcgtggtcggcgggacggggagtacgggaggggttaagggcgggntaaggtcgtaagttacgttaggacccgtgggttcgggggaacccg

SEQ ID NO: 426899 - DNA, 696 bp, Homo sapiens
  misc_feature: GZ8MTXP01EPCHT.21.76.G10.1.454.CMB.2.raw
  modified_base (279)..(279): a, c, t, g, unknown or other
  modified_base (295)..(295): a, c, t, g, unknown or other
  modified_base (328)..(328): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtgggggtccctgagactctctgtgcggtctcgtgggttcacgtcactactaacncatgagcgtgggtccncgaggctccggagggaggggcgtggagtgggtntctagtttattagtagtggtggtggtgcagtagtacgcgaacgacgtccggtaggaacggggaccctattccgaacctacttacctacccgaaggaactaactaaattccaattacggaaactacgcttagtacttacttaaacaaagttacggaaacgacggtacccgtaggaacgaaccgggacccggaacgaaaccgtaccgggtaccccgttacttaaagttaaccggtggttaacgggacccgggtaaacgggggttacgggtagggggaaccgggggaaggggacggggttacgtaaggttacgggtaatttaaccggtttccgggaaccggttaaccgggttaacggggggtaaccccggg

SEQ ID NO: 426900 - DNA, 603 bp, Homo sapiens
  misc_feature: GZ8MTXP01C7F88.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccgaaccgtgggggtccctgagactctcctgtgcggtctcgtggtcaccgtcactacaactcatgagcgtcgggtccgccgaggcctccgaggggaggggcgtgggaggtgggtctcgtagtttatttagtaggtggtggtggtcgcagtatacgcaagactccggtaggaacggggccgtacttccgacctatcctaccgaagacgaactaacttccaaattacgaaactacggtcttagtacttacttaacaaattcgggaaactgcctagagacgaccgacgaccgcgggtccttatacttcgtgcggcgggacggggagtggggaacggggagggcgggcaagtgggaacttacgttcggaccgtgggttcgggggaaccg

SEQ ID NO: 426901 - DNA, 615 bp, Homo sapiens
  misc_feature: GZ8MTXP01DB04B.21.76.G10.1.454.CMB.2.raw
  modified_base (564)..(564): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccgaaccggtgggggtccctgagctctcctgtgcggtctcgtggtcaccgtcactacactcatgagcgtcggtccgcgaggccgtaccggaaggggaacggggcgtgggagtgggtctacgtagtttagtttagtaggtgggtggtcggtgacgtagtacttacggcaaacggtaccgtccggtaggaaacggggtcctattccaacctactcccgtaccgaagacgaactaacttaccatacgaaacacgtctagtactacttaacaaagtcgaacacgcctaggacgacgccgaacgaccgacggtcctctaatcgtgtgccggagggttgacgggaacggggnggcggctaaggtagtaacttacgttcggaccgtaacgggcgggggaacccg

SEQ ID NO: 426902 - DNA, 672 bp, Homo sapiens
  misc_feature: GZ8MTXP01D4Q3Y.21.76.G10.1.454.CMB.2.raw
  modified_base (195)..(195): a, c, t, g, unknown or other
  modified_base (220)..(220): a, c, t, g, unknown or other
  modified_base (314)..(314): a, c, t, g, unknown or other
  modified_base (364)..(364): a, c, t, g, unknown or other
tcagtcgtcgctcgcacgaccggtgctcgatttagtcactcatacaggggggcagaagtctctctcagtcaggacacagcatggacatgagggtccctgctcagctcctgggactcctgcttctctggctcccagataccagatgtgacatccagatgacccagtctccatcctccctgtctgcatctgtagganacagatcaccatcacttggccgggnggtcaggacattagactattattagcctggtatcagacaagaaaccaggtaaacgttcccaagcctcctgtatctatgactcgctacttccttntttgactaaactccggtacggggtccctaagttccgttaccgggttaccngggttacggaccggtagggttaggaacgttcggtacggggtaacctagttactttacacctccttacaaccctaattacgacggaccacgtaccccgtacgaccgtacgtaccggtaaggtaacgttacgttacgttacgtaaccgttaaacgtttaacgttaaaccgtaacgttaaaactaaaagttaacgtacgtaaccgtcgttacccgtacccttaccgttaccgttaccggttcggaccggttaaccgggtaacgggtaaccggtaacggtacgaacttaaccgtaaccggttaaacgtaacg

SEQ ID NO: 426903 - DNA, 626 bp, Homo sapiens
  misc_feature: GZ8MTXP01EP2TR.21.76.G10.1.454.CMB.2.raw
  modified_base (300)..(300): a, c, t, g, unknown or other
  modified_base (580)..(580): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagacgtgggaggagacttgactcccgaaccgtggggggtccctgagactctcctgtgcggtctcgtgggtcaccgtcactacaactcatgagcgtggtccncaggctccgagggagggctggagtgggtctctagtttattagtaggtggtggtggtcgcgtagtattacgctaaagacctccggtagggaaacgggcctaacgttaccaacctatccctaccaaggaacaactaattccaatacgaaactacgctagtaacttacttaacaaaacgttaggaaacgtacgaccgtaggaacgacggacccgaacgaaccgacggtcccgttatacgttaacgtggtacggacgggacgggaggtacgggacggggagggngggcaaggtggaacttacgttcggaccgtcggttcgggggaacccg

SEQ ID NO: 426904 - DNA, 574 bp, Homo sapiens
  misc_feature: GZ8MTXP01DSQOY.21.76.G10.1.454.CMB.2.raw
  modified_base (365)..(365): a, c, t, g, unknown or other
  modified_base (399)..(399): a, c, t, g, unknown or other
  modified_base (525)..(525): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaagtgtccagtgtgaggtgcagctggtggagacgtggaggagacttgatccgaaccgtgggggtccctgagactctcctgtgcggtctcgtgggttcaccgtcactacaactccatgagctgggtccgcaggctaccgaggggaagggctgggagtgggtctgagtttatttatagtggtggtggtgcagattacgnaacgactcggtgaagggccattcacatcacaganacaattccaatacgaacacgtctagtactactacaaatcggaaactagcctagagaacgcccgaacgaccacggtccgttactacgttacgtggtggaccgggtaggggagtgggacggggagggngggcgaagttagggaattacgttacggaccgtaacggttgggggaaccg

SEQ ID NO: 426905 - DNA, 556 bp, Homo sapiens
  misc_feature: GZ8MTXP01BR18X.21.76.G10.1.454.CMB.2.raw
  modified_base (296)..(296): a, c, t, g, unknown or other
  modified_base (371)..(371): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtgggaggagacttgatccaaccgtgggggtccctgagactctcctgtgcggtctcgtgggttcaccgtcactacaactcatgagctgggtccncaggcctcgagggagggctggagtgggtctctagtttattagtagtggtggtggtgcagatacgcaagactcggngaagggccattcacatctccagagacaattccatacgaacacgctgtatcttacaaattggaaacagcctaggacgacgaccgacgaaccgccggtcccgttatacttacgtggtcgcgggacggggttagtagggacggggaggagggcaagtggaattcgttgaccgtggttcgggggaaccg

SEQ ID NO: 426906 - DNA, 591 bp, Homo sapiens
  misc_feature: GZ8MTXP01BWDFO.21.76.G10.1.454.CMB.2.raw
  modified_base (453)..(453): a, c, t, g, unknown or other
  modified_base (470)..(470): a, c, t, g, unknown or other
  modified_base (480)..(480): a, c, t, g, unknown or other
  modified_base (518)..(518): a, c, t, g, unknown or other
  modified_base (533)..(533): a, c, t, g, unknown or other
  modified_base (551)..(551): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccgaaccgtgggggtccctgagctctctgtgcgtctcgtggtcaccgtcactactactcatgagcgtcgggtccgccgaggcctccggaggggaaggggctgggaggtgggtctcgtagtttattagtaggtggtggtggtgcgagtattacgcgaacgtaccgtcccggtagggaaacgggtcccgtacttcgacctactccgtaccgaagagaactacgttaccatacgaacncggtactgtaactctanaaagtgaacncgcagagacgccgacgacgacgtccgtatacgttcggngtcggacggacgggnggagggacggggaggcgngtaaggtgtaacttacgtcggaccgtgggttcggggaacg

SEQ ID NO: 426907 - DNA, 571 bp, Homo sapiens
  misc_feature: GZ8MTXP01CAOPM.21.76.G10.1.454.CMB.2.raw
  modified_base (378)..(378): a, c, t, g, unknown or other
  modified_base (531)..(531): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagactgggaggagacttgatccgaaccgtgggggtccctgagactctcctgtgcggtctcgtgggttcaccgtcactacaactcatgagcgtcgggtcccgccgaggcctccgaggggaaggggctgggagtgggtctcgtagtttatttagtaggtggtggtggtcgcagtattacgnaagactccggtagaacgggccatccacatctaccagagacatccatagaacacgctagtatcttagaaatggaacagccgtagacgcgcccgaacgaccgacggtccgtctattcgtgtggacggtacgggagtcgggaacggggaggcgggnaagtggaattcgttcggacccgtgggttcgggggaacccg

SEQ ID NO: 426908 - DNA, 605 bp, Homo sapiens
  misc_feature: GZ8MTXP01EP8EO.21.76.G10.1.454.CMB.2.raw
  modified_base (290)..(290): a, c, t, g, unknown or other
  modified_base (563)..(563): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagtttggctgagctgggttttccttgttactatttcaaaaggtgtccagtgtgaggtgcagctggtggagactggagagacttgatccaaccgtgggggtccctgagactctcctgtgcggtctctgggttcaccgtcactacaactcatgagctggtccncaggctccgagggaggggctggagtgggtctgtagtttatttagtagtggtggtggtgctagtatacgcaagacttccggtggaacgggcctattcacccgatccctaccagagaactaaattccatacgaacacgtctagtactacttacaaattaggggactaaggccctaggaacgaccgcccgtaacgaccgaaccggtccgtacttaacgttaaccgtggtacggaccgggacggggagtacggggaggaaggggagggcctaaaggngggtaacttacggttcggacccgtaagggttcgggggaaccg

SEQ ID NO: 426909 - DNA, 616 bp, Homo sapiens
  misc_feature: GZ8MTXP01B4TB1.21.76.G10.1.454.CMB.2.raw
  modified_base (468)..(468): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtgggaggagacttgatccgaaccgtggggggtccctgagactctcctgtgcggtctcgtgggttccacgtcactactaactccatgagcgtgggtcccgcaggctccgaggggaggggctgggagtgggtctcgagtttatttataggtggtggtggtgcagtattacgcaagacctccggtaggaaacggggccctattccgactatccgtacagacgtaacattccatacggaactcgctgtaactcttacaaatcggaaacngcctaggagacgcccggagaaccgcgggtcccttataacgttaccgtgtcgggttaccggaggggaggtacgggaacgggggttagggcgggggacaagggtcgggtaactttaccggtttacgaccggtcgggttcggggggaaccg

SEQ ID NO: 426910 - DNA, 595 bp, Homo sapiens
  misc_feature: GZ8MTXP01D9KOS.21.76.G10.1.454.CMB.2.raw
  modified_base (284)..(284): a, c, t, g, unknown or other
  modified_base (433)..(433): a, c, t, g, unknown or other
  modified_base (444)..(444): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactgggaggagacttgatccgaaccgtggggggtccctgagactctcctgtgcggtctcgtggtcacgtcactacactcatgancgtggccgcaggctccgagggagggcgtggagtgggtctcgtagtttatttagtagtggtggtggtgcagtattacgcaagacgtcggtagaaacggggcctataccacatctacagagaacatccatacgaacacgtctatatctaanaaatggaaacngaccgtagacgacgacccgagaaccgacggtccgtactactcgtgtcggacgggacgggttaaggcgggaacggggaagggcggggacgtaagtggggtaacgtttacggtttacggaaccccggtaaggggttccggggggtaacccggg

SEQ ID NO: 426911 - DNA, 612 bp, Homo sapiens
  misc_feature: GZ8MTXP01DDQPK.21.76.G10.1.454.CMB.2.raw
  modified_base (256)..(256): a, c, t, g, unknown or other
  modified_base (308)..(308): a, c, t, g, unknown or other
  modified_base (511)..(511): a, c, t, g, unknown or other
  modified_base (530)..(530): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatccctccctgtctgcatctgtaggagacagacgtcaccatcacgttggccggggcggtcaaggacattagactattatagctgtatnagcaagaaacaggtaaactcccaagctcctgactctatcgctgcacttcctntttgacctaaatcgaacggggtcccctagttccgttcgggtttcaggtcgggactaacgggtggaattcgtaggggtactaggtactttaccacttctaccacctactacacggcaacggtcctacggaccacgggtacccgtaagggtaaactagttacgttacgaccttaaactttaataccttaagtaaactaaaaagtntaacggtccaggttacccnccccttacgtaccttaccggtttcgggacctaacgggaacggtaaccgtaaggacggttaactaacgttaaccgtaaaacgg

SEQ ID NO: 426912 - DNA, 644 bp, Homo sapiens
  misc_feature: GZ8MTXP01D7TYC.21.76.G10.1.454.CMB.2.raw
  modified_base (289)..(289): a, c, t, g, unknown or other
  modified_base (475)..(475): a, c, t, g, unknown or other
tcagtcgtcgctcgcacgaccggtgctcgatttagtcactcatacagggggctgggagaggagcccagcactgggattccgaggtgtttccattcggtgatcagcactgaacacagaggactcaccatggtagttttggctgagtcttgggttttccttgttactatttacaaaaggtgtcagtgtgaggtgcagcgtgggtggagacgtggaggagtacttgactaccgaaccggtcgggggtccctgacgactctctgtgcgtctcgtggtcacgtcactactaacncatgagcgtcggtccgcgaggctaccggaggggaaggggctaggaggtggtctcgtaagtttattagtaggtggtggtggtcgcgagtacttacgctaaacgtacctccggtaggaaacgggcctattaccacgtatccacagacaactaattccagtaacgactacgtctagtaactcttaaaanaacgtacggaactacgtacgtaggaacgaccgaccgaacgaccgtccgtccttatacgtcggtgtcgggacgggtacgggaggtaacggggaaggggaggggcggttaacgtaagggtacgttaaccgtttacggtaccggaaccggtaacgggggttcggggaacccg

SEQ ID NO: 426913 - DNA, 566 bp, Homo sapiens
  misc_feature: GZ8MTXP01ADIEF.21.76.G10.1.454.CMB.2.raw
  modified_base (485)..(485): a, c, t, g, unknown or other
  modified_base (520)..(520): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactgggaggagacttgatccaaccgtggggggtccctgagactctcctgtgcggtctctgggttcaccgtcactactaactccatgagctggtccgccaggctccgagggaaggggctggagtgggtctcgtagtttattatagtggtggtggtgcagtattacgcaagcctccgtgaaacggggccagttcacagtcctaccagagacaattccaagtagaacacgctgtactcgttacaaagtcgggaaacagcctagagacgccgacgtaccacgggtcctntacttacgtgtagcggacgggagtcggaacggggnggacgggcaagtcggaattacttggacctaacggttgggggaaccg

SEQ ID NO: 426914 - DNA, 607 bp, Homo sapiens
  misc_feature: GZ8MTXP01EZ9YJ.21.76.G10.1.454.CMB.2.raw
  modified_base (297)..(297): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtggggggtccctgagactctcctgtgcggtctcgtgggtcaccgtcactactaactccatgagctgggtccnccaggctccgagggagggctggagtgggtctcgtagtttattagtagtgggtggtggtcgcagtattacgcaagacctccggtaggaacgggccgattccaccatcctccagagactaattcccatacgaacacgtcttagtactcttacaaatggaaacacgcctagacgacgcccgaacgaccgaccggtccgttactacgttaccgtggtcggaccgggacggggaggtcggggaacgggggagggacggggacaagggtacgtaagttaccgttacggaccgtaacgggttcggggggtaacccgg

SEQ ID NO: 426915 - DNA, 604 bp, Homo sapiens
  misc_feature: GZ8MTXP01D348Q.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtgggggtccctgagactctcctgtgcggtctcgtgggttcaccgtcactactaactccatgacgctcgggtccgccaggctccgagggaaggggctggagtgggtctcagtttatttatagtggtggtggtgcagtattacgcaacgactccggtagaaacggggccgaatttccgaaccatcctaccaagacgaacaattccaattacgaaacacgctgtactcttacaaattggaaacaggcctagaacgacgacccgacgaacgaccggtccgttactacgttacgtaaggttgccgggtaacggggttaggtacggacgggggagggaggggcgaagtggggaacttcgttcggactaacggttgggggaacccg

SEQ ID NO: 426916 - DNA, 632 bp, Homo sapiens
  misc_feature: GZ8MTXP01D0BDO.21.76.G10.1.454.CMB.2.raw
  modified_base (282)..(282): a, c, t, g, unknown or other
  modified_base (298)..(298): a, c, t, g, unknown or other
  modified_base (533)..(533): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggtttttccttgttacttatttcaaaaggtgtccagtgtgaggtgcagcgtgggtggagacgtggaggagacttgactccgaaccgtgggggtccctgacgactctctgtgcgtctcgtggtcacgtcactacacncatgagcgtcggtccncgaggccgtccggaaggggagggcgtagggagtgggtctacgtagtttattagtggttggtggtgtcgcagtacgtacgcaacgtaccgtcggtaggaacgggtcctagtaccactactcctaccgagtaacaactacttaccaatacggaactacgtactagttacttctaaacgtaaagttacggaaactgaccgtagaacgaccgccgaacggaaccgtccggtacccgttntaacgttacgtcggtacggcgggacgggttaggtaggggacgggagggttcggacgtaagtagtaacgttacgtacgacggtcgggttcggggaacccg

SEQ ID NO: 426917 - DNA, 617 bp, Homo sapiens
  misc_feature: GZ8MTXP01AC67Z.21.76.G10.1.454.CMB.2.raw
  modified_base (294)..(294): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcgtgggttttccttgttactatttcaaaaggtgtccagtgtgaggtgcagctggtggagactggaggagacttgatccgaaccgtgggggtccctgagactctctgtgcggtctctggtcaccgtcactactaactcatgagcgtgggtccncaggcctcgagggagggctggagtgggtcctagtagtttattagtaggttggtgggtcgtgactagtacgttaccgagaaacgtacgtccggtaagggaacgggtaccgtacttacccactatccctacgaaggaactaactaaccttccaagttacgaaactccgttctattacttactaacaagtacgaacgcgtacagacgacgccgaacgacgtccgtcttactacgtcggtggacggacgggtacgggaggacggggaaggggaggcggacgtaagtcgtaacgttaccgtacggaccgtaacgggggcgggaacccg

SEQ ID NO: 426918 - DNA, 555 bp, Homo sapiens
  misc_feature: GZ8MTXP01EVSX8.21.76.G10.1.454.CMB.2.raw
  modified_base (198)..(198): a, c, t, g, unknown or other
  modified_base (227)..(227): a, c, t, g, unknown or other
  modified_base (470)..(470): a, c, t, g, unknown or other
tcagtcgtcgctcgcacgaccggtgctcgatttagtcactcatacaggggggcagaagtctctctcagtcaggacacagcatggacatgagggtccctgctcagctcctgggactcctgctgctctggctcccagataccagatgtgacatccagatcgacccagtcctccatccctccctgtctgcatctgtagganacagatcacatcacgttggccgggcggtnaggacattagactattatagctaggtatcagacaagaaacctaggtaaactccaagctcctgatctatgctgctactccttctttgacctaagtcgacggggtcccagttccgtcggttcagtggactaggtggactcgtagggactagtacttcactctacacatcacgcacgctagcacggctagaacgtatggttcactaactttattaactagtaaactaaaatataagcttacggtcnccccgttactccttacggtttccggaccggtaaccggacggggtaaccgtaacggggtacgaactaacgttaacgtaaaaccggg

SEQ ID NO: 426919 - DNA, 654 bp, Homo sapiens
  misc_feature: GZ8MTXP01CAFWK.21.76.G10.1.454.CMB.2.raw
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacgttcggccgggcgggtcaggacattagactattattagcctggtatcagcaagaaaccaggtaaagtcccaagctcctgatctatgctgctactccttctttcgaccctaagtcgacgggggttccccagttccgttcggtttcgagggtcgggaccgtagggtcgggtaagttcggtacggggtaactaggttacttttccgaccgttacctaccctaacctacgtacgacggcctaacggtcccttaggccctacggggtccgtaggtaaaggttacgttagttacgtaaccttaaacttttaacgttaacttaggttaaacctaaaaagttacgtaacgtacgttacggttcccgttccccttcgtccttaaccggtttccggaccgtaaccggaacggggtaaccgtaaagggtcggaaacgtaacgaaccgtaaaacgg

SEQ ID NO: 426920 - DNA, 731 bp, Homo sapiens
  misc_feature: GZ8MTXP01BSNFM.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagacgtgggaggagacttgactccgaaccgtcggggggtccctgacgactctcctgtgcggtctcgtggtcacgtcactacaactcatgagcgtcggtccgcaggcctacggaggggagggcgtgggagtgggtctacgtagtttagtttagtaggttggtggtggtgcgtagtagttacgcgtaaacgaccgttcggtaggaaacggggtccctaattcccgactactcctaccgaagaacgtaactaacttacccaagttaacgaaactacgtcttagttaacttaccttaaacgaaagttacggggaaaacctacggtaccccgtaagggaaccggaacccggccccggaaacccggaaccggtaacccgggttcccccgttaatttaaccgtttaaccggtgggttcggggaacccggggtaacgggggagttacggggggaaccggggttaaggggttacgggttacaagggttacgggtaactttaaccggttacggaccgtaaccggggttcggggggaaccccg

SEQ ID NO: 426921 - DNA, 770 bp, Homo sapiens
  misc_feature: GZ8MTXP01BN9C7.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagcgtggtggagacgtggaggagacttgactccgaaccgtgggggtcctgagactctctgtgcgtctcgtggtcacgtcactacaactcatgagcgtcggtccgcgaggctccggagggagggcgtggagtgggtctcgtagtttattagtaggtggtggtggtcgacgagtacgttacgcgaaacgtaccgtcgggtaggaacggggtccctacgttccaacctacttccctaccgaagaacgtaacctaacttcccaaagttaccgaaacctaccgtcgttagtaaccttacttaaacgtaaaacgttacggaaaacccgtacggtccccgtaagggaaaccgaacccgggaccccggtaaaccggaaaccccggtaaccgggggttcccctttaaccgtttaacgttaaacccgggttggggttaccgggaccgggggtaaaccgggggttagggtaacgggggaacccgggggaagggggttaccggggccgtaagggttaaccggggttaacgttttaacccgggtttacggaaaccccggggttaacgggggttccggggggggtaaaccccgg

SEQ ID NO: 426922 - DNA, 581 bp, Homo sapiens
  misc_feature: GZ8MTXP01BO6SK.21.76.G10.1.454.CMB.2.raw
  modified_base (444)..(444): a, c, t, g, unknown or other
  modified_base (501)..(501): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggttcaccgtcactactaactccatgagcgtgggtcccgccaggcctccgaggggaggggctggagtgggtctcgagtttatttagtagtggtggtggtcgcgagtattacggctaaacggactcccggtaggaaacggggcccgtattacccacattccaccagacgacaattccatacgaaacncgctgtatcttacaaatggaacagcctaggacgcgccgacgtaacgccggtcccgtntaagttctggtcgcgggtacgggagtcggacgggagggaggcaagtgggaattaccgttgaccgtggttcgggggaaccg

SEQ ID NO: 426923 - DNA, 692 bp, Homo sapiens
  misc_feature: GZ8MTXP01DD9LR.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagacgtgggaggagacttgactccgaaccgtgggggtccctgagactctcctgtgcggtctcgtggttcacgtcactacactcatgagcgtggtcccgcaggcgtccggaggggaaggggcgtggaggtgggtctacgtagttatttagtagtggtggtgtgacagtagttacgcgaagaccgtccggtagggaaacggggccgtaattccaacctacgtcctaccgaagacgtaactaaactttccaagtacgaaacctacggtcttacgttaacttccttaaacaaaacgttcggggaaaactacggtacccgtaagggaacgaaccggacccggaacgaaacccggtccggtacccgttacttaacgtttaccgtaagggttcggacgggggtaaacgggaggtacgggggaacggggaaggggcgggactaaggtacgggtaactttacggttacgggaacccggtaacggggttcggggggtaacccg

SEQ ID NO: 426924 - DNA, 509 bp, Homo sapiens
  misc_feature: GZ8MTXP01AHZSL.21.76.G10.1.454.CMB.2.raw
  modified_base (195)..(195): a, c, t, g, unknown or other
  modified_base (222)..(222): a, c, t, g, unknown or other
  modified_base (441)..(441): a, c, t, g, unknown or other
  modified_base (453)..(453): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatccctccctgtctgcatctgtagganacagagtcaccatcacgttggccgggngggtcaggacattagactattatagctggtatcagacagaaaccaggtaaacgttccaagctcctgatctatgctgctattcctctttgacctaacgtcgacggggtcccatccgttcggttcagtggcaggtggtatcgtagggactagtattcactctcacatcacgcacgcctgcagtctagaatagtgtcgactaacttatactataacaaaatntaagcttagtcnccctctcttacgttcggcgcgacgggaaccagggtcggactaacgttaacgaaacg

SEQ ID NO: 426925 - DNA, 636 bp, Homo sapiens
  misc_feature: GZ8MTXP01CL9E7.21.76.G10.1.454.CMB.2.raw
  modified_base (195)..(195): a, c, t, g, unknown or other
  modified_base (320)..(320): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtcctccatccctccctgtctgcatctgtaganacagatcaccatcacgttcggccgggcggtacaggactattaggactattattacgcctggtatcagacaagaaacctaggtaaattccccaaagtcctctagattctatgctgactcttccttntttacgaccctaagttcgacggggttccctagttcccgttacgggttccagggtcgacgtagggtgtacgtcgtgggtactagtacttcactctacactactcacgcacgtcctagaccgtggtaccgtgaacgtattggtactacgttaactttacttaacgtaactaaacttaaaagtcttaacggtaacgttaccggttcccggttacccctttcggttaacccgttaccggtttcccggggaccgtaaccgggtaaccgggtaaaccgtaaacggggttcggaaaccttaacggttaaccgtaaaacccggg

SEQ ID NO: 426926 - DNA, 558 bp, Homo sapiens
  misc_feature: GZ8MTXP01EZXSY.21.76.G10.1.454.CMB.2.raw
  modified_base (427)..(427): a, c, t, g, unknown or other
  modified_base (493)..(493): a, c, t, g, unknown or other
  modified_base (507)..(507): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagcgtggtggagacgtgggaggagacttgatccaaccgtgggggtccctgagactctctgtgcgtctctgggtcacgtcactacaactccatgagctggtccgccaggctccgagggaggggctggagtgggtctcgagtttattagtagtggtggtggtgcagattacgcaagctccggtgaaggggccattcgacatctccgagagacaattccatacgaacacgctagtatctanaaatgggaaacaggcctagagacgcccgacgaccgacggtccgtctacttacgtgtgcggacgggngtagggaacggggngggaggcgtaagtgggtaacttaccgttagacccgtggttcgggggaaccg

SEQ ID NO: 426927 - DNA, 612 bp, Homo sapiens
  misc_feature: GZ8MTXP01DVZOB.21.76.G10.1.454.CMB.2.raw
  modified_base (291)..(291): a, c, t, g, unknown or other
  modified_base (426)..(426): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagcgtggtggagacgtggaggagacttgactccgaaccgtgggggtcctgagactctctgtgcgtctctggtcacgtcactacactcatgagcgtggtccncaggctccgaggggaggggctggagtgggtctcgtagtttatttagtgtggtggtggtcgcagtacttacgcaacgactcggaggaacgggccgtatccgactactccacgagacgaacaacttccatacgaacncgtctgttactacttaacaaatcggggaaacaggcctaggaacgacgacccgaacgaaccgcgggtcccgttattaacgttacgtggtacggacgggtacggggaggtcggggaacgggggagggcggcgtaaggttacgggtaacttacggttacggaacccgtcgggggttcggggggaacccg

SEQ ID NO: 426928 - DNA, 529 bp, Homo sapiens
  misc_feature: GZ8MTXP01B3D9K.21.76.G10.1.454.CMB.2.raw
  modified_base (195)..(195): a, c, t, g, unknown or other
  modified_base (221)..(221): a, c, t, g, unknown or other
  modified_base (447)..(447): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatccctccctgtctgcatctgtagganacagagtcaccatcacgttgccgggnggtcaggacattagacattattagctggtatcagcagaaaccaggtaaagttcccaagctcctgactctatgctgctatcctctttgacctaagtcgacggggtccccagtccgtcggttcaggtggcaggtggatcgtagggacagtatttcactctcaccatcagcagcctagcaggcctagaacgattgttgactaacgtttattaactagtaactaaaaatntaagcttaagtcgttccccgtctacttacgtttcggacgtcgacgggtaaccaagggtacgactaacgttaacgaaaaccgg

SEQ ID NO: 426929 - DNA, 676 bp, Homo sapiens
  misc_feature: GZ8MTXP01EY5DF.21.76.G10.1.454.CMB.2.raw
  modified_base (268)..(268): a, c, t, g, unknown or other
  modified_base (563)..(563): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggtttttccttgttactatttcaaaaggtgtccagtgtgaggtgcagctggtggagacgtgggaggagacttgactccgaaccgtgggggtccctgagactctcctgtgcggtctcgtggtcnccgtcactacaactcatgacgcgtcgggtcccgcgaggccgtcggaggggaggggctggagtgggtctctagtttatttagtaggtggtggtggtcgacagtatacgctaacgaccgtcggtaggaacgggccgtattccaccgtatcccgtacgaagaacgtactaaacgttccaagttacgaacctacgtcttagtaactctttaaacgaaagttcgggaaaactacggtaccctagggaacgaacccggacccggaacgaacccggccgggtaccttacttaacgttaccgngggttacggacggggaacggggttagggtacggggaaccgggggaggggttcggacgtaaggtcgggtaacttacggttacggacccgtaacggggttcggggggaaaccccg

SEQ ID NO: 426930 - DNA, 666 bp, Homo sapiens
  misc_feature: GZ8MTXP01ENNYO.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactattcaaaaggtgtcagtgtgaggtgcagcgtgggtggagactggaggagacttgactccgaaccgtgggggtcctgagactctctgtgcggtctcgtggttcacgtcactactaactccatgagcgtcgggtccgccgaggccgtccggaaggggacgggggctgggaggtgggtctacgtagtttagtttagtaggtggtggtggtgacgtagattacgctaagaccgtcggtaggaacgggcctattcaacgcttcaccgagaacactacttccatacgaaactcgtctagtacttacttaacaaagttacgggaaactcggtccagggacgaaccggcccggaaacgacccgtaacccggggtcctttacgttaaactttccgggtggtaacgggccggggtaaacgggggttggtacgggggaaccggggaaggggttcgggactaagggttagggtaacttaccggttacgacccggtaacgggttggggggaaaccccg

SEQ ID NO: 426931 - DNA, 622 bp, Homo sapiens
  misc_feature: GZ8MTXP01AYHUT.21.76.G10.1.454.CMB.2.raw
  modified_base (373)..(373): a, c, t, g, unknown or other
  modified_base (468)..(468): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcgtgggttttcctgttactattcaaaaggtgtcagtgtgaggtgcagctggtggagactggaggagacttgatccgaaccgtggggggtccctgagactctcctgtgcggtctcgtgggttcaccgtcactacaactccatgagcgtcgggtccgccaggcctccggaggggagggggctgggagtgggtctcgagtttattagtagtgggtggtggtcgcaggattacgnaagaccgtcgtggaacgggcgtattccacctatcctaccaggacactaacttccaagtacgaacacgcttgtacttcttacaaattgggaaaccncgcgagacgcgacccgacgaccgtaccggtccttacgttacgttacgtggtcggaccggggtacggggacgggtaggggaacgggggagggttggacgtaagggtacggttaacgttacggttacgggacccggtcggggttcgggggaacccg

SEQ ID NO: 426932 - DNA, 568 bp, Homo sapiens
  misc_feature: GZ8MTXP01BANFE.21.76.G10.1.454.CMB.2.raw
  modified_base (293)..(293): a, c, t, g, unknown or other
  modified_base (491)..(491): a, c, t, g, unknown or other
  modified_base (525)..(525): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccgaaccgtgggggtccctgagactctcctgtgcggtctcgtggtcaccgtcactacaactcatgagctggtccncaggctccgaggggagggctggagtgggtctcgagtttatttagtaggtggtggtggtcgcgagtattacgctaagacctccggtagaacgggccagttcaccgatcctcagagacattccatacgaacacgctagtactcttacgaaattgggaaacagcctagagacgcccgagaccgcggtccgtctaattacgnggttcgcgggtacgggagtacgggacggggaggnggacgaagtgggtaattcgttgacccgtggttcgggggaaccg

SEQ ID NO: 426933 - DNA, 650 bp, Homo sapiens
  misc_feature: GZ8MTXP01A7U8V.21.76.G10.1.454.CMB.2.raw
  modified_base (599)..(599): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtgggggtccctgagactctcctgtgcggtctctgggtcaccgtcactacaactccatgagcgtgggtccgccaggcctccgagggaggggctggagtgggtctcgtagtttatttagtagtggtggtggtgcagtagttacgcaagacctccggtaggaaacggggcccgtaatttccgaaccctattccctacccgaagtaacgaacctaaactttacccaagttacggaaacctacggtccttagttaacttacctttaacaaaagttcggaaactacggtaccctaggaacgacgcccggaacgaccgaccggtcccgtacttacgttaccgtggtacggcggacggggttaggtagggaacggggagggngggctaaggtggaactttacggttcggacccgtcgggttcgggggaacccg

SEQ ID NO: 426934 - DNA, 595 bp, Homo sapiens
  misc_feature: GZ8MTXP01CCKYT.21.76.G10.1.454.CMB.2.raw
  modified_base (287)..(287): a, c, t, g, unknown or other
  modified_base (440)..(440): a, c, t, g, unknown or other
  modified_base (521)..(521): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagacgtggaggagacttgatccaaccgtgggggtccctgagactctcctgtgcggtctcgtggttcaccgtcactacaactccatgancgtggtccgcaggctccggagggagggcgtggagtggtctcagtttattagtagtggtggtggtcgcgagattacgcaagacctcggtgaaacgggcctattccacctatcctacagagactaattccatacgaacacgctagtactcttaanaaatcgaaactcgcctaggacgaccgacccggacgacccgtacgggcccttacttaactccgtggtacggcggtaacgggngggtaacggacgggggaggagggactaaggtagtaactttacggtacgaccggtaacgggttcgggggaacccg

SEQ ID NO: 426935 - DNA, 579 bp, Homo sapiens
  misc_feature: GZ8MTXP01DHC82.21.76.G10.1.454.CMB.2.raw
  modified_base (294)..(294): a, c, t, g, unknown or other
  modified_base (407)..(407): a, c, t, g, unknown or other
  modified_base (454)..(454): a, c, t, g, unknown or other
  modified_base (567)..(567): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctctggttcaccgtcactacaactccatgagctgggtccncaggctccgagggaaggggctggagtgggtctcagttatttagtagtggtggtggtgcagattacgctaagactccgtagaaacgggccgtattacaccaatcgtaccagganacaattccaatagaacaacgtctgtaatcttaacaaattaggaaacngacctagacgagcccgacgaaccaccgggtcctcctattaacctggtcgcgggacgggagtagggcggggaagggcggggactaagtaggaagttacgttacgaaccggtcgnggggggaacccg

SEQ ID NO: 426936 - DNA, 579 bp, Homo sapiens
  misc_feature: GZ8MTXP01BJMVL.21.76.G10.1.454.CMB.2.raw
  modified_base (456)..(456): a, c, t, g, unknown or other
  modified_base (466)..(466): a, c, t, g, unknown or other
  modified_base (485)..(485): a, c, t, g, unknown or other
  modified_base (493)..(493): a, c, t, g, unknown or other
  modified_base (500)..(500): a, c, t, g, unknown or other
  modified_base (514)..(514): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagacgtggaggagacttgactccgaaccgtgggggtccctgagactctctgtgcggtctcgtggtcacgtcactacactccatgagcgtcgggtccgcgaggcctaccgaggggaagggggctgggaggtgggtctcgtagtttagttagtaggtgggtggtggtgcgagtattacgcgaaacgacctcggaggaacgggccgtattccactctctaccagacgactattaccatacgaactcgctagtactctaanaaatggaacngccagacgacgccgagacncggtcctntactcgngtcggcggacgggngtacggggacgggaggcggctaaggtggtaacttacggttcgaccgtcggggttcggggaacccg

SEQ ID NO: 426937 - DNA, 585 bp, Homo sapiens
  misc_feature: GZ8MTXP01A5O98.21.76.G10.1.454.CMB.2.raw
  modified_base (294)..(294): a, c, t, g, unknown or other
tcagtcgtcgctcgcacgaccggtgctcgatttagtcactcatacagggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctcgtggtcaccgtcactacaactcatgagctgggtccncagctcgaggggagggctgggagtgggtctcgtagtttagtttagtaggtggtggtcggtgcagacttacgcgtaagaccgtccggtaggaacgggccgtacttcaccatcctcagagacatccatacgaacacgctagtatcttacaatgaacagcctagacgacgccgacgaccgaccggtccgtctaacttaccgtggtacgcgggtaccgggttaggacggggacgggggagggcgggacgtggtagggtcttacgttcggaccgaacgggttcggggggaacccgg

SEQ ID NO: 426938 - DNA, 648 bp, Homo sapiens
  misc_feature: GZ8MTXP01BNYJV.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtggggggtccctgagactctcctgtgcggtctcgtgggttcaccgtcactactaactccatgagcgtgggtccgcaggctccgagggaggggctggagtgggtctctagtttatttagtagtggtggtggtcgcagattacgcaagacctccggtggaaacgggccgattccacatcctaccagacgactaattccaatacgaacctacgcttagtacttacttaacaaagttggaaacgtagaccctaggaacgaccggacccggaacgaacccgaccgggtcccgttacttaacgtttaccgtggttcgggccgggaacgggggaggttacggggaacggggggaggggaggggttaccgtaaggttacgggtaactttaccggtttcgggaacccgtaacggggttcggggggaacccgg

SEQ ID NO: 426939 - DNA, 681 bp, Homo sapiens
  misc_feature: GZ8MTXP01DBJIE.21.76.G10.1.454.CMB.2.raw
  modified_base (570)..(570): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagtcttgggttttccttgttactatttcaaaaggtgtccagtgtgaggtgcagctggtggagacgtgggaggagacttgactccgaaccgtcgggggtccctgacgactctccgtgtcgcgtctcgtggttcaccgtcactactactccatgacgcgtcggtccgcgaggccgtccggaggggaacggggcgtgggagtgggtctcgtagttatttagtaggtgggtggtggtcgcagtacttacgcgaacgtaccgtcgtagggaacgggccgtataccacactccaccagacgtaactattccgaatacgaaacgtcgtactagttaacttacctaaacaaacggtacaaaccgacggtacccgtaggaaccggaaccggaccccgaaacggacccgtacccgggtccttaacgtaacgtttaccggnggggtcgaccggggtaacgggggaggtacggggaacgggggttagggcgggacctaaggtacgggttcgttaacgtccggaacccggtaacggggttcgggggaaaccccg

SEQ ID NO: 426940 - DNA, 587 bp, Homo sapiens
  misc_feature: GZ8MTXP01BV40F.21.76.G10.1.454.CMB.2.raw
  modified_base (294)..(294): a, c, t, g, unknown or other
  modified_base (478)..(478): a, c, t, g, unknown or other
  modified_base (533)..(533): a, c, t, g, unknown or other
  modified_base (536)..(536): a, c, t, g, unknown or other
  modified_base (545)..(545): a, c, t, g, unknown or other
  modified_base (548)..(548): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtgggttcaccgtcactacaactcatgagctgggtccncaggctccgaggggaaggggctgggagtggggtctcgtagtttatttataggttgggtgggtggtccgcgagtattacgcaaaggacctccggtaggaaacggggcccattccaaccatcctcccgaagacgaacaaattcccaatacggaaacacgtctagttatcttacaaatcgggaaacngccaggagacgcccgagtaccgacgggtccctatacgttactggtgccggagggnggnggacggggnggngggcaagtggaatacgttgaccctaaggttgggggaacc

SEQ ID NO: 426941 - DNA, 581 bp, Homo sapiens
  misc_feature: GZ8MTXP01D6WIT.21.76.G10.1.454.CMB.2.raw
  modified_base (276)..(276): a, c, t, g, unknown or other
  modified_base (292)..(292): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggcttagctgggttttccttgttactatttcaaaagtgtccagtgtgaggtgcagctggtggagactggaggagacttgatccaaccgtgggggtccctgagactctcctgtgcgtctcgtggtcaccgtcactactaacnccatgagctgggtccncaggctccgaggggaaggctggaggtgggtctcgagtttaattagtaggtggtggtggtgcagtattacgcagaacctcgtggaagggcctacttcaccatctacagagacaattccatgaacacgctgtatcttacaaatgaacgagcctagagacgccgacgaccgaaccggcctacttacttacgtgtaacggcggacggggacggttggaacggggagggacgggttcaaggtggtaacgttaacgtttcggaaccgttacgggtcgggggcgtaaacccggggg

SEQ ID NO: 426942 - DNA, 704 bp, Homo sapiens
  misc_feature: GZ8MTXP01B3C7X.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagacgtggaggagacttgatccgaaccgtgggggtccctgagactctcctgtgcggtctcgtggttcacgtcactactactcatgagcgtggtccgcgaggcctaccgaggggaggggctggagtgggtctcgtagtttattagtaggtggtggtggtcgcgtagacgttacgctaagaccgtccggtagggaaacgggccgtacttaccgacctactacccgtaccgaagaacgaaactaacttacccaaagttacgaaacctacgtacttagttaacttaccttaaactaaaagtacgggaaacctacggtaccctaaggaaacgaacccggcccggaaaccggaaccgtacccggtccccgttaacttaacgtttacgtgggttacgggacggggtaaacggggttagggttacgggggaacgggggagggacggggcctaaggttcgggtaacgtttacggtttacggaacccggtaacggggttaaccggggggaacccg

SEQ ID NO: 426943 - DNA, 770 bp, Homo sapiens
  misc_feature: GZ8MTXP01D7FJX.21.76.G10.1.454.CMB.2.raw
  modified_base (295)..(295): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagcgtggtggagacgtggaggagacttgactccgaaccgtgggggtccctgagactctcctgtgcggtctcgtggtcacgtcactacactcatgagcgtggtccncaggctcgagggagggctggagtgggtctcgtagtttagtttagtaggttgggtggttggtcgacgtagtacttaccggcgtaaacggtacccgttcccgggtagggaaaccgggggtccccgttaactttacccgaacccgtacgttacccgtacccgtaaaggtaaccggtaaaccttaaactttaccccgaaagtttaacccgggaaaaccctaccggttaccgttagttaaactttacctttaaaactaaaacggtttacggggaaaaccctacgggtaccccgttaagggaaaccggtaaccggaccccggaacggtaaacccgtccccgggtaccgttaacttaacggtttacccgtaagggttcgggacgggaaccggggttagggacggggaacgggggaaggggccgggataaggttagggtaacttacggttacggacccggttaacggggttcgggggaacccg

SEQ ID NO: 426944 - DNA, 685 bp, Homo sapiens
  misc_feature: GZ8MTXP01CYKA6.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtgggggtccctgagactctcctgtgcggtctcgtgggtcaccgtcactactaactccatgagcgtcgggtcccgcgaggcctccgaggggacggggcgtggagtgggtctcgtagttatttagtagtggtggtggtgcagtatacgcaagactccggtagacgggcctagtccaacgtatcctaccaaggacaaactaactttcccaagtacgaaacctcgtaccttagttaacttactttaacaaaagttcggaaaactcggtaccctagggaacgaccgcccggaacgaacccgaaccgggtcccgttactaacgtttaccgtcggttcggaccggggtaacgggggttagttaaccgggggacgggggaaaggggacggggccttaaagggtacgggggtaacttttaaccggttttacggaaccccggttaacggggttcgggggggtaaacccgg

SEQ ID NO: 426945 - DNA, 591 bp, Homo sapiens
  misc_feature: GZ8MTXP01ACA3Y.21.76.G10.1.454.CMB.2.raw
  modified_base (360)..(360): a, c, t, g, unknown or other
  modified_base (370)..(370): a, c, t, g, unknown or other
  modified_base (383)..(383): a, c, t, g, unknown or other
  modified_base (386)..(386): a, c, t, g, unknown or other
  modified_base (391)..(391): a, c, t, g, unknown or other
  modified_base (434)..(434): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctgggggtccctgagactctcctgtgcggtctctgggttcaccgtcactacaactccatgagctggtccgccaggctccgagggaagggctggagtgggtctcgtagttatttatagtggtggtggtgcagattacgnaagacctcgngaagggcatcacntcncaganacattccgatcgaacacgctgtatcttacgaaatcgggaaacncgtcctagaaccgagacccgtaacgaaccgaccggtccgtactacttaccgtcggtgccgggaccgggttacggtaggaaccgggggaggaacggggccaaggttgggaaactttacccggtttggaaaccccgtaacgggttcggggggaaccccg

SEQ ID NO: 426946 - DNA, 685 bp, Homo sapiens
  misc_feature: GZ8MTXP01BM4DK.21.76.G10.1.454.CMB.2.raw
  modified_base (282)..(282): a, c, t, g, unknown or other
  modified_base (298)..(298): a, c, t, g, unknown or other
  modified_base (567)..(567): a, c, t, g, unknown or other
tcagtcgtcgctcgcacgaccggtgctcgatttagtcactcatacaggggctgggagaggagcccagcactgggattccgaggtgtttccattcggtgataagcactgaacacagaggactcaccatggagttttggctgagctgggttttccttgttactatttacaaaaggtgtccagtgtgaggtgcagctggtggagacgtggaggagacttggactccgaaccgtgggggtccctggagactctctgtgcgtctcgtgggtcaccgtcactactacnccatgagctgggtccnccgaggcctaccgagggggacgggcgtgggaggtgggtctcgtagtttatttagtaggtggtggtggtgccaggtaattacggaaacgtaccgtaccgggtaggaacggggccctaagttacccaccgtactaccgtaccgaaagacgtaactaaacttccgaagttacgaaacctacgtcttagtactacttaagaaatcgaaacacggcctaagggacgaccggaccgaaccggtaacgaccgggttaccctacttaacggttacgnggtacggaacgggtaacggggagggtcgggaacgggggagggtacgggcttaggttagggtaattaccgtttggaaccccgtaggggttcgggggaaccttaacccgggggtaacccc

SEQ ID NO: 426947 - DNA, 794 bp, Homo sapiens
  misc_feature: GZ8MTXP01D01BV.21.76.G10.1.454.CMB.2.raw
tcagtcgtcgctcgcacgaccggtgctcgatttagtcactcatacaggggctgggagaggagcccagcactgggattccgatgtgtttccattcggtgatcagcactgaacacagaggactcaccatggagttttggctgagcttgggttttccttgttactatttcaaaaggtgtccagtgtgaggtgcagctggtggagacgtggaggagacttgactccgaaccgtgggggtccctgagactctcctgtgcggtctcgtggtcaccgtcactactaactccatgagcgtcgggtcccgccgaggccgtccggaagggggaacggggtcgtagggaggttggggtccttacgtaaggttttagtttagttaggttgggttagggttgggtgacgtaggtacgtttaccggaacgaacggtaaccgttcccgggtagggaaaccgggggtccctaacgtttaccaaacccgtaaattccccgtaaccgaaaggtaacggtaaacctaaactttcccgaaagttaccggaaaacctaccgggtcttaacgttaacttaccgtttaaaccaaaagttacggaaaaccgtaacggtcccgttaagggaaaccgacccggaacccggaaaacccggtacccgtacccggggtaccctttacgttaaacgttaacccggttgggttacggggaccgggttaaacgggggaggttcgggggaaaccgggggttgggaacgggtctaaggttcggtaaacgttaccggtttacggaacccggttcggggtaaccgggggg

SEQ ID NO: 426948 - DNA, 677 bp, Homo sapiens
  misc_feature: GZ8MTXP01ETJJN.21.76.G10.1.454.CMB.2.raw
  modified_base (222)..(222): a, c, t, g, unknown or other
  modified_base (252)..(252): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatccctcctgtctgcatctgtaggagacagacgtcaccatcacgttggccgggnggtcaggacatagacattatagctggtatnagacagaaaccaggtaaatcccaagctcctagatctatcgctgctacttccttcttcgactaactcggacggggtacccctacgttccgttcggttcgagggtcgggtacgtaggttcgggtaacgttcggtacggggtaactacggttactttacctaacttccctactaaccctacttaccgaacggtccaaccgtcccgttacgacccgtacggggtacccgttaacgggtaaagtacgtttacgttccgtaacctttaaactttaaacgtttaaccttaaggttaaactaaaaaacttctaacggtaccttaaacggttccccggttaacccctttcgtaccgttccgggtttccggacccggaacggtacggggtaaccgtaacgggtacgggaacctaacgttaaccgtaaaacccggg

SEQ ID NO: 426949 - DNA, 607 bp, Homo sapiens
  misc_feature: GZ8MTXP01BBX19.21.76.G10.1.454.CMB.2.raw
  modified_base (381)..(381): a, c, t, g, unknown or other
  modified_base (405)..(405): a, c, t, g, unknown or other
  modified_base (408)..(408): a, c, t, g, unknown or other
  modified_base (510)..(510): a, c, t, g, unknown or other
  modified_base (550)..(550): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtggggggtccctgagactctcctgtgcggtctcgtgggttcaccgtcactacaactccatgagcgtcgggtcccgccgaggcctccggaagggggaagggggctgggaggtcgggtctctagtttatttagtaggtggtggtggtgcagattacgnaagactcgtagaacgggcatcacntcncagacacaattccatacgaacacgctagtactcttagaaatgggaaacacgtccaggacgcggacccgacgaccgaccgggtcccttacttaactttccggnggtcgggacgggacgggggttaggtacggggaacgggggngggacggcgtaagtcggtaacgtttacgtacggaccggtcggggttcgggggaaccg

SEQ ID NO: 426950 - DNA, 697 bp, Homo sapiens
  misc_feature: GZ8MTXP01CNSIV.21.76.G10.1.454.CMB.2.raw
  modified_base (295)..(295): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagtctgggttttccttgttactatttcaaaaggtgtccagtgtgaggtgcagctggtggagacgtggaggagacttgatccgaaccgtgggggtccctgagactctcctgtgcggtctcgtggtcaccgtcactacaactcatgagctgggtccncaggctccgagggaggggctggaggtgggtctcgtagttatttagtagtggtggtggtcgctagatacgcaaggacctcggaggaacgggccgtattccaccctatcctaccaagacgaactaacgttacccagtacgaaccacgtaccgttagttacttaccttaacgaaacttacggggaaacctacggtaccccgtaaggacggaaccggacccggaaccggaacccgtaaccgggtccccgttacttaacgtttaaccgtcgggtaacgggccgggtaacgggggttaacgggttcggggaaccgggggttaaggggacgggggttaccgtaagggttacgggtaacgtttaccggtttacggaacccgggttaacgggttcggggggtaaccccggg

SEQ ID NO: 426951 - DNA, 507 bp, Homo sapiens
  misc_feature: GZ8MTXP01BLOV6.21.76.G10.1.454.CMB.2.raw
  modified_base (195)..(195): a, c, t, g, unknown or other
  modified_base (364)..(364): a, c, t, g, unknown or other
  modified_base (392)..(392): a, c, t, g, unknown or other
  modified_base (413)..(413): a, c, t, g, unknown or other
  modified_base (452)..(452): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtcctccatcctccctgtctgcatctgtagganacagactcaccatcacgttcggccggggcgggtcaggacattagacattattagcctggtatcagacagaaaccaggtaaacgttcccaagctcctgatctatgctagcatcctctttgccaagtcagggggtcccaatcgtcggtttcagtggcagtggatctgggangtatttcactctcaccatcagcacgccncgcacggactagagtagtgtntactattaattactaataaataaaatataagcacgtccncccgtactcgttcgttcggccgaacgacggaacgaggacgactaacgaacgaacg

SEQ ID NO: 426952 - DNA, 566 bp, Homo sapiens
  misc_feature: GZ8MTXP01A9VEE.21.76.G10.1.454.CMB.2.raw
  modified_base (503)..(503): a, c, t, g, unknown or other
  modified_base (515)..(515): a, c, t, g, unknown or other
  modified_base (525)..(525): a, c, t, g, unknown or other
  modified_base (528)..(528): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtggttcaccgtcactacaactcatgagcgtgggtccgccgaggcctccgaggggaaggggcgtgggagtgggtctcgtagtttagtttagtaggtggtggtggtcgcagtagttacgcaagacctcggtaggaaacggggccgattccaccgtatcctaccagacgaacaacttccatacgaacacgctagtatcttacaaatgggaaacagcctagacgacgccgacgacgacgtcgtactatcngtcgcggacggngtggacgggnggngggcaagtggaattacgtgaccgtcggttggggaaccg

SEQ ID NO: 426953 - DNA, 625 bp, Homo sapiens
  misc_feature: GZ8MTXP01DD645.21.76.G10.1.454.CMB.2.raw
  modified_base (452)..(452): a, c, t, g, unknown or other
  modified_base (550)..(550): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgactccgaaccgtggggggtccctgagactctcctgtgcggtctcgtggttcacgtcactacaactccatgagcgtcgggtccgcgaggcctccgaggggaaggggctggagtgggtctcgtagttatttagtagtggtggtggtcgcagtattacgcgtaacgacgtcggtaggaaacgggtccgtattccaacctagtcctaccgaagacgaactaattccaaagtacgaaaccncgtcttagttaactactttaacaaatcggaaacagtcctaggacgacgccgaacgaccgaccggtccgtactacttacgtggtcggaccgggtagggnggtacggggcggggttaagggcgggataaggtaggtaactttacgttacggaaccgtcgggttcgggggaacccg

SEQ ID NO: 426954 - DNA, 744 bp, Homo sapiens
  misc_feature: GZ8MTXP01D0KT1.21.76.G10.1.454.CMB.2.raw
  modified_base (362)..(362): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggtagttttggctgagcttgggttttccttgttactatttcaaaaggtgtccagtgtgaggtgcagcgtgggtggagacgtgggaggagacttgactccgaaccgtgggggtcctgagactctcctgtgcggtctcgtgggttcaccgtcactactaactccatgagcgtggtcccgcaggcctcgagggacggctaggagtgggtctctagtttattatagtggtggtggtcgnaggtattacgcaaacgtaccgtcggtaggaacggggccgtacttccgaacctatcctacccgaagacgaactaaactttccaagttagaaacctaccgtacttacggtaaacttccttaaactaaaacgttacgggaaaaccgtacgtaccccgtaagggaaacgaacccggaccccggaaaccggaaacccgtaaccggggtccccttaacgttaaccgtttcgtaacggggttcggacccgggggtaaaccgggggttaggttacgggggaacccgggggagggggaaccggggttaccgtaagggttagggtaaccgttttacgggtttaacccgggaacccgtaacgggggtttaacccggggggggtaaaccccggg

SEQ ID NO: 426955 - DNA, 584 bp, Homo sapiens
  misc_feature: GZ8MTXP01C1R6J.21.76.G10.1.454.CMB.2.raw
  modified_base (296)..(296): a, c, t, g, unknown or other
  modified_base (354)..(354): a, c, t, g, unknown or other
  modified_base (416)..(416): a, c, t, g, unknown or other
  modified_base (423)..(423): a, c, t, g, unknown or other
tcagtcgtcgctcgcacgaccggtgctcgatttagtcactcatacagggggctgggagaggagcccagcactgggattccgaggtgtttccattcggtgatcagcactgaacacagaggactcaccatggagttttggctgagtcttgggttttccttgttactatttcaaaaggtgtccagtgtgaggtgcagctgggtggagacgtggaggagacttgactccgaaccgtgggggtccctgagactctctgtgcggtctcgtggtcacgtcactacaactcatgagctggtccncaggctccgagggaaggcgtggagtgggtctcgtagttattagtagtggtggtggtcncgtagtatacgcaaagactccgtagaacggggcatacacatcctacagtagactaattccanagtaacncgtctgtaactctaacaaatgaacagcctaggaacgcgacccgtaagacccgaccgggtcctacctaaatttcgcgtggaccggtaacggggagtgggaaccggggttaggacggttcaaggtcggtaattcgtacgaccgtaacgggttgggggaacccg

SEQ ID NO: 426956 - DNA, 640 bp, Homo sapiens
  misc_feature: GZ8MTXP01AB8XH.21.76.G10.1.454.CMB.2.raw
  modified_base (581)..(581): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagcgtggtggagacgtgggaggagacttgactccgaaccgtgggggtccctgacgactctccgtgtgtcggtctcgtgggttccaccgtcactacactcatgagcgtcggtccgcgaggctccgaggggagggctggaggtcggtctcgtaagtttattagtagtggtggtggtcgcgagtagtacgctaaacgtctcccggtaggaacggggcctacttaccactagtaccctaccgaagactaactaacttccaatacgaaacctacgcttagtacttaacttaacaaagtcgggaaacacggtcctaagaacggaccgccgaaccgtacgacgggtcccttattacgtacgtggtacggacgggacgggagtcggggaacggggaggnggggactaaggtcggtaactttcgttacggaccggtaaccgggttgggggtaaccccgg

SEQ ID NO: 426957 - DNA, 632 bp, Homo sapiens
  misc_feature: GZ8MTXP01CTNMI.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagactggaggagacttgactccgaaccgtgggggtccctgagactctcctgtgcggtctctggttcaccgtcactactaactccatgagcgtgggtccgcaggctcgagggaaggggctggagtgggtctgtagtttatttataggtggtggtggtcgactagattacgcaacgactccggtggaaacgggtccgtaattccaaccgtatccctacccaagaacgaactaacttacccaagtacgaaacacgtcttagttactactttaacaaagttacggaaacacgtacctaggaaccgacgcccggaacgacgaccgggtcctactacttacgtggtacggccgggaggggacggtaggggacggggaagggttcgggactaagtgggtaacttacgttacggaccccgtaaggggttcgggggaaccgg

SEQ ID NO: 426958 - DNA, 685 bp, Homo sapiens
  misc_feature: GZ8MTXP01C6GEX.21.76.G10.1.454.CMB.2.raw
  modified_base (242)..(242): a, c, t, g, unknown or other
  modified_base (480)..(480): a, c, t, g, unknown or other
  modified_base (622)..(622): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctgggtggagacgtgggaggagacttgactccgaaccggtgggggtcccngagactctcctgtcgcgtctcgtggtcaccgtcactacaactccatgagcgtcgggtcccgcgaggcctaccggaggggaagggggctagggaggttggggtactcgtaagtttagtttagtaggttgggtcggtggtcgacgaaggtagttaccgcgtaaacgaccgtccgggtagggaacggggcctattccgacctactcctaccagaacgactaacttccgaatacggaaaccncggtacttgtaacttcgttaaacgaaatacgggaaacacgtaccgtaggaacgacgacccggaacgaaccggtaccgtaccgttactaagttcccgtaaggtcggacgggacggggaaggtacggggacgggggttaagggngggttaccgtaaggtgggtaacgtttacgttacggaacccgtcggggttcgggggtaacccgg

SEQ ID NO: 426959 - DNA, 653 bp, Homo sapiens
  misc_feature: GZ8MTXP01EJ4CB.21.76.G10.1.454.CMB.2.raw
tcagtcgtcgctcgcacgaccggtgctcgatttagtcactcatacaggggggcagaagtctctctcagtcaggacacagcatggacatgagggtccctgctcagctcctgggactcctgctgctctggctcccagataccagatgtgacatccagatcgaccagtctccactccctccctgtctgcatcgtgtaggagacagagtccaacctatcacgttcggccggggcggtacaaggactattagactattatagctgtatcagacaagaaactagtaaacgtccaagtctactagatctatcgctgctactcctcttgacctacgtcgacgggtccctagttccgtacggtttcgagttcgggacgtagtggtacgtcgtacggactagtacttcaccttctaccaactactcacgacacgccctagaccgacggtaccgtaggtaaagtacgttagttacgtaacctttaaacgtttaaacgttaaccgttaaacgttaaaactaaaaaacggtttataaaccggtaccttaaaccgggtcccgttaccccgttaccttaccgttaacccggttttccgggaccggttaaccggaacgggtaaccggtaacggggtaacggaacctaaacgttaaccgtaaaacccggg

SEQ ID NO: 426960 - DNA, 553 bp, Homo sapiens
  misc_feature: GZ8MTXP01BHSN4.21.76.G10.1.454.CMB.2.raw
  modified_base (483)..(483): a, c, t, g, unknown or other
  modified_base (511)..(511): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggttcaccgtcactactaactccatgagctgggtccgccaggctccgagggaggggctggagtgggtctcagtttatttagtagtggtggtggtgcagattacgcaagacctccggtgaaacggggccgattccgacatcctccagacgacaattccatagaacacgctgtatcttacaaatggaaacagcctgacgacgccgagaccacggtccgtactattcngtcgcggacgggagtgggacgggagggngggcaagtggaacttcgttgaccgtaacggttgggggaaccg

SEQ ID NO: 426961 - DNA, 677 bp, Homo sapiens
  misc_feature: GZ8MTXP01CT5FA.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcacatggagttttggctgagcttgggttttccttgttactatttcaaaaggtgtccagtgtgaggtgcagctggtggagacgtggaggagacttgactccgaaccgtgggggtccctgagactctcgtgtgcggtctcgtggtcaccgtcactacaactcatgagcgtggtccgcaggcctcgaggggaggggctggagtgggtctactaggttatttagtaggtggtggtggtcgctagtagttacgcgtaaagaccgtccggtagaaacggggtccgtacgttccaacctacgtacctaccgaaggaactaacctaatttcccaagtacgaaacctacgctttaagacttacctttaaacgaaacttacggggaaaactcggaccctaggaaacgacgacccgaacgtaaccgccggtccgttactaacgttacgtgggtcggaccgggaaaggggttggtaccgggaagggggaaggggttccggggaactaagggttaaggtaacctttaacggttcgggaaccccgttgggggttaaccgggggaacccgg

SEQ ID NO: 426962 - DNA, 774 bp, Homo sapiens
  misc_feature: GZ8MTXP01EBNDB.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccgaaccgtgggggtccctgagactctctgtgcggtctcgtggttcacgtcactactaactccatgagcgtcgggtcccgcgaggccgtccgaggggaggggctggagtgggtctcgtagttatttagtaggttggggtggtggtcgacgtaagtacgttacgcgtaaacggtaccgtcccgggttaggaaaccggggtcccgttaactttacccaacccgtacttcccgttacccgaagtaacggtaaacctaactttacccaagttaccggaaacctaccggtcttacggtaacttacctttaaacgtaaaacgttacggaaaaccgtacggtaacccgttaggaaacggaccggaccccggaaccggtaaacccgtaccgggtaccccgttacttaacgttaccggtggttacgggacgggtaaaccgggggttagggtaacggggaaccggggggttaaaggggcggggttaaccgtaagggttaagggtaacgtttaaccgggtttacgggaacccggttaacggggttaaccggggggggtaaaccccgg

SEQ ID NO: 426963 - DNA, 621 bp, Homo sapiens
  misc_feature: GZ8MTXP01CO9UZ.21.76.G10.1.454.CMB.2.raw
  modified_base (292)..(292): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccgaaccgtgggggtccctgagactctctgtgcgtctcgtggtcaccgtcactacactcatgagcgtgggtccncaggcctccgagggaggggctggagtgggtctcgtagttatttagtaggtggtggtggtcgcagtatacgcaagactcggtagaacggggcctatcactactctaccagacgactaattccaagtacgaacacgcttagtactacttacaaagtcgaactacgcctaggaacgacggacccgaacggaaccgaccggtcccgtactaacgttaccgtggtcggacgggtacgggggacggttacggggaaccgggggaggggcgggaccgtaaggtcgggtaacttacggtttacggaacccggtaacgggttcggggggtaaccccgg

SEQ ID NO: 426964 - DNA, 553 bp, Homo sapiens
  misc_feature: GZ8MTXP01EVDLI.21.76.G10.1.454.CMB.2.raw
  modified_base (228)..(228): a, c, t, g, unknown or other
  modified_base (301)..(301): a, c, t, g, unknown or other
  modified_base (342)..(342): a, c, t, g, unknown or other
  modified_base (362)..(362): a, c, t, g, unknown or other
  modified_base (470)..(470): a, c, t, g, unknown or other
tcagtcgtcgctcgcacgaccggtgctcgatttagtcactcatacaggggggcagaagtctctctcagtcaggacacagcatggacatgagggtccctgctcagctcctgggactcctgctgctctggctcccagataccagatgtgacatccagatcgacccagtctccatccctcctgtctgcatcgtgtaggacgacagacgtcaacctatcacgttggccgggnggtacaggactattagactattatcggccgtatcagacaacgaaacgagtaacgtaccacgactctgtatatntgctgctacttctctgacactcgacggactctcgtcgttcngtagcgtagtcggtatcggngggtacagttcttcaactctcactaatcgacgacgtcgaccctgacacgtccgtagtaagtacttggttactaacccttaaatttattaaacgtaactaaaataaaanacgtcgaattaccgttcgtccccttatcgtacgttcggcgacgaagggtaacccgaagtacggcaaactcgttaaacggaacg

SEQ ID NO: 426965 - DNA, 573 bp, Homo sapiens
  misc_feature: GZ8MTXP01A400V.21.76.G10.1.454.CMB.2.raw
  modified_base (280)..(280): a, c, t, g, unknown or other
  modified_base (295)..(295): a, c, t, g, unknown or other
  modified_base (430)..(430): a, c, t, g, unknown or other
  modified_base (450)..(450): a, c, t, g, unknown or other
  modified_base (458)..(458): a, c, t, g, unknown or other
  modified_base (506)..(506): a, c, t, g, unknown or other
  modified_base (518)..(518): a, c, t, g, unknown or other
  modified_base (525)..(525): a, c, t, g, unknown or other
  modified_base (536)..(536): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagcgtggtggagacgtggaggagacttgatccgaaccggtgggggtccctgagactctcctgtgcggtctcgtggtcacgtcactacacncatgagcgtcggccncgaggctacggagggaggggctggagtggtctcgtagtttattagtagtggtggtggtgacagtatacgcaagacgtcggaggaacgggcctattaccactagtccacaagagaactaacttccaatacgaaacncgtctagtactctaacaaancggaaacncggcctaggagaccgaccgacgacccgacggtcccttatacttacggngtcggaccgggnggttagngggacgggagnggcaagtggtaactcgtgaccgtgggttgggaacccg

SEQ ID NO: 426966 - DNA, 621 bp, Homo sapiens
  misc_feature: GZ8MTXP01B5HT5.21.76.G10.1.454.CMB.2.raw
  modified_base (458)..(458): a, c, t, g, unknown or other
  modified_base (490)..(490): a, c, t, g, unknown or other
  modified_base (529)..(529): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggtttttccttgttactatttcaaaaggtgtccagtgtgaggtgcagcgtggtggagacgtgggaggagacttgactacccgaaccggtggggggtccctgacgactctcctgtgcggtctcgtggttcacgtcactactactcatgagcgtcggtcccgcgaggcctccggaggggagggcgtgggaggttgggtctcgtagtttatttagtaggttggtggtggtcgacgagtatacgcgtaagaccgtcggtaggaacgggtcctattccaaccactccacgaagacgtaactacttccaatacgaacncgtcttagtactacttaacaaagtcgaaacgngtccaggacgaccgaccgacgacgccgtcttatattcgngtcggacgggacgggagtacgggacgggggaggcgggactaagggtcggtaacttaccggttgggaaccccgtgggggttcgggggaacccg

SEQ ID NO: 426967 - DNA, 803 bp, Homo sapiens
  misc_feature: GZ8MTXP01DDM7X.21.76.G10.1.454.CMB.2.raw
  modified_base (730)..(730): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagtcttgggttttccttgttactatttcaaaaggtgtccagtgtgaggtgcagctgggtggagacgtggaggagacttgactaccgaaccgtgggggtccctagacgactctcctgtcgtcgtctcgtggtcacgtcactactactccatgacgtcgtcgggtcccgacgacggccgtaccggaagggggtaacgggggtcgtagggtaggtcggggtaccttacgttaagtttagttttaagtaggttggggtggtggtcgaccgtagtacttacggcgtaaacggtacccgttaacccggggagggaaaccgggggtccctaaacgttccccgaaaccgtacgttacccgttaaacccgaaagggtaaccgtaaacccgttaactttacccgaaagttaacgggaaaccctacggtacctttaacggttacttaaccttaacgaaaacgttacgggtaaaactaccggtaccgtacgggaaacggtaacccgacccggaaaccgtaaccggtaccgggtaccctttaacgtaacgttacggtaacggtcggaacccggggtaggggttacggtacggggaacgggggngggttaccgggacgtaaggttacgggaacgtttaaccggttcggaaaccccggtgggttcgggggtaaccccg

SEQ ID NO: 426968 - DNA, 803 bp, Homo sapiens
  misc_feature: GZ8MTXP01D6Z6C.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagcgtgggtggagacgtgggaggagtacgttgacctacccgaaccgggttcgggggtccctaggacgtacctccgtccgtggtcgccggttccttcgtcggtccaccgtcaacctacctactccagtcgacgtcggtcggtcccgcgacggccgtaccgggaggggacggggtcgtagggaggtcggggtctacgttaagtttagtttaggttaggttggggtggttggtacgaccgtaggtactaccggtcgaaaccgttcccggtcggtagggtaaaccggggtaccttacttaccgaaccgtactcctaaccgaagtaaccgtaactaacttacctaagtaaccgaaaccgtaccgtacgtttacgttaaacttaccctttaaacaaaacgttacgggaaaaacccgtccggtacccgttaaggggaaacccgtacccggaaccccggggaaaccgaacccgggtaacccggggtcccctttaagttaaccgtttacgggtaacggggtacggttaccgggggaagggttacgggtagggggaacgggaggggacggttacgaaggttacgaacgtttacgtcggaccgtaacggggttcggggtaaccg

SEQ ID NO: 426969 - DNA, 679 bp, Homo sapiens
  misc_feature: GZ8MTXP01BZIDK.21.76.G10.1.454.CMB.2.raw
  modified_base (267)..(267): a, c, t, g, unknown or other
  modified_base (299)..(299): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagacgtggaggagacttgactccgaaccgtgggggtccctgagactctcctgtgcggtctcgtggtcnccgtcactacaactccatgagcgtcgggtccnccgaggcctccggaggggaaggggctgggagttgggtctcgtagtttagtttagtaggtggtggtggtgacgtagtacttacgcaaagtaccgtccgggtaggaaacggggtcccgaatttcccgaacctacgttccctaccgaagaagtaacctaattcccaagttacggaaacctaccggtcttagttactacgttaacaaattcggaaactacggacctaggaacgaccgcccggaacgaaccggtaccggtcccgttaacttacgttaccggtggtacggacggggtacggggaggtacgggaacgggggttagggacggggactaaggtgggtaacttacggttacggaccggtaacggggttcgggggaacccg

SEQ ID NO: 426970 - DNA, 723 bp, Homo sapiens
  misc_feature: GZ8MTXP01EPBJI.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtgggggtccctgagactctcctgtgcggtctcgtggtcaccgtcactacaactccatgagcgtcgggtccgcgaggcctccgaggggaggggcgtggaggtgggtctcgtagtttattagtaggtggtggtgtcgcagtatacgcaaagactccggtaggaaacggggcctattaccaacctatcctaccaagacaacaacttccaagttacgaaactacggtacttagttaactactttaacaaaacgttacggggaaaacctacggtacccgtaagggaaaccggtaaccggaccccgggaaacggtaaacccggaacccgggggtccccgtttatttaaacgtttaacccggtgggttcggggaaccggggaaaccggggggttaaggtacgggggaaaccggggggttaagggggaccgggggactaaagggttgggtaaacgtttaaccggtttacgggaaccccggtaacgggggttcggggggaaacccgg

SEQ ID NO: 426971 - DNA, 709 bp, Homo sapiens
  misc_feature: GZ8MTXP01DQGU4.21.76.G10.1.454.CMB.2.raw
  modified_base (657)..(657): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagacgtggaggagacttgactccgaaccgtgggggtccctgagactctcctgtgcgtctcgtggtcacgtcactacactcatgagcgtcgggtccgcgaggcctccggaggggaacggggcgtgggaggtgggtctcgtaagtttatttagtaggtgggtggtgggtgacgagtacttacgactaaacggacttcccggtagggaaaccgggggtcctaactttcccaacccgtatccctaccgaaggtaacgaaactaaacttaccctaaatacggtaaaccaacgttccgttaacgttaacttaccttaaaccgtaaaaagttacgggaaaaccgtacggtaccccgttagggaacggtaaccggaccccgaaaccggaaccgtaaacccgggtccgttaacttacgttaacgtggttacggacggggacggggaggtaggggacggggaaggggnggacgaagtaggaacgttacgttacggaccgtaacgggttgggggaacccgg

SEQ ID NO: 426972 - DNA, 678 bp, Homo sapiens
  misc_feature: GZ8MTXP01EK0JT.21.76.G10.1.454.CMB.2.raw
  modified_base (491)..(491): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagcgtggtggagacgtgggaggagacttgactccgaaccgtgggggtccctgagctctcctgtgcgtctcgtggtcacgtcactactactcatgagcgtcggtccgccgaggcctccggaggggaacggggcgtgggagtggtctcgtagttagttagtggtggtggtgtcgcagtacgtacgcgtaaacgacgtccggtaggaaacgggccgtacgttccaacctactacccgtaccaaggaacgtaacctaacttccaaagttaccgaaaacctcggtacgttataacttaccttaaanaaaacgtcggaaacgcgtaccgtaagggaaccgaccggacccgaaccgtaccgtaccggttcccttaagttacgttcggtaagggtacgggacggggtaacggggaggtacgggggaagggggacggcgggttactaaggtaggtaactttcgggtacggaccggtaacgggggttcggggaacccg

SEQ ID NO: 426973 - DNA, 698 bp, Homo sapiens
  misc_feature: GZ8MTXP01CBYJG.21.76.G10.1.454.CMB.2.raw
  modified_base (321)..(321): a, c, t, g, unknown or other
  modified_base (609)..(609): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagtcttgggttttccttgttactatttaccaaaaggtgttcagtgtgaggtgcagcgtgggtggagacgtgggaggagtacttgactaccgaaccggtcgggggtccctaggacgtactctccgtggtcgtcggtctcgtcggttccaccgtacactacaactcatgacgtcgtcggtccncgaggccgtccggaaggggaggggtcgtagggtaggtcgggtactacgtagtttagtttagtaggtggtggtcggtagcgaagtagttacgacgtaaacgaccgtcggtaggaaacgggtcctaacttaccaaaccgtacttacccgaacgaagtaacgtaaccttaacttaaccagttaaaccgaaccctacgttacgttaagttaactaacgttaaacaaaagtacggaaaccgtcgtaccgaagacgaccgaccgtaacgaccggtccgtacttacttacgtcgngggtccgaggggtacggttagggacggggacggggttaggcgttctaaggtagttaacttacggacgaccggtgggggccggaacccgg

SEQ ID NO: 426974 - DNA, 716 bp, Homo sapiens
  misc_feature: GZ8MTXP01EHFC0.21.76.G10.1.454.CMB.2.raw
  modified_base (276)..(276): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagcgtggtggagacgtggaggagacttgatccaaccgtgggggtcctgagactctctgtgcgtctcgtggtcaccgtcactacaacncatgagcgtggtccgcgaggctccgagggagggctggagtggtctctagttattagtagtggtggtggtcgacgtagtacttacggctaaacgtccgtccgggtagaaacggggtcccgtagtttaccgacctagttccctacccgtaagaacggtaactaaacgttccaattacgaactacgtctagtacttacttacgaaaatcggtaaacgacggtacccgttaggaaacgtacccggcccgaaaccggtaaaccggacccgggttaccccggttaacgtttacgtttaacccgtaaggggtcgggttaaccggggtaaaccgggggttagttaacgggggaacgggggaagggggacgggaaccgtaagggtttaacgggggaacttttaacggtttaccgggaccggtaaccggggttcggggggtaaaccccgg

SEQ ID NO: 426975 - DNA, 630 bp, Homo sapiens
  misc_feature: GZ8MTXP01EOKO4.21.76.G10.1.454.CMB.2.raw
  modified_base (352)..(352): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccgaaccgtgggggtccctgagactctcctgtgcgtctctgggttcaccgtcactacaactccatgagctgggtccgccaggctccgagggaggggcgtggagtgggtctcgtagttattatagtggttggggntcggtgtagagtacgtacgacgacgccgtcgtacggacggacgtactacacactacctacgacgacgaactaactacctacgtacgaactactctatactactactaacgtacgaacgaccgacgacgacgaccgaccggaccgaccggtaccgtaccgtacgtacgtaacgtcggttacggacgggacgggtacgggtacgggacggggacggggacgggtaacgtacggtaacggtacgtacggttaccggtaaccggttaaccggggtaaccggg

SEQ ID NO: 426976 - DNA, 576 bp, Homo sapiens
  misc_feature: GZ8MTXP01AVJSV.21.76.G10.1.454.CMB.2.raw
  modified_base (194)..(194): a, c, t, g, unknown or other
  modified_base (497)..(497): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagagtcaccatcacgttcgccgggcgggtcaggacattagactattattagcctggtatcagcagaaaccagtaaacgtcccaagctcctagatctatgctgcctattcccttctttacggaccctaagtcgaacgggggtccccagttccgttcgggttcgaggttgggcctaaggtgggtaacgtcgtagggacctagtactttacactctcaaccatcacgcacgcctgcacggcctagaacgagtgttagactaactttactactacgtaataaaatataacgtacttaaggttccncccgttactacttaccgtttcgggaccgtaacgacggggtaacccgaagggtacggaactaacgttaaccgtaaaccgg

SEQ ID NO: 426977 - DNA, 714 bp, Homo sapiens
  misc_feature: GZ8MTXP01CNBWJ.21.76.G10.1.454.CMB.2.raw
  modified_base (301)..(301): a, c, t, g, unknown or other
  modified_base (623)..(623): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctgggtggagacgtgggaggagacttgactccgaaccgtgggggtccctgagactctcctgtgcggtctcgtgggttcacgtcactacaactcatgagcgtcgggtccnccgaggctccggaggggaagggggcgtgggaggtcgggtctcgtagtttagtttagtaggtggtggtggtcgacaggtacttacgcgtaagacccgtcggtaggaaacggggcctacgttccaaccctatcccgtacccaaggactaaactaacgttacccaagtacgaaacctaccggtacttacgttaactttaccgttaaactaaaagttacggaaaccgttacggccccgttaaggaacggaaccggacccggaaccgtaccggacccggtcccgttacgttaacgttaccgtgggtacgggaccggggtaacggggnggtaacggggacgggggaagggcggggttacgtaaggtacgggtaacttttacggttaccggaaccggtaacgggttcgggggtaacccgg

SEQ ID NO: 426978 - DNA, 562 bp, Homo sapiens
  misc_feature: GZ8MTXP01E1WFN.21.76.G10.1.454.CMB.2.raw
  modified_base (395)..(395): a, c, t, g, unknown or other
  modified_base (518)..(518): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctcgtgggttcaccgtcactacaactccatgagctgggtcccgccaggctccgaggggaagggggctgggagtggggtctcagtttatttatagtggtggtggtgcagattacgcaagactccgtgaacgggcgatcaccntctccagagacaattccatcgaacacgctgtatcttacaaattcggaacagccctgacgacgcccgacgaccacgggcccgtactattactggtgcggacggggagtcgggaacggggagggngggcaagtgggtaatacgtttgaccctaacggttgggggaaccg

SEQ ID NO: 426979 - DNA, 666 bp, Homo sapiens
  misc_feature: GZ8MTXP01DRSW3.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagcgtggtggagacgtggaggagacttgactccaaccgtgggggtccctgagctctcctgtgcggtctcgtggtcacgtcactacactcatgacgcgtcggtcccgcgaggccgtaccggaggggaacggggcgtagggaggtgggtctcgtagtttatttagtaggtgggtggtggtcgacgagtacgttacgctaacgacgtccgggtagaacgggtaccgtatccaccgtactcctaccaagaacgactaacgttccaaatacgaaacctacgtcttagttaactcttaaacgaaacttacggggaaactcggaaccgttaggaacggaacccgaccccgaagaacccgtaccggtacccgttacttaacgttcgtaaggtcgggacgggacggggttaggtacggggacgggggaaggttcggactaaggttgggaactttcggtagacccggtcggggttcggggaacccg

SEQ ID NO: 426980 - DNA, 665 bp, Homo sapiens
  misc_feature: GZ8MTXP01C6M3V.21.76.G10.1.454.CMB.2.raw
  modified_base (474)..(474): a, c, t, g, unknown or other
  modified_base (485)..(485): a, c, t, g, unknown or other
  modified_base (517)..(517): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctgggtggagacgtgggaggagacttgactccgaaccggtggggggtccctggagactctcctgtgcggtctcgtgggttcaccgtcactacaactccatgacgcgtcgggtcccgcgaggtcctaccggaggggaacgggggcgtgggtaggtggggtcttacgtagttatttagtaggtggtggtggtcgcgagtagttacgcgaaacgtactccggaggaaaccggggccgtacttccgaacctactcctacccgaagtacgaacctaattccctaaanacggtaaaccncggtcttagtaactctaaacaaagtgaaaacncgtaccaggaacgccgacccgacgaacctccgggtccttattacgtccgtggtcgggacgggttacggggaggtcggggacggggaagggcgggactaaggtacggtaatttacccgtggggaccctaagggggttcggggaacccgg

SEQ ID NO: 426981 - DNA, 669 bp, Homo sapiens
  misc_feature: GZ8MTXP01CQAZL.21.76.G10.1.454.CMB.2.raw
  modified_base (593)..(593): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaggtgtccagtgtgaggtgcagctggtggagacgtggaggagacttgatccaaccgtgggggtccctgagactctcctgtgcggtctcgtggtcaccgtcactacaactccatgagcgtgggtcccgccgaggcctccgaggggaaggggctgggagtgggtctcgtagtttatttagtaggttggtgggtaggtcgcgtagtagttaccgcgtaacgaccgtccggtagggaaacggggtcccgtagttaccaacctatccctaccgaagacgtaactaaagttcccaagtaacgaaccacggtacttgttaacttccttaactaaagtacggaaactacggtaccgtaggaacggaccgacccgggaactaaccggaccgggtcccgtacttaagttccgtggtacggcgggtaaccgggggnggtacggggcgggggaggggcggacgtaagtacgggtaacttacggttacgaccgtcgggttcgggggtaacccgg

SEQ ID NO: 426982 - DNA, 727 bp, Homo sapiens
  misc_feature: GZ8MTXP01BKUC6.21.76.G10.1.454.CMB.2.raw
  modified_base (268)..(268): a, c, t, g, unknown or other
  modified_base (280)..(280): a, c, t, g, unknown or other
  modified_base (283)..(283): a, c, t, g, unknown or other
  modified_base (286)..(286): a, c, t, g, unknown or other
  modified_base (658)..(658): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagacgtgggaggagacttgatccgaaccgtgggggtccctgagactctccgtgtgcggtctcgtggtcncgtcactacacncangancgtggccgcaggctccgaggggagggcgtggaggtcggtctacgtagtttaagtttagtaggtggtggtggtgctagtagtacgcgtaagaccgtcggtagaaacggggccgtacgttaccaacctacttcccgacctaagaacgtaacctaaactttacccgaagtaacggaaaccctacggtactttacgtaacctttactttaaaaccaaaagtttcgggaaaaacccgtcggggttacccaagggaacggaaccggaccccgaacggtaaaccccggtaccggttaccccgggttaattaacgttttaaccgtcgggttacgggacccgggggaacggggagggtaacgggggaacggggttaagggnggggttacgtaaggttacgggtaactttaacgggttcgaacccgggtaacgggttcggggggaaccccg

SEQ ID NO: 426983 - DNA, 749 bp, Homo sapiens
  misc_feature: GZ8MTXP01B5WRR.21.76.G10.1.454.CMB.2.raw
  modified_base (293)..(293): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtgggaggagacttgatccgaaccgtgggggtccctgagactctcctgtgcggtctcgtggtcaccgtcactacaactcatgagctggccncagctcgagggaggctggagtgggtctgtagtttatttagtaggttgggtggtaggttcgctagtagttaccgcgaaaggtaccctcccgggtaggaaacggggtcccgtaattcccaacccgtaatccctacccgaaggtaacgtaacctaaacttacccaagttacgaaaccgtaccgtaccgttagtacttaccttaaccgtaaaattacggggaaaaccgtacggtaccccgttagggtaaaccggaaccggaccccggaaacccggaaaccccggtaaccggggtaccccggttaacctttaaccgttaaccgttcgggttaccggaccgggtaaaccgggggttaggtacgggggaaccgggggaaggggttcggggaccgtaaggtacgggtaacgtttaaccggtttacggaaccccgggttaacgggttaacggggggtaacccggg

SEQ ID NO: 426984 - DNA, 557 bp, Homo sapiens
  misc_feature: GZ8MTXP01ESMYG.21.76.G10.1.454.CMB.2.raw
  modified_base (390)..(390): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtgggggtccctgagactctcctgtgcggtctctgggtcacgtcactacaactccatgagctggtccgccaggctccgagggagggctggagtgggtctcagttattatagtggtggtggtgcagattacgcaagactccggtagaagggccatcacatctcaganacaattccatgaacacgctgtatcttacaaatggaaactgccctagagacgcccgaacgaaccacgggtcccgtatacgttactggtcgacggacggggagtgggacggggagggcgggctaaggtgggaatttaccgttggaccctaacgggttggggggaacccg

SEQ ID NO: 426985 - DNA, 712 bp, Homo sapiens
  misc_feature: GZ8MTXP01BN3BL.21.76.G10.1.454.CMB.2.raw
  modified_base (268)..(268): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagcgtggtggagacgtgggaggagacttgactaccgaaccgtgggggtccctgagactctctgtgcgtctcgtggtcncgtcactacactcatgacgcgtcggtcccgcgaggccgtaccggaggggaaggggtcgtgggaggtcgggtctacgtaagtttagtttagtaggtggtaggtggtcgacgtagtacgttaccgcgtaaacgtaccgtcccggtagggaaaccggggaccgtactttaccgaaccctacgtccctaccgaagaacgtaactaaacttccaagtaacgaaacctacgtacgttagttacttacgttaaacaaagttcgaaacgtacgtcccgtaggaacgaccggacccggacgtaaccgccgggtacccttacgttaacgttacggtcggtacggaccggggtagggacggtaggggaacgggggttaagggcgggttaccggtaaggttacggtaacgtttacggttccggaaccggtccgggggttaacgggggaaccccggg

SEQ ID NO: 426986 - DNA, 662 bp, Homo sapiens
  misc_feature: GZ8MTXP01B4DSR.21.76.G10.1.454.CMB.2.raw
  modified_base (486)..(486): a, c, t, g, unknown or other
  modified_base (523)..(523): a, c, t, g, unknown or other
  modified_base (562)..(562): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagcgtggtggagacgtggaggagacttgactccgaaccgtgggggtccctgagactctccgtgtgcggtctcgtggtcaccgtcactactactcatgagcgtcggtccgcgaggcctccggaggggacgggctggaggtgggtctgtagtttatttagaggttgggtggtggtcgactagtacgttacgcaaagaccgtcggtagggaacggggtcctattaccacgtataccctccgaagaacgtaacctaactttccgaattacgaaacctacgtcttagttactaccgtttaanaaacgttcgggaaacaacggtcctaggaaccggaccncccggaaacgaccgtccggtccgttaccttaagttccgngggtaccggcggggtaaacgggttggtaggggacgggggttaagggcggttacgaagtggaactttacgtacgaccggtaacggggttcggggtaacccg

SEQ ID NO: 426987 - DNA, 652 bp, Homo sapiens
  misc_feature: GZ8MTXP01CKCYQ.21.76.G10.1.454.CMB.2.raw
  modified_base (308)..(308): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagactgggaggagacttgactccgaaccgtcggggggtccctgacgactctcctgtgtcggtctcgtgggttccaccgtcactaacaactccatgacgcgtgggtcccncgaggcctacgaggggaaggggctgggagtcgggtctgtagttatttagtggtggtggtacgtgacagtacttagcgaaacgtctcccggtaggaaaccgggggtcctactttccaaccctattacccgtaccgaagaacggaacctaacgttacccagttaacggaaacctcgtactagttactaccgttaaacaagtacgaacgcgtaccgaggacgaccgaccgacgtaccgccgtacgtactacgtcgtcggacggacgggacggttggaaggggacggggaggttcgagtaagtacgttaacgttacggttacggaccggtcgggttaacggggaaccg

SEQ ID NO: 426988 - DNA, 753 bp, Homo sapiens
  misc_feature: GZ8MTXP01CMSBA.21.76.G10.1.454.CMB.2.raw
  modified_base (367)..(367): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagtcttgggttttccttgttactatttacaaaaggtgtccagtgtgaggtgcagcgtggtggagacgtgggaggagacttgactaccgaaccggtggggggtccctgagactctctgtgcgtctcgtggttccacgtcactactaactcatgacgcgtggtccgcgaggctccggaagggacggggctgggagtgggtctcgtagtttattagtagtggtggtggcngagagtacgcgaaagtaccgtcggtaggaaacggggtcctattacccaaccgtacttcccgtacccaaggtaacgacctaaagttcccaaattacggaaacctacggtcttacggtaactttaccgttaacaaaagttcgggaaaacctcgggtaccgttaacggaaacggaacggaccccggaacggtaaaccccgtaccgggttaccccgttaagttaaccgtttaacggtcgggtacgggttaacccggggtaaaccggggggaggttaacgggggaacgggggttacgggggaacggggttaccgtaagggtttaccgggtaaactttacccgggttaagggttaccccggtaacgggggtttaacggggggaaacccccgg

SEQ ID NO: 426989 - DNA, 702 bp, Homo sapiens
  misc_feature: GZ8MTXP01AOXYG.21.76.G10.1.454.CMB.2.raw
  modified_base (301)..(301): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggtagttttggctgagtcttgggttttccttgttactatttacaaaggtgtccagtgtgaggtgcagcgtggtggagacgtgggaggagacttgactccgaaccggtcgggggtccctgacgctctcctgtgcgtctcgtggtccacgtcactacactcatgagtcgtcggccncgacggtcgtccggaggggaggggcgtagggagttcgggtactagtaagtttattagtaggtgggtggtggtcgacgtagtacgttaccgcgtaacgtaccgtccggtaggaaccgggccgtacttaccaaccattacccaccgaagtactaactaacttccaagtacgaaacctcgttactacgttaactacttaaacaacgtacggaactacgaccgtaggaacggaccgacccggtaaccgaacccgacccgggttcccttaagttaacgttcccggtaagggtacgggaccggggaacggggttaacggtcgggggaaccgggggttaggagggttacgtaaggttcggtaacgtttcgtaccgggaaccggtaacggggttcgggggaaaccccgg

SEQ ID NO: 426990 - DNA, 609 bp, Homo sapiens
  misc_feature: GZ8MTXP01CZGRG.21.76.G10.1.454.CMB.2.raw
  modified_base (599)..(599): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccaaccgtgggggtccctgagactctcctgtgtcggtctcgtgggttcaccgtcactacaactccagtgagcgtcgggtcccgccaggctaccggagggaaggggctggagtcgggtctcgtagtttatttatagtgggtggtgtcgcagtatcgctaagacctcggtagaaacgggtcctattaccgacctagtcaccctaggaccgtaacaactttccagtacgaacacgtctagttacttacttaacaaagtcgtaaacgagtacccgtaggaacgaccgcccgtaacggacccgtacgggtcccgtattacgtacgtggtacggccggtaggggagtggggacgggaggcggcaagtggaacttgtcgactaacggnggggtaaccg

SEQ ID NO: 426991 - DNA, 643 bp, Homo sapiens
  misc_feature: GZ8MTXP01BZINX.21.76.G10.1.454.CMB.2.raw
  modified_base (355)..(355): a, c, t, g, unknown or other
  modified_base (401)..(401): a, c, t, g, unknown or other
  modified_base (408)..(408): a, c, t, g, unknown or other
  modified_base (430)..(430): a, c, t, g, unknown or other
tcagtcgtcgctcgcacgaccggtgctcgatttagtcactcatacagggggctgggagaggagcccagcactgggattccgaggtgtttccattcggtgatcagcactgaacacagaggactcaccatggagttttggctgagcttgggttttccttgttactatttacaaaaggtgtccagtgtgaggtgcagcgtgggtggagacgtgggaggagacttgactccgaaccggtgggggtccctgagactctctgtgcggtctcgtgggttcacgtcactacaacctcatgagcgtcgggtccgccgaggctccggaggggaaggggctgggagtgggtctctagttatttagngtgggtgtggtgcaggtatacgcaagactcgtgagggccattcacntctcagngaacattccatagacacgcgtntactcttaacaaattaggggaaacacggtaccaggaaaccgacggcccgaaaccggaccgaaaccggggtcccgttactaacgtttaaccggcgggtacgggacggggtaacgggggttacggtacgggggaacggggaggggacgggttacgtaagttcgggtaacgtttacggttaccggaaccggtaacgggggttcgggggtaaccggg

SEQ ID NO: 426992 - DNA, 600 bp, Homo sapiens
  misc_feature: GZ8MTXP01D465K.21.76.G10.1.454.CMB.2.raw
tcagtcgtcgctcgcacgaccggtgctcgatttagtcactcatacaggggggcagaagtctctctcagtcaggacacagcatggacatgagggtccctgctcagctcctgggactcctgctgctctggctcccagataccagatgtgacatccagatcgacccagtcctccatccctccctgtctgcatctgtaggagacagatcacatcacgttggccgggcggtacaggactattagactattatacgctggtatcagacaagaaacgtaggtaaacttcccaagtctcctagtatctatcgctgctacttcctctttcgacctaacgtcgacggggtccctagttccgttcggtcgaggtcggactagggtggagtcggtacgggtactagtactttacactcctacactatacacgcgacgtcctacgacacggtaccgtaaggtaagtacgttgttacgtaaccttaactttaactaacttaagtaaactaaaattcgtaactacgttacgttcccttcccctacgttaccgttaccgtttcggaccgtaacggacgggtaacgtagggacaaccgtaacgttaacgtaaaccgg

SEQ ID NO: 426993 - DNA, 676 bp, Homo sapiens
  misc_feature: GZ8MTXP01BMPIR.21.76.G10.1.454.CMB.2.raw
  modified_base (298)..(298): a, c, t, g, unknown or other
  modified_base (305)..(305): a, c, t, g, unknown or other
  modified_base (599)..(599): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgactccgaaccggtgggggtccctgacgactctccgtgtgcggtctcgtggtcaccgtcactacactcatgagcgtcggtccncgaggcncgagggaggctggagtggtctcgtagttattagtagtggtggtggtcgacgagtactacgctaacgaccgtcggtaggaaacgggtccgtacttccgaacctagtccctacccgaaagtacggaacctaactttccaaagtacgaaaacctggtccttaaggttacttacctttaaacgaaacgttacggggaaaactcggttacccgtaggaacgaaccggaccccggaacgtaaccgtacccggggtacctttaccgttaacttacggttggagggttaccgggaaacgggngtacgggggaacgggttaggggcgttacgtaaggtcggtaacgtttacggtccgacgaacggggttggggaaccccg

SEQ ID NO: 426994 - DNA, 652 bp, Homo sapiens
  misc_feature: GZ8MTXP01DI2XW.21.76.G10.1.454.CMB.2.raw
  modified_base (299)..(299): a, c, t, g, unknown or other
  modified_base (461)..(461): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttacaaaaggtgtccagtgtgaggtgcagctggtggagacgtgggaggagacttgactccgaaccgtcgggggtcctgagtactctctgtgcgtctcgtggtcacgtcactacaactcatgagcgtcgggtcccncgaggctacggaggggaggggctgggagtgggtctacgtagttattagtaggtggtggtggtcgcaggtactacggcgaaacgtacgttccggagggaaacggggtcctacttccgaacctactcctaccgagtaacgaactaactttaccagtacgaaacncgtacgtataacttcttaaccaaattacggaaacctagcccgtagaacgccgaccgagaccgaccggtcttacttaaactcgtaagcggcgggtaacgggaggtacgggacggggttaggcgggggacttaagggtaggttaaccgtttacgttacgggaacccggtcgggggttcgggggtaaccccggg

SEQ ID NO: 426995 - DNA, 676 bp, Homo sapiens
  misc_feature: GZ8MTXP01BVHDV.21.76.G10.1.454.CMB.2.raw
  modified_base (287)..(287): a, c, t, g, unknown or other
  modified_base (296)..(296): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggtagttttggctgagcttgggttttccttgttactatttacaaaaggtgtccagtgtgaggtgcagcgtggtggagacgtggaggagacttgactccgaaccgtgggggtccctgagactctctgtgcgtctcgtggtcacgtcactacaactcatgancgtggtccncgaggctccggagggaagggctagggagtggtctacgtagttattagtagtgggtgtcggtgcagtattacgctaaacgacctccgggaggtaaacggggcctacttaccacctataccctaccgagacgaactaacttaccagtacgaaactacgtcttagtaacttcttaactaaagtacgggggaaactacggacccgtaggacgaaccggccccgaaacgaacccgaccgggtccttaccgttaaactttcccgtggttacgggcggggtaaacggggttagggttacgggaaccgggggttgggacggggttaccgaagggttcgtaaccggtttacgttccgggaacccgtcgggggttcgggggaaccccggg

SEQ ID NO: 426996 - DNA, 725 bp, Homo sapiens
  misc_feature: GZ8MTXP01CIH4U.21.76.G10.1.454.CMB.2.raw
  modified_base (283)..(283): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagcgtggtggagacgtgggaggagacttgactccgaaccgtgggggtcctgagactctcctgtgcgtctcgtggtcacgtcactacactccangacgcgtcgggtcccgccgaggccgtccggaaggggaaggggcgtgggaggtgggtctcgtaagtttatttagtaggtggtggtggtcgctagtacgttacgctaaacgcgtccggtagggaaacggggtcctaatttccgaaccgtatcctacccgaagaacgaactaaacttacccaagttacggaaacctagtacccgttagttaacttacttaacgaaaacgttacgggaaacctagggtcccctaaggaacggaaccggtaccccggaaccgaacccggaaccgggtcccgttacgttaacggttaacccgtgggttaccggggaccgggtaaaccgggggaggttaaccgggggaacggggaggggaccgggttacgtaagggtacggtaactttacggttacgggaaccggttcggggcggggggtaaaccccgg

SEQ ID NO: 426997 - DNA, 698 bp, Homo sapiens
  misc_feature: GZ8MTXP01BAE4K.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaagtgtccagtgtgaggtgcagcgtggtggagacgtgggaggagacttgactccgaaccggtgggggtccctgagactctccgtgtgcggtctcgtggtcaccgtcactacaactccatgagcgtcggcccgcaggctccggagggagggcgtggagtcgggtctcgtagtttagtttagtaggtggtggtggtcgcagtatacgacaagaccgtccggaggaacgggccgtattacccacgtacttcctaccgaagaacgtaactaacctttcccgaataacggaaaccacgtacgttagtacttaccttaacaaacttacggggaaactcggtacccgtaaggaccgaaccgggaccccggaaaccgtaccggaccggtccccggttaattaccggttaccgttaagggtcgggacccgggtaacgggggacggtaacgggggaacggggagggggttacgggaccgtaagggttacgggtaactttaccgggttacggaaccccggtggggttccggggggaaccccg

SEQ ID NO: 426998 - DNA, 749 bp, Homo sapiens
  misc_feature: GZ8MTXP01EDG1U.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggtagttttggctgagtcgttgggttttccttgttactatttacaaaaggtgtccagtgtgaggtgcagcgtggtggagacgtggaggagtacttgactaccgaaccggtcgggggtccctgacgtactctcgtgtgcggtctcgtggtcaccgtcactactactcatgacgcgtcggtccgcgaggcctccggagggagggcgtgggagtgggtctagtagtttagtttagttaggtggtggtggtcgacgtagtacgtacgacgtaaacgtaccgtccgggtagggaaacgggtcccgtaacttcccaaccgtacttacccgtacgaaaggaacctaaactaaacctttccaaagttaacggtaaaacctccggttcttaacgttaaacttcctttaaaacgaaaacgttacgggaaaaccgtcggttaccccgtaaggggaaaccgaaccccggaccccggaaacgaaaccggtaccccgggttacccctttaatttaaagttcccggtaaggtccggggaacccgggtaaggggttaggacggggtaacggggaggggagttcgtaaggtggtaacgttaacgttcggaaccccggttaaggggcggggtaaaccccg

SEQ ID NO: 426999 - DNA, 603 bp, Homo sapiens
  misc_feature: GZ8MTXP01EZX12.21.76.G10.1.454.CMB.2.raw
  modified_base (333)..(333): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcgtggttttccgtgttagctatttagaaggtgtccagtgtgaggtgcagctggtggagtctgggggagcttggtccagcctggggggtccctgagactctcctgtgcagcctctggattcacctttagagctattggatgagctgggtccgccagggctccgaggggaagggctggagtggggtggccaanagtaaagcaagatggaagtgagacaaatactaatgtggacttcgtgtaggaagggccgtattcaacctatactccaagacgaacaacggacccaaaggaccgactacgtacttggtacttcgtacgaacgaaacgtaacgaacgacgtaccgtacgtagacgtacggaacggaacggaacggttacgtacgttagttacgttaacgttagttcggacggaacgtacgtaacccgttaccccgttaccggttacgtaacgttaacgtaagg

SEQ ID NO: 427000 - DNA, 595 bp, Homo sapiens
  misc_feature: GZ8MTXP01BL915.21.76.G10.1.454.CMB.2.raw
  modified_base (285)..(285): a, c, t, g, unknown or other
  modified_base (452)..(452): a, c, t, g, unknown or other
  modified_base (458)..(458): a, c, t, g, unknown or other
  modified_base (462)..(462): a, c, t, g, unknown or other
  modified_base (474)..(474): a, c, t, g, unknown or other
  modified_base (482)..(482): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagacgtgggaggagacttgactccgaaccgtgggggtccctgagactctcctgtgcgtctcgtgggttccaccgtcactactaacnccatgacgcggtcggtcccgcgcgtccgtacgggaggggacggtcggtaggtggtcggttctacgttagtttagttagtggtggtaggtggcgacgtagtacgtacgacgtaacgtacgtcggaggacgggtcctactaccgactctccacgaagacaactactcanacgacncgtntatactctaaanagtagacncgtcagacgcgacgacgaccgcgtcttatacgtgtgcggacgggaggttggacgggacgggaggcgagtaaggtacgttaagttacgtcggacggtaacggggcgggaaccgg

SEQ ID NO: 427001 - DNA, 576 bp, Homo sapiens
  misc_feature: GZ8MTXP01A8LGM.21.76.G10.1.454.CMB.2.raw
  modified_base (289)..(289): a, c, t, g, unknown or other
  modified_base (298)..(298): a, c, t, g, unknown or other
  modified_base (427)..(427): a, c, t, g, unknown or other
  modified_base (439)..(439): a, c, t, g, unknown or other
  modified_base (538)..(538): a, c, t, g, unknown or other
  modified_base (564)..(564): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtgggaggagacttgactccgaaccgtgggggtccctgagactctctgtgcggtctcgtggttcaccgtcactactaactccatgancgtggtccncaggctccgagggagggctggagtgggtctacagtttattagtagtggtggtgtgctagattcgcaagactcggtgaacgggcctattccaccatcctaccaagacgaactaattcccaatacgaaacncgtctgtaactnttaacaaattgggaaacagtcctggaacgcgcgaacgtacgaccgggtcctattactacgtgtcggccggaagggttgagggacggggagggcgttagngtggtaactacgttggaacccgtggngggggtaacccg

SEQ ID NO: 427002 - DNA, 686 bp, Homo sapiens
  misc_feature: GZ8MTXP01BJSQV.21.76.G10.1.454.CMB.2.raw
  modified_base (294)..(294): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggtttttccttgttactatttcaaaagtgtccagtgtgaggtgcagcgtggtggagacgtggaggagacttgatccgaaccgtgggggtcctgagactctctgtgcggtctcgtggtcaccgtcactacactcatgagcgtcggtccncaggcgtccgaggggagggcgtggaggtgggtctcgtagtttagttagtaggtggtggtggtcgctagtagttacgacgtaaagtaccgtccggtagggaaaccggggtccgtactacccgaaccgtacgtccctaccgaaagaacgtaactaacttacccagttaacgaaactacgtcgttagtacttctttaaacaaaacgttcgggaaacctaggtccgtaaggacggacccgaccggtaaaccggacccgtaccgggtacccgttactaaggttacccgtgggtacggaccggggaacggggttaggtcggggaacggggttaggggacggcgttaaggtaggtaacgtttacgttcgggaacccgtaacggggttcgggggaacccg

SEQ ID NO: 427003 - DNA, 774 bp, Homo sapiens
  misc_feature: GZ8MTXP01AP5WA.21.76.G10.1.454.CMB.2.raw
  modified_base (314)..(314): a, c, t, g, unknown or other
  modified_base (332)..(332): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggtagttttggctgagcttgggttttccttgttactatttacaaaaggtgtccagtgtgaggtgcagcgtgggtggagacgtgggaggagtacttgactacccgaaccggttcgggggggtcccctaggaacgtaccttcgttcccgtggtcggtccggtctcgtgggttccaccgtcactactacncatgacgtcgtcggtccncgaggcctaccggaaggggacggcgtggaggtcggtctacgtagtttattagtaggttggtggtgtcgctagtagttcgacgaacgtacccgtcgtagggaaaccggggtccttacttaccgaccctataccctaccgaagaacgtaactaacttacccgaagtacgaaacctgtacttaaggttacttaccttaaacgaaagtacgaacgtacggtaccgttaacggacggaacccggggacccgaacccgggaaaccccgggtaacccggttcccgggtttaaacttaaaaccggttttcccgggaacggggttccgggaaccggggggaaacgggttggggtaaacgggggaaccggggggttaggttacccgggagtaagggttcccgttaagttccggtaccggttaaccggtaacgggggcgggggtaaaccccgg

SEQ ID NO: 427004 - DNA, 727 bp, Homo sapiens
  misc_feature: GZ8MTXP01D2O0D.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagtcttgggtttttccttgttactatttacaaaaggtgtccagtgtgaggtgcagcgtgggtggagacgtggaggagtacttgactccgaaccggtgggggtccctagacgtactctccgtgtggcggtctcgtggtcaccgtcactactactcagtgacgcgtcgggtccgcgacggccgtacggaggggaggggcgttagggagtcgggtctacgttaagtttaagtttagtaggttggggtggtaggtcgagtaaggtacgttacgcgtaaacgtaccgttcgggtagggtaaacccggggtcctaacgtacccaacctcgtaccctaaccgaaggaaactaactaattaccaagttaaccggaactacgttctagttaacttaccttaaagaaacttcggggaaaactcgtaccgtaggaaccgaacgcccgaacgaccgtccggtacccttattcttaccggtggtcgggaaccggggtaaggggttcggtacgggggaacgggggaggggaagttacgtaaggttaaacggttctttaacggttccggaacccgggttaacgggttcgggggtaaacccgg

SEQ ID NO: 427005 - DNA, 774 bp, Homo sapiens
  misc_feature: GZ8MTXP01CBOXL.21.76.G10.1.454.CMB.2.raw
  modified_base (297)..(297): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcgtggttttcctgttactattcaaaggtgtcagtgtgaggtgcagctggtggagacgtgggaggagacttgatccgaaccgtgggggtccctgagactctccgtgtgcgtctcgtggttccacgtcactactaactcatgacgcgtcgggtcccnccgaggcctaccggaggggaaggggctgggaggttgggtctacgtagtttattagtaggtggtggtggtcgctaggtactacggcaaacgtaccttcccggtagggaaaccggggtccctaaacgtttcccaaacccgtaacgttccctaacccgaaggaacggtaaacctaacgtttaccccaagttaacgaaaacccgtaccggtaccttaaggttaacttacccgttaataaaacgttacgggggtaaaccctaaacgcccggttaaaggaaacggtaaccgaaccccggtaaccggaacccggtaacccggggttcctaaccgttaacgttaccgtaaggggttacggaccggggaaacggggttacggtaagggggaaccgggggttaaggggaccggggacgtcgggtaagggttaacgtttaacccggtttacggaaccccgggtaacggggttcgggggggaaccccgg

SEQ ID NO: 427006 - DNA, 680 bp, Homo sapiens
  misc_feature: GZ8MTXP01CETID.21.76.G10.1.454.CMB.2.raw
  modified_base (293)..(293): a, c, t, g, unknown or other
  modified_base (357)..(357): a, c, t, g, unknown or other
  modified_base (400)..(400): a, c, t, g, unknown or other
  modified_base (565)..(565): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagactggagagacttgatccaaccgtgggggtccctgagctctcctgtgcggtctcgtgggttcaccgtcactacaactccatgagctgggccnccaggctccgagggaggggctgggagtgggtctgtagtttatttataggtggtgggtgtgcagnttacgcaagactcgtagaacgggccgtatccactatctaccanacgactaagttcccagtacgaaaccacgtcttacgtacttaccttaacaaagttcgggaaactacgggtaccctagggaacggaccgaccccggtaacggaaccccgtaccggggtaccccttagtaacgtttccgtgggttacggacccggggtaaacgggggngtaacccggggggaacggggaacgggggagggttacccgaagggtttaccggggtaacgtttacccggttttaccgggaaacccgtaaccgggggtttcggggggaaacccccgg

SEQ ID NO: 427007 - DNA, 761 bp, Homo sapiens
  misc_feature: GZ8MTXP01DHFI1.21.76.G10.1.454.CMB.2.raw
  modified_base (305)..(305): a, c, t, g, unknown or other
  modified_base (694)..(694): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagtcttgggttttccttgttactatttcaaaaggtgtccagtgtgaggtgcagcgtgggtggagacgtgggaggagacttgactccgaaccggtgggggtccctgagactctcgtgtgcgtctgtggtcaccgtcactactaactccatgacgcgtcgggtcccncgacggccgtaccggaagggggaggggcgtagggtacggtgggtcttacgtagtttagttagtaggttgggttggtggtcgtcgagtacgttacgcgtaaacgtaccgtccgggtgggtaaaccgggaccgtaacttaccaaccgacttacccgaccgaagaagtaacctaacttcctaaagtaacgaacctacgtcttaagttacttacttaaacgaaacgttacggaaaccgacggtacccgtaagggaaaccgaccgggtacccgaaacggtaacctagggttcccggtacccgttaatttaacgttaaccggtagggttacgggacccgggggttaaacgggaggggttaacgggggaacgggggttacggggttaaccggggtntaaggggttaacggttaacggtttaccgggtttccggaaaacccgggttcggggttaaaccgggggg

SEQ ID NO: 427008 - DNA, 680 bp, Homo sapiens
  misc_feature: GZ8MTXP01A456B.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtgggggtccctgagactctctgtgcggtctcgtggttcacgtcactacaactcatgagtcgtggtcccgcaggctccgagggaggggctgggagtgggtctcgtagtttagtttagtaggtggtggtggtcgcgaggtatttaccggcaaacggtaccgtccggtagggaaacggggcccatttaccgaccatcctaccgaagacaactaattcccaatacgaaactacgtctagtacttcttaacaaaacgtcggggaaacacggttcccgaggaacgaccgtacccgaaggaacccgaccggggtcccttacttaacgttacccggtggtaggttacccggggaaacggggttagggttacggggaacccgggggagggacggggacctaagggttacgggtaacgttaaccggtttcgggaaccccggtaacggggttcggggggaaccccg

SEQ ID NO: 427009 - DNA, 574 bp, Homo sapiens
  misc_feature: GZ8MTXP01EXUC1.21.76.G10.1.454.CMB.2.raw
  modified_base (232)..(232): a, c, t, g, unknown or other
  modified_base (309)..(309): a, c, t, g, unknown or other
  modified_base (366)..(366): a, c, t, g, unknown or other
tcagtcgtcgctcgcacgaccggtgctcgatttagtcactcatacaggggggcagaagtctctctcagtcaggacacagcatggacatgagggtccctgctcagctcctgggactcctgctgctctggctcccagataccagatgtgacatccagatcgacccagtcctccatccctccctgtctgctatcgtaggtaggacacagtactccaccatcacgttcggccgggnggtacaggactattagactattatagctggtatcagacaagaactagtaaactccaagctctagtactctagtcgtntcgactacttccttacgtttagacctaacgtcggacgggtccctagtcgttcgtcgngtgctagtgatcgtggatagtacttcactcacacgatcagcacgctagcacgggctagaaacgtgttacgtactaacttaacttaattaacgtaagtaaaacctaaattagtaacgtacgttacggtcccttcccttacgttaccttaccggttcgaccggtaacggaacggaaccgtaaggggtcgaacctaacgttaacgaaacgg

SEQ ID NO: 427010 - DNA, 769 bp, Homo sapiens
  misc_feature: GZ8MTXP01EKY9L.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtgggggtccctgagactctcctgtgcggtctcgtgggttcaccgtcactacaactccatgagcgtcgggtcccgaccaggcctccggaaggggaagggggtcgtagggaggttcggggtctacgtaagtttagtttagtaggttgggttggtggttgccgaaggtagttaccgacgaaacgtaaccgtcccgggttagggaaacgggggtcccgtaacgtttacccgaacctaacttacccgttacccgaaaggaaaccggtaaacctaaactttccccaaagttaacgaaaccctaccggtaccttagtaacttacctttaaacgaaaattcggggaaaactacgggtacctaaggaacgaccggtacccggaacgaaaccgtaccggtcccgttacttaaacgttccgtgggttcggacccgggggaaacggggttagggtacgggggaaaccgggggaggggaacgggaccgtaaggtcgggtaaattttaacccgggttacggaaaccccggtaacggggttaacggggggaaaccccgg

SEQ ID NO: 427011 - DNA, 621 bp, Homo sapiens
  misc_feature: GZ8MTXP01EYNQO.21.76.G10.1.454.CMB.2.raw
  modified_base (188)..(188): a, c, t, g, unknown or other
  modified_base (263)..(263): a, c, t, g, unknown or other
  modified_base (471)..(471): a, c, t, g, unknown or other
  modified_base (554)..(554): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtncagctggtgagactggaggagacttgactccgaaccgtggggggtccctgagactctctgtgcgtctcgtggtcncgtcactacactcatgagcgtcggtccgccaggcctccggagggagggggcgtggagtggggtctgtagttagtttagtaggtggtggttggtcgacgtagattacgcgaagaccgtccggtaggaacgggccgtataccaccgtactcccgtaccaagacgaactaaattccaatcgaaactcgacttgactactacaaatggaacngcctgacgagccccgaagaccgaccgggtccttaacgtacgtttaaccgtggtacggcggggaacggggttggtaacgggggnaacgggggaggggacgggcgtaggtaacggtagttacggttacgtaaccggttaaccgggtcggggg

SEQ ID NO: 427012 - DNA, 830 bp, Homo sapiens
  misc_feature: GZ8MTXP01BZJGM.21.76.G10.1.454.CMB.2.raw
  modified_base (316)..(316): a, c, t, g, unknown or other
tcagtcgtcgctcgcacgaccggtgctcgatttagtcactcatacaggggctgggagaggagcccagcactgggattccgaggtgcttccattcggtgatcagcactgaacacagaggactcaccatggtagttttggctgagtcgttgggtttttccttgttacttatttacgaaaaggtgtccagtgtgaggtgcagcgtggtggagacgtgggaggagacgttgactcccgaaccggttcgggggtccctaggacgacttcgtccgtgtcggtccggttctcgttcggtacctaccgtctactactacctccngtgacgtcgtcggtcccgcgacggcgtaccggagggggacgggtcgtagggtaggttggttcttagtttagtttagtttagttaggggttggggtgggttcggtgtacgtaaggtaaacgttcggtaaaccgtaacggtaaccgggtccgtaacggggaaaccgggtccgtacgttacccaacgtaccttctaacgaacggtaacaacttaaacctttaccgaaacgttacgaaaccgtccgttcttaacgttaacttactttaaaaccgaaagtaccggtaaactaccgtaacgggtccggaaggacccccggttaaccggggaaacccgcccggtaacccgggtttacccgttaaccgtttaaggttttaacccggagggggttaccgggacgggggttaaaccgggggaaggggttacgggggaaccgggggttggggaccggggtaattggggtaacgtttaacggttacgtttacccggggaaccgggttaacgggggttccccggggg

SEQ ID NO: 427013 - DNA, 658 bp, Homo sapiens
  misc_feature: GZ8MTXP01A4Z7V.21.76.G10.1.454.CMB.2.raw
  modified_base (502)..(502): a, c, t, g, unknown or other
  modified_base (577)..(577): a, c, t, g, unknown or other
  modified_base (596)..(596): a, c, t, g, unknown or other
  modified_base (615)..(615): a, c, t, g, unknown or other
tcagtcgtcgctcgcacgaccggtgctcgatttagtcactcatacagggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgactccgaaccgtgggggtccctgagactctctgtgcgtctctgggtcacgtcactactaactccatgagcgtcgggtccgcgacggctccgagggggaagggctgggagtgggtctctagtttatttagtaggtgggtggtaggtcgctagtacgttacgctaaggacctcggtaggaacggggccgtacttccgaacccgtattcccacccgaaggaacgaaactaaactttcccgaaagtacggaaacaccggtaccttagggttaacttacccgtttaaaanaaacgttacggggaaacgtcgtacccgtaggaacgaccggtacccggaacgtaccgaccggtacctatagttcgnggtcggacgggtacggggngacggggagggagggcggntaaggtcgtaacttacggtcggaaccgtggggcggggtaaccg

SEQ ID NO: 427014 - DNA, 646 bp, Homo sapiens
  misc_feature: GZ8MTXP01ETNJR.21.76.G10.1.454.CMB.2.raw
  modified_base (283)..(283): a, c, t, g, unknown or other
  modified_base (295)..(295): a, c, t, g, unknown or other
  modified_base (490)..(490): a, c, t, g, unknown or other
  modified_base (580)..(580): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggtagttttggctgagcttgggtttttccttgttactatttacaaaaggtgtccagtgtgaggtgcagcgtgggtggagacgtgggaggagtacttgactcccgaaccggttcggggggtccctggacgtactctcgtgtgcgttctcgtcggtcncgtcactacacncatgacgcgtcggccgcgaggctcgggagggacggggctggaggtggtctacgtatttattagtggtggtggtggtgctagtactacgcgaaacgtaccgtcgggtacggaacggggtccctactttacccgaaccgtacttacccgaccgaaaggaactaaccttaacttaccgaattaaccggaactacggtntacggttactacgtaacgaatacggaacacgtcgtaggacgacgtcccggaacgacgtccggtcgttatacgttcgaaggtcggacgggngggttaggcgggaggggagggcgcgtaagtaggtaactttacgcggacggtcggttcggggaaccg

SEQ ID NO: 427015 - DNA, 628 bp, Homo sapiens
  misc_feature: GZ8MTXP01B8002.21.76.G10.1.454.CMB.2.raw
  modified_base (575)..(575): a, c, t, g, unknown or other
tcagtcgtcgctcgcacgaccggtgctcgatttagtcactcatacaggggctggggagaggagcccagcactgggattccgaggtgtttccattcggtgatcagcactgaacacagaggactcaccatggagttttggctgagtcttgggttttccttgttactatttcaaaaggtgtccagtgtgaggtgcagctgggtggagacgtggaggagacttgactccgaaccggtggggggtccctgagactctcctgtgcggtctcgtggtcaccgtcactactaactccatgagcgtcgggtcccgcaggctccggaggggaggggctagggagtggggtctcgtagttatttagtggtgggtgggtgtgcagtagttacgcaaagacctcggtaggaaacgggcctatccaactactcctaccagtaacactaacttccatacgaaccacgtctagttactacttaacgaaattcggaaacgtagccctaggaagaccgcccggaaccgaccgacggtaccgttactaacgttacgtggtcgacggggtacgggaggtacgggaggggacgggngggactaaggtggtaacgttcgttacggaccgtaacgggttcgggggaacccg

SEQ ID NO: 427016 - DNA, 681 bp, Homo sapiens
  misc_feature: GZ8MTXP01A1HNR.21.76.G10.1.454.CMB.2.raw
  modified_base (284)..(284): a, c, t, g, unknown or other
  modified_base (294)..(294): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagtcttgggttttccttgttactatttcaaaaggtgtccagtgtgaggtgcagctggtggagacgtggaggagacttgactccgaaccgtgggggtcctgagactctctgtgcgtctcgtggtcacgtcactacactcatgacncgtcggtccncgaggcctacgagggagggctggagtggtctgtagttattagtaggtggtggtgtcgacagtagtacgcaacgtactcggagaacgggtcctacgtccaactacttaccaccgaggaaccaccttaaattccgaaagtaccggaaacctcgtcgttacgttactaaccgtttaacaaaacgttcggggaaactacggggtcctaagggaaccgcggaccccgaaggtaacccgtaccggtcgttaacttacgttaccggtcggggtacgaccggggtaaacgggggttacgtacgggggaacgggggaggggacgggttcctaagggttcgggtaaactttcccgggttacgggaccccgggtaaccggggttcggggggaacccgg

SEQ ID NO: 427017 - DNA, 716 bp, Homo sapiens
  misc_feature: GZ8MTXP01A8HH2.21.76.G10.1.454.CMB.2.raw
  modified_base (655)..(655): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagtcttgggttttccttgttactatttacaaaaggtgtccagtgtgaggtgcagcgtggtggagacgtggaggagtacttgactacccgaaccggtcggggggtccctaggacgtacctccgtccgtggtcggtccggttcttcggttcgggttccacccggtcaactactaacctccaagtcgacgtcgtcgggtcccgcgaggccgtccggaaggggaggggtcgtgggagtgggtctcgtagtttattagtggtggtggtggtcgacgtagtacgttacgcaaacggtaccgtccggagggtaacgggcctacgttccaacctctccgtaccaagtacgactaacttcccaattaccggaaactacgtcttagtacttaccgttaacaaaagttcgaaactacgtaccgtaggacgtaccgacccggtaacgacccgtacgggttacccttacgttaaacgttcggtaaggtccgggaccggggtaacggggttaggtacgggggaacgggngggacggttacgtaagtaggttaacgttacgttaccggaccgtcgggttcgggggaacccg

SEQ ID NO: 427018 - DNA, 726 bp, Homo sapiens
  misc_feature: GZ8MTXP01DWCM6.21.76.G10.1.454.CMB.2.raw
  modified_base (313)..(313): a, c, t, g, unknown or other
  modified_base (645)..(645): a, c, t, g, unknown or other
  modified_base (668)..(668): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttacaaaggtgtcagtgtgaggtgcagctgggtggagacgtggaggagacttgactcccgaaccggtggggggtccctaggacgtacttctccgtgtcgtcggtcttcgtggttccaccgtcactacaactcagtgagcgtcgggcccncgaggccgtaccggaaggggaggggtcgtgggaggttacggggtcttacgtaagtttagtttagtaggttggggtgggtggtggacgtaggtacgttacggaccgtaaacgtaccgttccggggtaggaaacccggggtcctaacgtttacccacccgtaaactccctaacccgaaggtaacgaacttaaaccgttccaagttaacgaaacctcgtacttagttaacttcttaaaacaaacgttacggaaacgacgtccgtaggaacgaccgaccggaacaccggaccgtccgttaccttagttaaccgtggtcgggaccgggtaacggggnggtacgggggaacggggaggggnggacgtaaggtacgtaagtttaccgttacggaccgggtaacgggttcgggggaacccg

SEQ ID NO: 427019 - DNA, 698 bp, Homo sapiens
  misc_feature: GZ8MTXP01D35EK.21.76.G10.1.454.CMB.2.raw
  modified_base (300)..(300): a, c, t, g, unknown or other
  modified_base (647)..(647): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagacgtgggaggagacttgactccgaaccggtgggggtccctgagctctccgtgtcgcgtctcgtggtccacgtcactacactcatgacgtcgtcggtccncgaggctaccggagggacgggcgtggaggtggtctacgtagtttagtttagtagggttggtaggtcggtgacgtagtacgttacgacgtaaacggtaccgtcgggtacgggaaacgggtcccgtaacttacccaaccgtacgttccccgtaacgaacggtaaacgtaaaccttaactttaccccgaaagttaacggaaaccgtacgtccgttaagttaaccttacttaaacgtaaacgttacggaaacgtacgtaccgtaggaaacgaccggacccgacgaaccgcccgtacgttaccttagttccgtgggtcggaccgggagggttacgggaggggaccggggagngggacgtaagtaggtaacttcgtacggacccgtaagggttcggggtaaccg

SEQ ID NO: 427020 - DNA, 594 bp, Homo sapiens
  misc_feature: GZ8MTXP01CRSQV.21.76.G10.1.454.CMB.2.raw
  modified_base (283)..(283): a, c, t, g, unknown or other
  modified_base (514)..(514): a, c, t, g, unknown or other
  modified_base (531)..(531): a, c, t, g, unknown or other
  modified_base (548)..(548): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagcgtggtggagacgtgggaggagacttgactccgaaccgtgggggtccctgagactctcctgtgcggtctcgtggtcaccgtcactactaacnccatgagcgtggtccgccgaggcctccgaggggaggggctagggagtgggtctcgtagttatttagtagtgggtggtggtcgcgagtagtacgcaagtactccggtaggaaacgggccgtatccgaccatcctacagactacattccaagtacgacacgctagttactcttacaaatcgggaaactgaccgtagacgcgacccgagaaccgtccgtcgtacttagttccgnggtcggcggtaacgggngtagggcgggttaaggngttacaagtggtaacttacgttgaccgtaacgggttcggggaaccg

SEQ ID NO: 427021 - DNA, 703 bp, Homo sapiens
  misc_feature: GZ8MTXP01AN5TH.21.76.G10.1.454.CMB.2.raw
  modified_base (309)..(309): a, c, t, g, unknown or other
  modified_base (666)..(666): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagcgtgggtggagacgtgggaggagtacttaggacttaccgaaccggtcggggggtccctagacgtacttccgtccgtggtcgcggttcttcgtcggtaccaccgtacaactacctacnccagtcgagtccgtcgggtcccgccgacggccgtaccgggaaggggaacgggggtcgtaggggtacggttgggttacgtcgtttaaggttttaagtttaggttaggttggggttggtcggttagaccggtagtacgttaccgcgtaaacgtaccgtcgggaggaaccggggtcctacgtacccacgtacgttacccacgtacgtaaacgaacttacgttacctagaaccgtaactcggtaacttagtacttaccttaaagaacttaacgggaactcggtacagacgccgacgacgtaccgtccgtcgttaacttcgtaagtggtacggacggagggttagacggggcggagggcggntaaggtcgtaattcgtagaccgtgggttcggaacccg

SEQ ID NO: 427022 - DNA, 670 bp, Homo sapiens
  misc_feature: GZ8MTXP01AOPU3.21.76.G10.1.454.CMB.2.raw
  modified_base (305)..(305): a, c, t, g, unknown or other
  modified_base (390)..(390): a, c, t, g, unknown or other
  modified_base (503)..(503): a, c, t, g, unknown or other
  modified_base (589)..(589): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagtcttgggttttccttgttactatttacaaaaggtgtccagtgtgaggtgcagcgtggtggagacgtggaggagacttgactaccgaaccggtgggggtcctgagctctctgtgtcgtctcgtggtcaccgtcactacaactccatgacgcgtcggcccgacgnggccgtaccggaggggaagggcgtggaggtcgggttactacgtagtttaagtttagtaggtggtaggtcggtgacgagtatacgnaacgtacctcggagaacgggcctacttccacatccctaccgagaacgtaacctacttaccgaagtacgaacctacgtcttagttaactaccttaaacgaaatacggggaaacncggtacctaagggaccacggacccgaaacggtaacccgccggtaccgttattaaactccggtgggtaccgggaggggaacccgggnggttacggggaaacgggggttgggaggttcaaggtgggtaacttacccggtgaacccggtggggttaaccggggaacccgg

SEQ ID NO: 427023 - DNA, 650 bp, Homo sapiens
  misc_feature: GZ8MTXP01B7LX0.21.76.G10.1.454.CMB.2.raw
  modified_base (286)..(286): a, c, t, g, unknown or other
  modified_base (325)..(325): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttacaaaaggtgtccagtgtgaggtgcagcgtggtggagacgtggagagacttgacgtccgaaccgtcgggggtccctgacgtactctctgtcgtcggtctcgtggtccacgtcactacacncatgagcgtcggccacgaggcgtccggaaggggacgggngtagggaggtcgggtctacgtagtttagttagttaggtcggtggtggtacgtgaagtacgttacgcgtaacgtacgtcggtaagggacgggaccctagttaccaccgtactcccactaaggaactaactacgttaccaaagttaacgaacctacgtacttagttaacttacctaacgtaaagacggtaactaccgactaggaacgaccgccggaaacgtacgaaccgtccgtatacttcggtgcggaaccgggagggttagacggggacgggttagggcggttataaggtacgtaattcgtacggacgtcggttcggggaacccg

SEQ ID NO: 427024 - DNA, 587 bp, Homo sapiens
  misc_feature: GZ8MTXP01COJ33.21.76.G10.1.454.CMB.2.raw
  modified_base (287)..(287): a, c, t, g, unknown or other
  modified_base (537)..(537): a, c, t, g, unknown or other
  modified_base (545)..(545): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactgggaggagacttgatccgaaccgtgggggtccctgagacgtctcctgtgcggtctcgtggttcacgtcactacaactccatganctggtccgcaggctccgagggaggggctggaggtggtctctagttatttagagtggtggtgtcgctagtatacgcaagactccggtgaaacgggccgtaatcaacctatcctaccagacaactaagttaccataagaaccaacggtcctaggttactcgttaacaaagttgggaaactaaggccctagaacgcgaccgacgaaccacggtccgtactacttctaaggtcgaccgggtagggaggtaaggngggagggngggcaagtggaataccgttagcctaacggttcgggggaaccg

SEQ ID NO: 427025 - DNA, 661 bp, Homo sapiens
  misc_feature: GZ8MTXP01BBDA7.21.76.G10.1.454.CMB.2.raw
  modified_base (302)..(302): a, c, t, g, unknown or other
  modified_base (320)..(320): a, c, t, g, unknown or other
  modified_base (386)..(386): a, c, t, g, unknown or other
  modified_base (395)..(395): a, c, t, g, unknown or other
  modified_base (420)..(420): a, c, t, g, unknown or other
  modified_base (428)..(428): a, c, t, g, unknown or other
  modified_base (447)..(447): a, c, t, g, unknown or other
  modified_base (451)..(451): a, c, t, g, unknown or other
  modified_base (467)..(467): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggtagttttggctgagtcttgggttttccttgttactatttacaaaaggtgtccagtgtgaggtgcagcgtggtggagacgtgggaggagtacttgactacccgaaccggtcggggggtccctaggacgtactctccgtggtggcggttctcgtcggtccaccgtcactactacncatgagcgtcggccgcgnggccgtaccggagggagggcgtgggtagtcggtctacgtagtttagttagtaggtggtggtgtcgngagtatcgntaacgcgtcgaggacggcatccacntcacaganaactacgtcagtacgaacncgtntagttataccgttaanaaagtcgaaacgtcgacgacggaacgacccggtccgaaccggaccggtacccgggttcccttaagttacgttacggtggtacgggaccggggaaggggttacggacgggggaacggggttagggaggttccggtaaggttcggtaaccgttttacggtcgggaaccccggttaagggggttccggggaacccgg

SEQ ID NO: 427026 - DNA, 553 bp, Homo sapiens
  misc_feature: GZ8MTXP01B75AX.21.76.G10.1.454.CMB.2.raw
  modified_base (370)..(370): a, c, t, g, unknown or other
  modified_base (385)..(385): a, c, t, g, unknown or other
  modified_base (409)..(409): a, c, t, g, unknown or other
  modified_base (510)..(510): a, c, t, g, unknown or other
tcagtcgtcgctcgcacgaccggtgctcgatttagtcactcatacagggggctggggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctctgtgcggtctctggtcaccgtcactacaactccatgagctgggtccgccaggctccgagggaggggctggagtggggtctcgagttatttatagtggtggtggtgcagatacgcaagactccgngaagggcgatcacanctccagagacaatccatagaacanctagtactcttacaaaatcgggaaacagaccctagacgacgcccgagtaccaccggtccgtactacttcgtgtgccgacggggagtgggacgggaaggggnggacaagtggaattacgtttgacctaacggttcgggggaaccg

SEQ ID NO: 427027 - DNA, 686 bp, Homo sapiens
  misc_feature: GZ8MTXP01CF8AH.21.76.G10.1.454.CMB.2.raw
  modified_base (296)..(296): a, c, t, g, unknown or other
  modified_base (472)..(472): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagacgtggaggagacttgatccgaaccgtgggggtccctgagctctccgtgtgcggtctcgtggttcacgtcactacaactcatgagcgtcggtccncgaggctccgaggggagggctgggagtgggtctgtagtttattagtaggtggtggtggtcgacgagtagtacgcaaagacgtccgtaggaacgggccgtactcgacctatcctaccagaacgtaactaacgttaccaagttacgaaactaccgcgttacgtattacccgtttaaanaaacgtacgggaaacgtacggaccgtacggaacgccggaacccgaaccggaacccgtaccggtacccgttaacgttaacgttacggtcggtacgggttaccgggtaaacggggttagggtaacggggaacgggggaacggggttaacggacgttaagggtacggttaacgtttacggttacggaaccggtaacggggttaacgggggtaacccg

SEQ ID NO: 427028 - DNA, 748 bp, Homo sapiens
  misc_feature: GZ8MTXP01B2SIJ.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagtcttgggttttccttgttactatttacaaaggtgtccagtgtgaggtgcagcgtggtggagacgtgggaggagtacttgactaccgaacggtcgggggtcctaggagactctccgtgtcgcggtacttcgtggttccacgtacactacacgccattcgagtcgtcggtcccgacgacggccgtaccggaaggggtaacggggtcgtagggagggttcgggttaccgttagttaggttttaagttttaggttagggttggggttggggtaacgggtcggtaccgtaggttacgttaaccggacgtaaacggtaccgtcccgggtagggaaaccgggtcccggttaacgttaccaaccgtactacccgtacccgaaagtaaccggtaactaacttacgtaaacgttaccggaaactaccggtcttagttaactaccgtttaacaaacgttaacggaacgttacgaccgaggaaccgacggacccgaaccgacgtaccggtcgttactacggtaacgtcgggtcggacgggtagggcggtacgggaggggagggcggttcaaggttccggaatttccggtacgaccggtcgggttaacggggtaacccg

SEQ ID NO: 427029 - DNA, 526 bp, Homo sapiens
  misc_feature: GZ8MTXP02JZ91U.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctgggggtccctgagactctcctgtgcggtctctgggttcaccgtcactactaactccatgagctgggtccgccaggctccgagggaaggggctggagtggggtctcagttattatagtggtggtggtcgcagattacgcagactccgtgaaagggccgattcaccatctccagagacaattccatgaacacgctgtatcttacaaatgaacagcctgagagccgacgacacggccgtcattactgtcgcgacgggagtggacgggaggagggcaagtggatacttgaccacggtgggggaccg

SEQ ID NO: 427030 - DNA, 459 bp, Homo sapiens
  misc_feature: GZ8MTXP02GWYEF.21.76.G10.1.454.CMB.2.raw
  modified_base (345)..(345): a, c, t, g, unknown or other
  modified_base (379)..(379): a, c, t, g, unknown or other
  modified_base (391)..(391): a, c, t, g, unknown or other
  modified_base (405)..(405): a, c, t, g, unknown or other
  modified_base (422)..(422): a, c, t, g, unknown or other
  modified_base (433)..(433): a, c, t, g, unknown or other
tcagtcgtcgctcgcacgaccggtgctcgatttagtcactcatacaggggcagaagtctctctcagtcaggacacagcatggacatgagggtccctgctcagctcctgggactcctgctgctctggctcccagataccagatgtgacatccagatgacccagtctccatcctcctgtctgcatctgtaggagacagagtcaccatcacttgccgggcgggtcaggacattagacattatttagcctggtatcagcagaaaccagtaaagttccaagctcctgatctatgctgcatcctctttgcatcaggggtccatctcggttcagtggcagtgatctgggacngattcactctcaccatcagcagctgcagcctganatgtgctaattntactgtacaaaatntaagcagttcacccctntcactttcgcncgaggaccaggtgactatcgaaaacg

SEQ ID NO: 427031 - DNA, 519 bp, Homo sapiens
  misc_feature: GZ8MTXP02GSCI6.21.76.G10.1.454.CMB.2.raw
  modified_base (293)..(293): a, c, t, g, unknown or other
  modified_base (387)..(387): a, c, t, g, unknown or other
  modified_base (393)..(393): a, c, t, g, unknown or other
  modified_base (458)..(458): a, c, t, g, unknown or other
tcagtcgtcgctcgcacgaccggtgctcgatttagtcactcatacagggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctgggggtccctgagactctcctgtgcggtctctgggttcaccgtcactactaactccatgagctgggtccnccaggctccgagggaaggggctggagtggggtctcagttatttatagtggtggtggtgcagattacgcagactccgtgaaggccgatcacatcnccaganacaattccaatgaacacgctgtatcttacaaatgaaacagcctgagagccgaagacacggccgtntatactgtgcgacggagtgacgggaggagggcaagtggactacttgaccagtgggggaccg

SEQ ID NO: 427032 - DNA, 708 bp, Homo sapiens
  misc_feature: GZ8MTXP02JIMFX.21.76.G10.1.454.CMB.2.raw
  modified_base (609)..(609): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcgttgggttttccttgttacttatttacgaaaaggtgtccagtgtgaggtgcagcgtggtggagacgtgggaggagtacttgactacccgaaccggtcgggggtccctggacgtactctccgtgtgcggtctcgtggttcaccgtcactactaactcatgacgtcgtcgggtccgccgaggcctccggaagggggaacggggcgtagggtaggtcggggtcctacgtagtttatttagtaggttgggtggtggtcgacgtagtacttacggcgtaacggtaccgttccgggtagggaaaccggggtccgttaacttcccgaaaccgtactccctaacccgaaggaaacgtaacctaacttcccgaagtacgaaacccgacggtcttagttacttaccttaaacaaagtcggaaaactcgaccgtaggaacgcggacccgaacgtaccgacggtccttactaattcgngggtacgcgggaacgggtaggtacggggacgggggaaggccgggataagggtcggtaaactttaccggttaggaacccgtgggggtacggggaacccgg

SEQ ID NO: 427033 - DNA, 560 bp, Homo sapiens
  misc_feature: GZ8MTXP02GP965.21.76.G10.1.454.CMB.2.raw
  modified_base (418)..(418): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctgggggtccctgagactctcctgtgcggtctcgtgggttcaccgtcactactaactccatgagcgtgggtcccgccaggcctccgaggggaggggctggagtgggtctcgtagttatttagtagtggtggtggtgcagattacgcagactccgtgaagggccattccacatctccagagacaattccaatgaacncgctgtatcttacaaatgaacagcctagagcgccgacgacaaccgggccttacgtattacgtggtcggacggtacggggaggtacggacgggggaggaggggcaagtcggattacgttcggacctacgggtgggggaacccg

SEQ ID NO: 427034 - DNA, 476 bp, Homo sapiens
  misc_feature: GZ8MTXP02IXKUM.21.76.G10.1.454.CMB.2.raw
  modified_base (348)..(348): a, c, t, g, unknown or other
  modified_base (387)..(387): a, c, t, g, unknown or other
  modified_base (407)..(407): a, c, t, g, unknown or other
  modified_base (428)..(428): a, c, t, g, unknown or other
tcagtcgtcgctcgcacgaccggtgctcgatttagtcactcatacaggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccgggcgggtcaggacattagacattatttagcctggtatcagcagaaaccaggtaaagttcccaagctcctgatctatgctgcatcctctttgccaatcagggtcccatctcgtcagtgcagtgatcgtgggacngatttcactctcaccatcagcagcctgcagcctgaagtntgttgctaactttattactntacaaaaatataagcaagtcnccctctcactttcggacgcgacgggaccaaggtcgacactacaaaacg

SEQ ID NO: 427035 - DNA, 496 bp, Homo sapiens
  misc_feature: GZ8MTXP02GEFAF.21.76.G10.1.454.CMB.2.raw
  modified_base (220)..(220): a, c, t, g, unknown or other
  modified_base (439)..(439): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttggccgggnggtcaggacattagacattattagcctggtatcagcagaaaccaggtaaagttccaaagctcctgatctatgctgcatcctctttgccaatcaggggtcccatctcgttcagtggctagtggatcgtgggacagtatttcactctcacatcagcacgcctgcagcctagaagtatgtgactaacttattactagtaacaaaattactagtacaggtccnccctactcctaccgttcggacgaacgtacggacctaggtcggacaactacgaaaacg

SEQ ID NO: 427036 - DNA, 499 bp, Homo sapiens
  misc_feature: GZ8MTXP02HV077.21.76.G10.1.454.CMB.2.raw
  modified_base (281)..(281): a, c, t, g, unknown or other
  modified_base (300)..(300): a, c, t, g, unknown or other
  modified_base (326)..(326): a, c, t, g, unknown or other
  modified_base (332)..(332): a, c, t, g, unknown or other
  modified_base (437)..(437): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgcttctctggctcccagataccagatgtgacatccagatgacccagtctccatcctccctgtctgcatctgtaggagacagagtcaccatcacttgcggcggtcaggacattagacattattagcctggtatcagcagaaaccaggtaaagttcccaagctccngatctatgctgcatccttnttgcatcgacgggtccatctcgttcngtggcngtgatcgtagggacagtacttcactctcacatcagtcacgctgcacgcctagaagtacttggtctactaacttattaacgtctaaactaaaatatagacaggtcncccctactctacgtttcgacgtcgaacggacgaacggtcggaactacgactaaaacgtacgg

SEQ ID NO: 427037 - DNA, 587 bp, Homo sapiens
  misc_feature: GZ8MTXP02GOC6L.21.76.G10.1.454.CMB.2.raw
  modified_base (423)..(423): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctggttcaccgtcactactaactccatgagcgtgggtccgccgaggctccgaggggaaggggctgggagtgggtctcgtagttatttagtaggtggtggtggtgcagtattacgcagactccggtgaacgggccgattccacatcctccagagacaattccatgaacncgctgtatctacaaatgaactagcctagagacgacccgacgaccgaaccggtccgtactatttacgtggtcggacgggtacggggaggtcgggacgggggaagggacgggacgaagtcggggaactttacgtttacggaaccgtacgggtacgggggaacccgg

SEQ ID NO: 427038 - DNA, 485 bp, Homo sapiens
  misc_feature: GZ8MTXP02JUHY7.21.76.G10.1.454.CMB.2.raw
  modified_base (194)..(194): a, c, t, g, unknown or other
  modified_base (220)..(220): a, c, t, g, unknown or other
  modified_base (421)..(421): a, c, t, g, unknown or other
  modified_base (455)..(455): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagagtcaccatcacttggccgggngggtcaggacattagacattattagcctggtatcagcagaaaccaggtaaagttcccaaagctcctgatctatgctgcatcctctttgccaatcaggggtcccatctcggttcagtggcagtggatctgggacagatttcactctcacatcagcagcctgcagcctgacgatgttagcaacttatactagtactaaaaatnttaacgcaagttcgacccctctccactttcggcncgagggaccaaggtcggacactacaaaacg

SEQ ID NO: 427039 - DNA, 562 bp, Homo sapiens
  misc_feature: GZ8MTXP02G5E9D.21.76.G10.1.454.CMB.2.raw
  modified_base (417)..(417): a, c, t, g, unknown or other
  modified_base (444)..(444): a, c, t, g, unknown or other
  modified_base (486)..(486): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggttcaccgtcactactaactccatgagctgggtccgccaggctccgagggaaggggctggagtgggtctcagttatttagtagtggtggtggtgcagattacgcagactccgtgaagggccagttcaccatctccagagacaattcccaatcgaaacncggctgtactcttaacaaattgaaacngacctgaagacgacccgaacgaccacgggcctactattacgngtcgcggaacggggagtacggacgggggaggagggcaagtcgggaacttacgttgaacctacggtcgggggaaccg

SEQ ID NO: 427040 - DNA, 549 bp, Homo sapiens
  misc_feature: GZ8MTXP02JIY1I.21.76.G10.1.454.CMB.2.raw
  modified_base (417)..(417): a, c, t, g, unknown or other
  modified_base (444)..(444): a, c, t, g, unknown or other
  modified_base (449)..(449): a, c, t, g, unknown or other
  modified_base (492)..(492): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggttcaccgtcactactaactccatgagctgggtccgccaggctccgaggggaaggggctggagtgggtctcgtagttatttatagtggtggtggtgcagattacgcagactccggtgaagggccgattccaccatctacccagagacaattccagtanaaccacgctgtatcttacaaatgaacngaccngagcgaccgacgacgacggcgtactatactgtcgcggacgggngtcggacgggagggagggcaaggtggaacttacgttgaccgtacggtcgggggaccg

SEQ ID NO: 427041 - DNA, 496 bp, Homo sapiens
  misc_feature: GZ8MTXP02ISBAZ.21.76.G10.1.454.CMB.2.raw
  modified_base (220)..(220): a, c, t, g, unknown or other
  modified_base (353)..(353): a, c, t, g, unknown or other
  modified_base (386)..(386): a, c, t, g, unknown or other
  modified_base (391)..(391): a, c, t, g, unknown or other
  modified_base (420)..(420): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttggccgggnggtcaggacattagacattattagcctggtatcagcagaaaccaggtaaagtccaagctcctgatctatgctgcatcctctttgccaatcgagggtcccatctcggttcagtgcagtggatcgtgggacagtntttcactctcacatcagcagctgcagcctaganatgtnactaacgttatactgtaacaaaatactanacagtacgcccttactcctacgtttccgacgtaacgtaacggaaccgtaacggtacggactaacgtacaaaaccgg

SEQ ID NO: 427042 - DNA, 564 bp, Homo sapiens
  misc_feature: GZ8MTXP02I5FMN.21.76.G10.1.454.CMB.2.raw
  modified_base (423)..(423): a, c, t, g, unknown or other
  modified_base (435)..(435): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctggttcaccgtcactactaactccatgagctggtccgcaggctccgagggagggctggagtgggtctcgtagtttatttagtagtggtggtggtgcagattacgcagctcgtgaacggcgattcacatctcagacacaattccatacgaacacgctagtatcttaanaaattcgaaacncgaccgtggaacgacgaccggtacgaaccgacggtccgtacttaattccgtggtcggacggacggggatcgggacggggaaggcggacaagtaggacttacgttagacccgtagggtcgggggaacccg

SEQ ID NO: 427043 - DNA, 543 bp, Homo sapiens
  misc_feature: GZ8MTXP02FVFU3.21.76.G10.1.454.CMB.2.raw
  modified_base (298)..(298): a, c, t, g, unknown or other
  modified_base (531)..(531): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagactgggaggagacttgatccaaccgtgggggtccctgagactctcctgtgcggtctcgtgggttcaccgtcactactaactccatgagctgggtccncaggctccgagggagggctggagtgggtctctagttatttatagtggtggtggtgcagattacgcagactccggtagaacgggccgtattcaaccatctccagagacaattccatagaacacgctgtatcttacaaatgaaacagaccctagagacgccgacgaccgacggcctctacttactggtcgcgacgggagtcgggacgggaggagggcaagtggatacgttcgacncggtcggggacg

SEQ ID NO: 427044 - DNA, 538 bp, Homo sapiens
  misc_feature: GZ8MTXP02JUZ9V.21.76.G10.1.454.CMB.2.raw
  modified_base (417)..(417): a, c, t, g, unknown or other
  modified_base (505)..(505): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctgggggtccctgagactctcctgtgcggtctctgggttcaccgtcactactaactccatgagctgggtccgccaggctccgaggggaaggggctgggagtggggtctcaggtttatttagtaggtggtggtggtgcagattacgcagactccgtgaagggccgattcacatctccagagacaattccatgaacncgctgtatcttacaaattgaaacagcctagagagccgacgacacggccgttctatactgtgcggacgggagtggacgggaggacgggnaagtggacttacgttgaccgacggtcggggacg

SEQ ID NO: 427045 - DNA, 532 bp, Homo sapiens
  misc_feature: GZ8MTXP02G0740.21.76.G10.1.454.CMB.2.raw
  modified_base (414)..(414): a, c, t, g, unknown or other
  modified_base (436)..(436): a, c, t, g, unknown or other
  modified_base (493)..(493): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtgggttcaccgtcactactaactccatgagctgggtccgccaggctccgaggggaggggctggagtgggtctcgagttatttatagtggtggtggtgcagattacgcagactccgtgaagggccgattcacatctccagacgacaattccatgaacncgctgtatcttacaaatgaacngcctgagacgccgacgacacggcctctattactgtgcggacgggatggacgggaggngggcaagtggacttacgttggacctacggtgggggaccg

SEQ ID NO: 427046 - DNA, 539 bp, Homo sapiens
  misc_feature: GZ8MTXP02ILZVC.21.76.G10.1.454.CMB.2.raw
  modified_base (296)..(296): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctctgggttcaccgtcactactaactccatgagctgggtccnccaggctccgaggggaaggggctggagtggggtctcagtttatttatagtggtggtggtgcagattacgcagactccggtgaacggggccgattcaccatctccagagacaattccatagacacgctgtatcttacaaatgaacagcctagagacgccgacgacacggccgtactattactgtgcgacggggagtggacggggagagggcaagtggactacgttgaccgtacgtcgggggacg

SEQ ID NO: 427047 - DNA, 527 bp, Homo sapiens
  misc_feature: GZ8MTXP02GPHPE.21.76.G10.1.454.CMB.2.raw
  modified_base (295)..(295): a, c, t, g, unknown or other
  modified_base (329)..(329): a, c, t, g, unknown or other
  modified_base (339)..(339): a, c, t, g, unknown or other
  modified_base (431)..(431): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggttcaccgtcactactaactccatgagctgggtccnccaggctccgaggggaggggctggagtgggtctnagttatttanagtggtggtggtgcagattacgcagactccgtgaagggccattcacatctcagagacaattccatagacacgctgtatcttacaaatgaacngcctgagagccgacgacgacggccgtctattacgtgtcgcggacgggagtggacggggagaggggcaagtggactacgttgaccacgtgggggacg

SEQ ID NO: 427048 - DNA, 592 bp, Homo sapiens
  misc_feature: GZ8MTXP02GML22.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggttcaccgtcactactaactccatgagctggatccgcaggctccgaggggagggctggagtggtctcgagtttatttagtagtggtggtggtgcagattacgcagctccgtaggaacgggccgtattcaccatcctccagagacaattcccatcgaacacgctagtatcttacaaaatcgaaacagccctaggaacgacgacccggaacgacctaccgggtcccgttacttaatttaccgtgggttacggaccgggtaacgggggagttcgggaaaccgggggaggagggggctaggtagggtacttacgtttcgaacccgtaggtcgggggg

SEQ ID NO: 427049 - DNA, 610 bp, Homo sapiens
  misc_feature: GZ8MTXP02G2YZZ.21.76.G10.1.454.CMB.2.raw
  modified_base (398)..(398): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtggttcaccgtcactactaactccatgagctgggtccgccaggctccgaggggaaggggctggagtgggtctcgagtttatttagtagtggtggtggtgcgagtattacgcagactccgtagaagggccgattccacatcnccagagacaaattccatagaaccacgcttagtacttcttaacaaaagttgaaacctgacctaggaagacgcccggaacgtaccgaacggggtccccttattaacgtttaaccgtggtacggaccggggaaccgggggtaaaggtcggggaacgggggaggacgggcaaggttgggaactttacgttagaccccgtaagggtgggggaacccg

SEQ ID NO: 427050 - DNA, 524 bp, Homo sapiens
  misc_feature: GZ8MTXP02GSM6O.21.76.G10.1.454.CMB.2.raw
  modified_base (427)..(427): a, c, t, g, unknown or other
  modified_base (435)..(435): a, c, t, g, unknown or other
  modified_base (511)..(511): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggtttccttgttactatttcaaaaggtgtccagtgtgaggtgcagctggtggagactggaggagacttgatccaacctgggggtccctgagactctcctgtgcggtctctgggttcaccgtcactactaactccatgagctgggtccgccaggctccgagggaagggctggagtgggtctctagttatttatagtggtggtggtgcagattacgcagactcgtgaagggccgatcacatctcagagacaattccatgaacacgctgatcttacaaatgaacngcctaganacgccgacgacacggccgtctaatactgtgcggtacgggagtggacgggaggagggcaagtggattacgttgaccncggtgggggaccg

SEQ ID NO: 427051 - DNA, 551 bp, Homo sapiens
  misc_feature: GZ8MTXP02II5TZ.21.76.G10.1.454.CMB.2.raw
  modified_base (404)..(404): a, c, t, g, unknown or other
  modified_base (516)..(516): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctcgtggttcaccgtcactactaactccatgagcgtcgggtcccgccgaggcctccgaggggaaggggcgtggagtgggtctcgtagtttatttagtagtggtggtggtgcagatacgcagactcgtgaacggccgatcacatctcaganacattccatgaaccacgctagtatcttaacaaatagaacagcctagagacgccggacgacgaccgggccttactaattcgtagtggaccggacgggagtcggacggggaggngcgaagtcggattacgttgaccgaggtcgggggac

SEQ ID NO: 427052 - DNA, 546 bp, Homo sapiens
  misc_feature: GZ8MTXP02GSFEL.21.76.G10.1.454.CMB.2.raw
  modified_base (248)..(248): a, c, t, g, unknown or other
  modified_base (297)..(297): a, c, t, g, unknown or other
  modified_base (397)..(397): a, c, t, g, unknown or other
  modified_base (408)..(408): a, c, t, g, unknown or other
  modified_base (489)..(489): a, c, t, g, unknown or other
  modified_base (507)..(507): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacgtggggggtccctgagactctcctgngcggtctcgtgggttcaccgtcactactaactccatgagctcgggtccnccaggctccgagggaaggggctggagtgggtctcgagttatttatagtggtggtggtcgcagattacacagactccgtgaaggccatcacatctccaganacaatccaatnaaacacgctgtaactcttacaaatgaaactgcctagagaacgccgaacgacacggcctatatacgtggtcgcggaacgggngtacggacggggaagggnggacaagtggacttacttgaacccgaggtcgggggaacg

SEQ ID NO: 427053 - DNA, 570 bp, Homo sapiens
  misc_feature: GZ8MTXP02IQHMN.21.76.G10.1.454.CMB.2.raw
  modified_base (292)..(292): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaggtgtccagtgtgaggtgcagctggtggagactggaggagacttgatccaaccgtgggggtccctgagactctcctgtgcggtctcgtggtcacgtcactactaactccatgagctgggtccnccaggctccgagggaaggggctggagtgggtctcgagtttatttagtagtggtggtggtgcgagattacgcagactccgtgaacggccgattcacatcaccagagacaattccatagaacacgctgtactcttacaaattgaaactagaccctgaacgacgacccgaacgaccgacggcccgtactacttactcgtcggaccggacgggagtacgggacggggagggacggcgaagtcggaagttacctttaggaacccgtaacggtcgggggaaccg

SEQ ID NO: 427054 - DNA, 523 bp, Homo sapiens
  misc_feature: GZ8MTXP02HPE39.21.76.G10.1.454.CMB.2.raw
  modified_base (340)..(340): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagtttggctgagctgggttttccttgttactatttcaaaaggtgtccagtgtgaggtgcagctggtggagactggaggagacttgatccaaacctgggggtccctgagactctcctgtgcggtctctgggttcaccgtcactactaaactccatgagctgggtccgccaggctccaggggaaggggctggagtggggtctcagttatttanagtggtggtggtgcagattacgcagactccgtgaaagggccgattcaccatctccagagacaattccatgaaacacgctgtatcttcaaatgaaacagcctgagagccgacgacacggccgtctattactgtgcgacgggagtgacggggagagggcaatggatacttgaccactgggggacg

SEQ ID NO: 427055 - DNA, 553 bp, Homo sapiens
  misc_feature: GZ8MTXP02JFMR8.21.76.G10.1.454.CMB.2.raw
  modified_base (362)..(362): a, c, t, g, unknown or other
  modified_base (432)..(432): a, c, t, g, unknown or other
  modified_base (465)..(465): a, c, t, g, unknown or other
  modified_base (489)..(489): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtgggttcaccgtcactactaactccatgagctggtccgccaggctccgagggagggctggagtgggtctcgtagttattagtagtggtggtgtgcgagtatacgnagctcgtgaagggccattcacatctccagacgacaattccatagacacgctagtatcttacaaatgaacncgcctagagacgaccgaacgacgacggaccgtntactactggtgaccggtaacgggnggtacggacgggggagggacggacgtaagtgggtaactacgtttgaccgacggtcgggggaccg

SEQ ID NO: 427056 - DNA, 564 bp, Homo sapiens
  misc_feature: GZ8MTXP02GKZN9.21.76.G10.1.454.CMB.2.raw
  modified_base (220)..(220): a, c, t, g, unknown or other
  modified_base (305)..(305): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatccctccctgtctgcatctgtaggagacagagtcacatcacttggccgggnggtcaggacattagactattattagcctggtatcagacaagaaaccaggtaaactccaagctcctgatctatgctgctattcctntttcgacctaagtcgacggggtcccagtccgttacggttcgagtcggcgtaggtgatcgtgggactagtatttcactctacacactcagcacgctgcacgacctagaagtagtagttacgtactaaactttacttaacgttacgtaaactaaaaattactaacgactaacggttacctaccccttactaccgttaccgtttccggaccgtaacgaacgggtaaccgtacgggtacgaacgtacgttaaccgtaaaacgg

SEQ ID NO: 427057 - DNA, 558 bp, Homo sapiens
  misc_feature: GZ8MTXP02INAYV.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactgggaggagacttgatccaaccgtggggggtccctgagactctcctgtgcggtctctgggttcaccgtcactactaactccatgagctgggtcccgccaggctccgagggaggggctggagtgggtctcagtttattagtagtggtggtggtgcagattacgcagactcggtgaacgggccgattccacatctcagagacaattccatcgaacacgctgtatcttacaaaatgaacagcctagaagacgccgacgacgacggccgtctattacgtggtcgcggacggggagtcggaacgggggacggagggagaaggtaggtacttacgttacggaccgtacgggtacgggggacg

SEQ ID NO: 427058 - DNA, 574 bp, Homo sapiens
  misc_feature: GZ8MTXP02JV8FT.21.76.G10.1.454.CMB.2.raw
  modified_base (293)..(293): a, c, t, g, unknown or other
  modified_base (338)..(338): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcgtggtttccgtgttacgtattcaaaggtgtccagtgtgaggtgcagctggtggagactggaggagacttgatccaaccgtgggggtccctgagactctcctgtgcggtctctgggttcaccgtcactactaactccatgagctgggtccnccaggcctccgagggaggggctggagtgggtctcagtttatttanagtggtggtggtgcagattacgcagacgtccgtgagggaccggacttcacactctccagagacaattaccaatagaacacgactagtacttacttactaaataacgaacgacgacgtacgagacgaccgaccgacgaccggaccgtacgtacttacgtcgtcggacggacgggaggtacggacgggacgggaggacgaagtaggtacgtacgttacgtacgtacggtacgggacgg

SEQ ID NO: 427059 - DNA, 591 bp, Homo sapiens
  misc_feature: GZ8MTXP02GA7IU.21.76.G10.1.454.CMB.2.raw
  modified_base (383)..(383): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagactggaggagacttgatccaaccgtgggggtccctgagactctcctgtgcggtctctgggttcaccgtcactactaactccatgagcgtcgggtccgccaggcctccgaggggaaggggctggaggtgggtctcgagtcttatttagtaggtggtggtggtgcagacttacgcagcctccgnggaacggccatcacatcacagagacattccatacgaacacgcttagtattacctacaaaatcgaaacacgtacctagaacgacggccgaacggtaccgaccggtccgtacgttaattacgtgtcggacggacggggtagtcgggaacgggggagggacgggaacgaaggtaggtaacgttcgtttacggaaccgtacgggtacggggg

SEQ ID NO: 427060 - DNA, 581 bp, Homo sapiens
  misc_feature: GZ8MTXP02GWS5O.21.76.G10.1.454.CMB.2.raw
  modified_base (366)..(366): a, c, t, g, unknown or other
  modified_base (386)..(386): a, c, t, g, unknown or other
  modified_base (389)..(389): a, c, t, g, unknown or other
  modified_base (408)..(408): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtgggggtccctgagactctcctgtgcggtctcgtgggttcaccgtcactactaactccatgagctgggtccgcaggctccgaggggaggggctggaggtgggtctcgagtttattagtagtggtggtggtgcagattacgnagctcgtgaaggcgatcacntcncagagacaatccatgaacncgctagtatcttacaaatgaactagcctagagacgaccgacgacgaccgggccgtactaattacgtggtcggaccgggtacggggaggtcgggaaccgggggaaggggacggggacgaaggttagggaactttacggtttcggaaacccggtacgggttacggggggaacccg

SEQ ID NO: 427061 - DNA, 526 bp, Homo sapiens
  misc_feature: GZ8MTXP02FEKLE.21.76.G10.1.454.CMB.2.raw
  modified_base (370)..(370): a, c, t, g, unknown or other
  modified_base (467)..(467): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctggggggtccctgagactctcctgtgcggtctctgggttcaccgtcactactaactccatgagctgggtccgccaggctccagggaaggggctggagtgggtctcagttatttatagtggtggtggtgcagattacgcagactccgngaaagggccgattcaccatctccagagacaattccatgaacacgctgtatcttacaaatgaacagcctgagagccgacgacacggccgtctattacngtgcgacgggagtcgacggggaggagggcaagtggatactttgaccacgtgggggaccg

SEQ ID NO: 427062 - DNA, 584 bp, Homo sapiens
  misc_feature: GZ8MTXP02JRW82.21.76.G10.1.454.CMB.2.raw
  modified_base (402)..(402): a, c, t, g, unknown or other
  modified_base (449)..(449): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtgggttcaccgtcactactaactccatgagcgtgggtccgccaggcctccgaggggaaggggctggagtggggtctcgtagtttatttagtagtggtggtggtgcagtattacgcagactccggtagaagggccgattcacatcnccagagacattccatcgaacacgctgtactcttacaaattcgaaacngcctaggaacgacgcccgaacgacgaccgggccttatacttaccgtggtcggccggtaacggggagtacgggacgggggagggaggggacaaggtgggtaacttacggttggacccgtacgggtgggggaacccg

SEQ ID NO: 427063 - DNA, 530 bp, Homo sapiens
  misc_feature: GZ8MTXP02HAHH0.21.76.G10.1.454.CMB.2.raw
  modified_base (294)..(294): a, c, t, g, unknown or other
  modified_base (363)..(363): a, c, t, g, unknown or other
  modified_base (486)..(486): a, c, t, g, unknown or other
  modified_base (497)..(497): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctgggggtccctgagactctcctgtgcggtctctgggttcaccgtcactactaactccatgagctgggtccnccaggctccgagggaaggggctggagtgggtctcgagttatttagtagtggtggtggtgcagattacgnagactccgtgaagggccgattcacatctccagagacaattccatgaacacgctgtatcttacaaatgaacagcctagagacgaccgacgactacggccgtatatacgtgtagcgacgggtagnggacgggaggngggacaagtggatacgttgaccgagtggggacg

SEQ ID NO: 427064 - DNA, 668 bp, Homo sapiens
  misc_feature: GZ8MTXP02JV92V.21.76.G10.1.454.CMB.2.raw
  modified_base (491)..(491): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttacaaaaggtgtccagtgtgaggtgcagctggtggagacgtggaggagacttgatccaaccgtgggggtcctgagactctctgtgcggtctcgtggttcaccgtcactactaactccatgagcgtcgggtccgccgaggcctccggaggggaacggggcgtgggaggtgggtctcgtagtttatttagtaggtggtggtggtgcgagtattacgcacgtacctccgggtaggaaacggggccctattccaacctactccctaccgaaagacgaactaacttcccaatacgaaccacgtcttagtacttacttaacaaaatcgaaacncgtaccgtaggaacgaccgaccccggaacggacccgaaccgggtcccgttacttaattaccggtggtaccggacggggaaaccgggggtagtacggggaaccgggggaggaacggggacaaggttacgggtaactttaccggttacggaacccggtacgggggttcgggggaacccg

SEQ ID NO: 427065 - DNA, 546 bp, Homo sapiens
  misc_feature: GZ8MTXP02HE7RA.21.76.G10.1.454.CMB.2.raw
  modified_base (295)..(295): a, c, t, g, unknown or other
  modified_base (509)..(509): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggttcaccgtcactactaactccatgagctgggtccnccaggctccgagggaggggctggagtgggtctcgagtttatttataggtggtggtggtgcagattacgcagactccgtgaaagggccattccacatctccagagacaattccatcgaacacgctagtatcttacaaatgaacagcctaggaagacgcccgacgacgacggcccgttactattacgtggtcgcggacgggagtggacggggaggngggacaagtggacttcgttagaccgagtcgggggacg

SEQ ID NO: 427066 - DNA, 538 bp, Homo sapiens
  misc_feature: GZ8MTXP02GUECL.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctggggggtccctgagactctcctgtgcggtctctgggttcaccgtcactactaactccatgagctgggtccgccaggctccgaggggaaggggctggagtgggtctcgagttatttatagtggtggtggtgcagattacgcagactccgtgaagggccgattcacatctccagagacaattccatagaacacgctgtatcttacaaatgaaacagcctgaagacgaccgacgacgacggccgtctattacgtgtgcggacgggagtcggacggggaggaggcaagtggatacgttgaccgtacggtgggggaccg

SEQ ID NO: 427067 - DNA, 541 bp, Homo sapiens
  misc_feature: GZ8MTXP02F8B9D.21.76.G10.1.454.CMB.2.raw
  modified_base (294)..(294): a, c, t, g, unknown or other
  modified_base (360)..(360): a, c, t, g, unknown or other
  modified_base (429)..(429): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaggtgtccagtgtgaggtgcagctggtggagactggaggagacttgatccaaccgtgggggtccctgagactctcctgtgcggtctcgtgggttcaccgtcactactaactccatgagctggtccncaggctccgagggagggctggagtgggtctcgagttatttagtagtggtggtggtgcagattacgnagactccgtgaaggggccattccacatctccagagacaattccatagaacacgctgtatcttacaaatnaaacagcctgaagacgaccgacgacgaccggcctactattactgtggcggacggggagtcgggacggggaggagggacaagtggaattacgttgactacggtagggggaccg

SEQ ID NO: 427068 - DNA, 471 bp, Homo sapiens
  misc_feature: GZ8MTXP02JXCEJ.21.76.G10.1.454.CMB.2.raw
  modified_base (194)..(194): a, c, t, g, unknown or other
  modified_base (344)..(344): a, c, t, g, unknown or other
  modified_base (362)..(362): a, c, t, g, unknown or other
  modified_base (382)..(382): a, c, t, g, unknown or other
  modified_base (430)..(430): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagagtcaccatcacttgccgggcggtcaggacattagacattattagcctggtatcagcagaaaccaggtaaagttccaagctcctgatctatgctgcatcctctttgccatcagggtccatctcgtcagtggcagtgatctgggacngattcactctcacatcancagcctgcagcctagaacgntgttagactaactttatactgtacaaaatatacgctagtcgacccctntctacttcggcgcgacgggacaaggtcgacactacgaaacg

SEQ ID NO: 427069 - DNA, 572 bp, Homo sapiens
  misc_feature: GZ8MTXP02HJV0E.21.76.G10.1.454.CMB.2.raw
  modified_base (298)..(298): a, c, t, g, unknown or other
  modified_base (328)..(328): a, c, t, g, unknown or other
  modified_base (349)..(349): a, c, t, g, unknown or other
  modified_base (360)..(360): a, c, t, g, unknown or other
  modified_base (504)..(504): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactgggaggagacttgatccgaaccgtgggggtccctgagactctcctgtgcggtctcgtgggttcaccgtcactactaactccatgagctgggtccncaggctccgagggagggctggagtggtctnagttatttatagtggtggtgngcagattacgnagctccggtagaagggccattcaccatcctcagagactaattccaatacgaacacgcttagtatcttaacaaattcgaaacagcctagagacgacccgacgacgacggccgtactaagttacgtcggtcggcggtaacgggggngtacgggacggggagggaggacgaaggtggtacttacgttacggaccgtaacgggtcgggggaacccg

SEQ ID NO: 427070 - DNA, 578 bp, Homo sapiens
  misc_feature: GZ8MTXP02JO64L.21.76.G10.1.454.CMB.2.raw
  modified_base (397)..(397): a, c, t, g, unknown or other
  modified_base (400)..(400): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccaaccgtgggggtccctgagactctcctgtgcggtctcgtgggtcaccgtcactactaactccatgagcgtgggtccgccaggcctccgaggggaaggggcgtggagtggggtctcgtagttatttagtaggtggtggtggtgcagtatacgcagctcggtagaacgggccattcacntcnccagacacaattccatacgaacacgctagtatacttacaaattagaaactagcctaggaacgacgaccgaaccgacaaccggccgtacgttaatacgtggtcgacggacggggagtcgggaacggggacgggagggcaaggtacggaacttacgttggacctagggtacgggggaccg

SEQ ID NO: 427071 - DNA, 633 bp, Homo sapiens
  misc_feature: GZ8MTXP02INEO4.21.76.G10.1.454.CMB.2.raw
  modified_base (295)..(295): a, c, t, g, unknown or other
  modified_base (339)..(339): a, c, t, g, unknown or other
  modified_base (363)..(363): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctctgggttcaccgtcactactactccatgagctgggtccnccaggctccgagggaaggggctggagtgggtctcagtttatttnagtggtggtggtgcagtattacgnagctcgtgaacggccgattaccacgtatcctaccgaggaacgaactaattcccaagtacgaaactaccggacttagtacttaccttaaacaaatacgaaccgtacgacccgtagggaaacgccggacccgaacggaccgaccgggcctttactaacgttaccgtgggtacggaccggggaaacggggtggaccgggggaacgggggaggggaccggagaagttagggaactttacggttacggaccgttacggggagggggtaaccccgg

SEQ ID NO: 427072 - DNA, 511 bp, Homo sapiens
  misc_feature: GZ8MTXP02GDN8Y.21.76.G10.1.454.CMB.2.raw
  modified_base (194)..(194): a, c, t, g, unknown or other
  modified_base (396)..(396): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagagtcaccatcacttgccgggcggtcaggacattagacattattagcctggtatcagcagaaaccaggtaaattccaagctcctgatctatgctgcatcctctttgcaatcgaggggtcccatctcgttcagtggcagtgatcgtgggacagtatttcactctcaccatcagcacgcctgcagcctgaagtattgttanactaaacttatttaactagtaaacaaaaatataacgacagtccgcccctactcctacgtttccgacggtaaccgaacgggaaccgaagggttacggaacaacgttacaaaaacgg

SEQ ID NO: 427073 - DNA, 498 bp, Homo sapiens
  misc_feature: GZ8MTXP02JZSTX.21.76.G10.1.454.CMB.2.raw
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccgggcggtcaggacattagacattattagcctggtatcagcagaaaccaggtaaagttcccaaagctcctgatctatgctgcatcctctttgccaatcaggggtcccatctcgttcagtggcagtggatcgtggggacaggatttcactctcacatcagcagcctgcagccctgaagattgttgctaaacttattaactagtacaaaaattatacgacagtccgaccccttctcctacctttccggcgcgtaacgggaccaaggtggaccactacgaaaaccgg

SEQ ID NO: 427074 - DNA, 504 bp, Homo sapiens
  misc_feature: GZ8MTXP02JPTQY.21.76.G10.1.454.CMB.2.raw
  modified_base (194)..(194): a, c, t, g, unknown or other
  modified_base (300)..(300): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagagtcaccatcacttggccgggcggtcaggacattagactattattagcctggtatcagcagaaaccaggtaaattccaagctcctgatctatgctgcatctnttgccatcagggtccatctcgtcagtgcagtgatcgtgggacagtattcactctcacatcagcacgcctgcagcctagaacgtatgttacgtactaactttattaactagtaactaaaaatataacgcgtaagtccgtaccctcttacctacgtttcggacgtaacgacggaaccgtaggtacgaactacgtaacgaaaaccgg

SEQ ID NO: 427075 - DNA, 577 bp, Homo sapiens
  misc_feature: GZ8MTXP02IOWNF.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtggttcaccgtcactactaactccatgagcgtcgggtccgccaggctccgaggggaaggggctggaggtgggtctcgtagtttatttagaggtggtggtggtgcagtatacgcagactccggtaggaagggccgtattccactatcctaccgagagaacaattccaatcgaaacacgtctagtactctaacaaatgaaactgacctaggagacgccgaacgaccgacggccgtactattacgtgtcggacggacgggaggtacggacggggaggagtacgaagtggaacttacgttcgaaccgtacggtcgggggaaccg

SEQ ID NO: 427076 - DNA, 535 bp, Homo sapiens
  misc_feature: GZ8MTXP02FQB4I.21.76.G10.1.454.CMB.2.raw
  modified_base (295)..(295): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctggggggtccctgagactctcctgtgcggtctctgggttcaccgtcactactaactccatgagctgggtccnccaggctccgagggaaggggctggagtgggtctcagttatttatagtggtggtggtgcagattacgcagactccgtgaacggggccattccacatctccagagacaattccatagaacacgctgtactcttacaaaatgaaacagcctagacgagccgacgacacggccgtatattactggtgcgacgggagtcggacgggaggaggcaagtcggattacgttgacctacggtggggacg

SEQ ID NO: 427077 - DNA, 570 bp, Homo sapiens
  misc_feature: GZ8MTXP02FZ6F1.21.76.G10.1.454.CMB.2.raw
  modified_base (296)..(296): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagactggaggagacttgatccaaccgtgggggtccctgagactctcctgtgcggtctctgggttcaccgtcactactaactccatgagctgggtccnccaggcctccgagggaggggctggagtgggtctcagtttatttagtagtggtggtggtgcagatacgcagactccgtgaacgggccgattcacctatcctccagacgaacaattccatacgaacacgctgtacttcttacaaatgaaacagcctaggaacgacgccgacaccgacggcctagtattacgtgtcgacggacgggtagtacgggacggggagggaggggacaaggtaggtaacttacggtttcgacccggtaggtacgggggaccg

SEQ ID NO: 427078 - DNA, 567 bp, Homo sapiens
  misc_feature: GZ8MTXP02H9AV0.21.76.G10.1.454.CMB.2.raw
  modified_base (274)..(274): a, c, t, g, unknown or other
  modified_base (441)..(441): a, c, t, g, unknown or other
  modified_base (446)..(446): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacgtgggggtccctgagactctctgtgcgtctctgggtcacgtcactactaacnccatgagctgggtccgccaggcctccgaggggaaggggcgtggaggtgggtctcgtagtttattagtaggtggtggtggtcgcagattacgcagactccgtaggaaagggccgtattcaccgatctaccagacgacaattccatagaacacgctgtatctacaaatnaacgncctagagacgccgaacgacgacggccgtctaagtacctggtagtcggaacggtggtcggaacgggggacggagggctaaggtggaacgttacgttcggtacccgaggttcgggggaaccgg

SEQ ID NO: 427079 - DNA, 564 bp, Homo sapiens
  misc_feature: GZ8MTXP02H9DZX.21.76.G10.1.454.CMB.2.raw
  modified_base (267)..(267): a, c, t, g, unknown or other
  modified_base (293)..(293): a, c, t, g, unknown or other
  modified_base (356)..(356): a, c, t, g, unknown or other
  modified_base (387)..(387): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcgtctctgggtcaccgtnactactaactccatgagctgggtccnccaggcctccgaggggaagggctggagtgggtctcgagtttattatagtggtggtgtcgcagntacgcagctccgtgaaggccattccacatcnccagacgacaattccatcgaaacacgctagttactcttaacaaattcgaaacagcctaggagacgcccgaacgacgacggtccgtactagttacctgtcgcggaacggtggtcggaacggggaggaggggactaaggtggaaacttacgtttacggacccgtaggtcgggggaaccg

SEQ ID NO: 427080 - DNA, 656 bp, Homo sapiens
  misc_feature: GZ8MTXP02HJA74.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctggttcaccgtcactactaactccatgagctcgggtccgccgaggcctccgaggggaaggggcgtggagtgggtctcgtagtttatttagtagtggtggtggtgcagattacgcagactccggtaggaaacgggccgtacttccgaacctagtccctacccgaagaacgaactaaactttcccaatacgaaaccacggtaccttagtacttcctttaaccaaaagttacgaaacctagcccttaggaacgacggacccgaacggaccgaccgggtcccgttactattaaccgtgtcgggaccggaaccggggtaggtacgggaacgggggaagggacggggactaaggttagggaactttacggtttacggaacccggtacggttacgggggaacccggg

SEQ ID NO: 427081 - DNA, 611 bp, Homo sapiens
  misc_feature: GZ8MTXP02I6JJO.21.76.G10.1.454.CMB.2.raw
  modified_base (263)..(263): a, c, t, g, unknown or other
  modified_base (279)..(279): a, c, t, g, unknown or other
  modified_base (281)..(281): a, c, t, g, unknown or other
  modified_base (546)..(546): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggtcncgctacactactaccncngtgcgtcggtccggtcccgacggacgtccgacgggaggggacggtcggaggtgggtcgtcagttagtttattagtggtgggttggtggtcgagagttacgtacgagacgtccggtacggtaaggggaccggtaccttacgtacccaactcttacccacgaagaacgaactacctactagaccaacgctgtatacttacaaactagacaagacctgaagacgccgaccgaacgacggccgtcgtatacgtcgtgcggacgggaggnggtacggggagggtacgggcgaagtacggtacgtacgttacgtaccggacgtcgggggaaccggg

SEQ ID NO: 427082 - DNA, 576 bp, Homo sapiens
  misc_feature: GZ8MTXP02FKC9N.21.76.G10.1.454.CMB.2.raw
  modified_base (441)..(441): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactgggaggagacttgatccgaacctgggggtccctgagactctcctgtgcggtctcgtgggttcaccgtcactactaactccatgagctgggtccgcaggctccgagggaaggggctggaggtgggtctcgagttatttagtagtggtggtggtcgcagattacgcagactcggtgaagggccgattcacatctccagagacaattccatacgaacacgctgtatcttaacaaatgaacngcctgagacgccgacgacgacggccgtactacgttactaggtcgcgtaacgggggatacggggaaccggggaggacggggacaaggttacgggaacttacggtttacgaacccgtacggttcggggggaaacccg

SEQ ID NO: 427083 - DNA, 556 bp, Homo sapiens
  misc_feature: GZ8MTXP02H8GWE.21.76.G10.1.454.CMB.2.raw
  modified_base (294)..(294): a, c, t, g, unknown or other
  modified_base (435)..(435): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaggtgtccagtgtgaggtgcagctggtggagactggaggagacttgatccaaccgtgggggtccctgagactctcctgtgcggtctctgggttcaccgtcactactaactccatgagctgggtccncaggctccgagggaggggctggagtgggtctcgtagtttatttagtagtggtggtggtgcagtattacgcagctccgtgaagggccgtattcaccatcctaccagagactaattccatacgaactacgctagtactcttanaaatgaaacagcctagacgacgaccgacgacgacggccgtactattacgtgtgaccggtacgggagtggacggggaggaggacgaagtggaattacgttagacccgtaggtcgggggaccg

SEQ ID NO: 427084 - DNA, 541 bp, Homo sapiens
  misc_feature: GZ8MTXP02H0TFQ.21.76.G10.1.454.CMB.2.raw
  modified_base (297)..(297): a, c, t, g, unknown or other
  modified_base (372)..(372): a, c, t, g, unknown or other
  modified_base (440)..(440): a, c, t, g, unknown or other
  modified_base (511)..(511): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtgggttcaccgtcactactaactccatgagcgtgggtccnccgaggctccgagggaaggggctggagtgggtctcgtagtttagtttatagttgggtggtggtgcagtattacgnagactccgtgaagggccattcacatctcagagacaatccatagaacagctgtatactacaaatgaacngcctagacagccgaacgtacgacggccgtactattacgtgtagccggacggagtggacggggagacggggnaagtgtactacgtcgaccgtcggcggggcg

SEQ ID NO: 427085 - DNA, 612 bp, Homo sapiens
  misc_feature: GZ8MTXP02FZ5YX.21.76.G10.1.454.CMB.2.raw
  modified_base (388)..(388): a, c, t, g, unknown or other
  modified_base (436)..(436): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtgggttcaccgtcactactaactccatgagctgggtccgcaggctccgagggaagggctggagtgggtctcgagtttatttagtagtggtggtggtgcagattacgcagactcgtgaaggcattcacatcncagagacaattccaatacgaacacgctagtatcttacaaatcgaaacncgcctagagacgcccgtaacgaccacgggtccctactaagttaccgtggtacggacgggaaccgggggtaacggttggggaaccgggggaagggacgggggacctaagggttacgggggtaaatttaacccggtttacgggaaccccggttaacggggttgggggggaaacccccg

SEQ ID NO: 427086 - DNA, 637 bp, Homo sapiens
  misc_feature: GZ8MTXP02J48MP.21.76.G10.1.454.CMB.2.raw
  modified_base (236)..(236): a, c, t, g, unknown or other
  modified_base (240)..(240): a, c, t, g, unknown or other
  modified_base (249)..(249): a, c, t, g, unknown or other
  modified_base (283)..(283): a, c, t, g, unknown or other
  modified_base (356)..(356): a, c, t, g, unknown or other
  modified_base (375)..(375): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttaccttgttactatttcaaaaggtgtccagtgtgaggtgcagctggtggagactggaggagacttgatccaaccgtgggtcggtcngacnctctcgtgngtcgtctggtcggtccacgtcactactaccgcangcgcggtcggaccgcgacggcctacgggaagtcggggagtcgtaggtcgtgtacttagtttagtagtttaggngggttcggtcggaggtacnctaaggtctaaccgggctccgggtacgtaacgggtcggaacggttccacttcaccctcgtacacgacgaataccaacttcggaactacggaactaccggtacttagtttctaaatttccgggaaaactacgacgacggacgtacggaccgacggacccgaaccggaccttaccggtcgttacttacgtacggtgtacgggacgggagtacgaggggaggaggggaacgtaggtacggtctacggttcgtacgtacggttcgg

SEQ ID NO: 427087 - DNA, 526 bp, Homo sapiens
  misc_feature: GZ8MTXP02FG5SX.21.76.G10.1.454.CMB.2.raw
  modified_base (453)..(453): a, c, t, g, unknown or other
  modified_base (468)..(468): a, c, t, g, unknown or other
  modified_base (493)..(493): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggttcaccgtcactactaactccatgagctgggtccgccaggctccaggggaaggggctggagtgggtctcagttatttatagtggtggtggtgcagattacgcagactccgtgaagggccgattcacatctccagagacaattccatgaacacgctgtatcttacaaatgaacagcctagagacgccgacgacncggcctactattacngtgcgacgggagtcggacggggagngggcaagtggatacttgaccacgtgggggaccg

SEQ ID NO: 427088 - DNA, 529 bp, Homo sapiens
  misc_feature: GZ8MTXP02JPT4H.21.76.G10.1.454.CMB.2.raw
  modified_base (294)..(294): a, c, t, g, unknown or other
  modified_base (362)..(362): a, c, t, g, unknown or other
  modified_base (493)..(493): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctgggggtccctgagactctcctgtgcggtctctgggttcaccgtcactactaactccatgagctgggtccnccaggctccgagggaaggggctggagtgggtctcgagttatttatagtggtggtggtgcagattacgnagactccgtgaagggccgattcaccatctaccagagacaattccatgaacacgctgtatcttacaaatgaactagcctgagagccgacgacacggccgtctatactgtgcgacgggagtggacggggaggngggcaagtggactacgttgacctacggtggggaccg

SEQ ID NO: 427089 - DNA, 621 bp, Homo sapiens
  misc_feature: GZ8MTXP02IY63S.21.76.G10.1.454.CMB.2.raw
  modified_base (296)..(296): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctctgggttcaccgtcactactaactccatgagctgggtccnccaggctccgagggaggggctggagtgggtctcgagtttatttagtagtggtggtggtgcagtattacgctagactccggtggaaacgggccgtattccgaccatcctaccagacgaactaattcccaatcgaaaccacgtctagtactcttacaaaattcgaaactagcctagaacgacgcccgaacggacgaccggtcccgtactaacttacgtggtgtaccgggaacggggtaggtacggggacgggggtaggggacggggacgtaaggttagggaacgtttaccgtttacggaaccccgtacgggttacggggggaacccg

SEQ ID NO: 427090 - DNA, 537 bp, Homo sapiens
  misc_feature: GZ8MTXP02HBB9K.21.76.G10.1.454.CMB.2.raw
  modified_base (295)..(295): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggttcaccgtcactactaactccatgagctgggtccnccaggctccgaggggaaggggctggagtgggtctctagttatttatagtggtggtggtgcagattacgcagactccggtgaagggccgattcaccatctccagagacaattccatgaacacgctgtatcttacaaatgaacagcctgagagccgagacacggccgtactatactgtcgcggacgggagtcggacggggaggagggacaagtggactacgtttgaccgtacggtgggggaccg

SEQ ID NO: 427091 - DNA, 537 bp, Homo sapiens
  misc_feature: GZ8MTXP02FLWWB.21.76.G10.1.454.CMB.2.raw
  modified_base (422)..(422): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggcttagctgggttttccttgttactatttcaaaaggtgtccagtgtgaggtgcagctggtggagactggaggagacttgatccaacctgggggtccctgagactctcctgtgcggtctctgggttcaccgtcactactaactccatgagctggtccgccaggcctccaggggaagggctggagtggggtctcagttatttatagtggtggtggtgcagattacgcagactccgtgaagggccgattccacatctccagagacaatccatgaacacgctgtatctanaaatgaacagcctgagacgccgacgacacggccgtactattactgtcggcgacggggagtggaacggggagggacgggcaggtggatacttcgaccacgtgggggactaacgggg

SEQ ID NO: 427092 - DNA, 538 bp, Homo sapiens
  misc_feature: GZ8MTXP02INTAP.21.76.G10.1.454.CMB.2.raw
  modified_base (296)..(296): a, c, t, g, unknown or other
  modified_base (435)..(435): a, c, t, g, unknown or other
  modified_base (499)..(499): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtgggttcaccgtcactactaactccatgagctgggtccnccaggctccgagggaggggctggagtgggtctcgagttatttatagtggtggtggtgcagattacgcagactccgtgaagggccattcacatctccagagacaattccatgaacacgctgtatcttacaaattgaaacngcctagaacgacgccgacgacacggccgtactattactgtcgcgacgggagtcggacgggaggnggcaagtggacttacgtttgaccgtacggtgggggaccg

SEQ ID NO: 427093 - DNA, 542 bp, Homo sapiens
  misc_feature: GZ8MTXP02JELK5.21.76.G10.1.454.CMB.2.raw
  modified_base (414)..(414): a, c, t, g, unknown or other
  modified_base (438)..(438): a, c, t, g, unknown or other
  modified_base (446)..(446): a, c, t, g, unknown or other
  modified_base (531)..(531): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacgtgggggtccctgagactctcctgtgcggtctctgggttcaccgtcactactaactccatgagctggtccgccaggctccgaggggaaggggctggagtgggtctctagttatttagtagtggtggtggtgcagattacgcagactccggtgaacgggccattcacatctccagagacaattccgatgaacncgctagtatctacaaatgaaaccngcctaganacgccgacgacacggccgtatagtactggtgacggacgggatcggacggggaggaggcaagtgggaatacgttagaccgtacggngggggtaaccg

SEQ ID NO: 427094 - DNA, 570 bp, Homo sapiens
  misc_feature: GZ8MTXP02G87PL.21.76.G10.1.454.CMB.2.raw
  modified_base (429)..(429): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtgggttcaccgtcactactaactccatgagcgtcgggtccgccaggctccgaggggaaggggctggagtgggtctcgtagtttattagtagtggtggtggtgctagtattacgcagactccgtagaacgggccgattcaccatcctccgagagaacaattccaatagaaccngctgtactcttacaaatgaactagcctagacgacgccgacgacacggtcctctaattccgtgtcgacggacgggtagcgggacggggaggacgggacaaggtacggaacttacgttacgacccgtagggtcggggaaccgg

SEQ ID NO: 427095 - DNA, 635 bp, Homo sapiens
  misc_feature: GZ8MTXP02JXVMP.21.76.G10.1.454.CMB.2.raw
  modified_base (445)..(445): a, c, t, g, unknown or other
  modified_base (473)..(473): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccaaccgtgggggtccctgagactctcctgtgcggtctcgtggtcaccgtcactactaactccatgagcgtcgggtccgccaggcctccgaggggaggggctggaggtgggtctcgtagtttattagtaggtggtggtggtgcagtattacgcagactccggtagaacgggtccgtattccacctatccctaccgagaacgaactaacgttcccaagtacgaaaccncgtcttagtactcttaacaaagtgaacngaccgtaggaacgacgacccggaacggacccgtaccgggtacccgttacttaagttaccgtgggtacggcggggtaacgggggagtcggggaaccgggggaggacgggactaaggtcgggtaacttccgttacggaccccgtaacggggtgggggaaccccg

SEQ ID NO: 427096 - DNA, 674 bp, Homo sapiens
  misc_feature: GZ8MTXP02GXJE7.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttacaaaaggtgtccagtgtgaggtgcagctggtggagacgtgggaggagacttgactccgaaccgtgggggtccctgacgactctcctgtgcggtctcgtggttcaccgtcactactactccatgagcgtggtcccgccgaggcctccgaggggaaggggcgtgggagtgggtctcgtaagtttatttagtaggttgggtggttggtcgacgtagtattacggcgtaacgtaccgtcccggtagggaaacggggtcccgtaattccgaaccctaattcccgtacccaaagtacgaaacctaaacgttcccaagtacgaaaccgacgtactagttaactacctttaaacaaattacgaaactacgccctagaaacgaccgacccgaacgaccgtaccggcccgtacttaactaacgtggtacggacgggacgggagtcggggaacggggaggacggactaaggtgggtaacttaccggttacgaaccgtacgggggttacgggggaacccg

SEQ ID NO: 427097 - DNA, 574 bp, Homo sapiens
  misc_feature: GZ8MTXP02F2QLL.21.76.G10.1.454.CMB.2.raw
  modified_base (294)..(294): a, c, t, g, unknown or other
  modified_base (373)..(373): a, c, t, g, unknown or other
  modified_base (390)..(390): a, c, t, g, unknown or other
  modified_base (436)..(436): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaggtgtccagtgtgaggtgcagctggtggagactggaggagacttgatccaaccgtgggggtccctgagactctcctgtgcggtctcgtgggttcacgtcactactaactccatgagctgggtccncaggctccgaggggaagggctggagtgggtctcgtagttatttagtaggtggtggtggtgcagattacgcagactccgngaagggcctattccacntctcagagacattcatacgaacacgctgtatcttacaaatgaaacngcagagacgccgacgacgaccgtcctactagtacgtcggtacggcgggaacggggtaggtacggggacggggaagggtcgggactaaggtacggtaacgttaccggttacggaacccggtacggggtacgggggaccg

SEQ ID NO: 427098 - DNA, 590 bp, Homo sapiens
  misc_feature: GZ8MTXP02GOG40.21.76.G10.1.454.CMB.2.raw
  modified_base (296)..(296): a, c, t, g, unknown or other
  modified_base (445)..(445): a, c, t, g, unknown or other
  modified_base (488)..(488): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagactggaggagacttgatccaaccgtgggggtccctgagactctcctgtgcggtctcgtgggttcaccgtcactactaactccatgagctgggccncaggctccgaggggaaggggctggaggtgggtctcgtagtttatttagtagtggtggtggtgcagattacgcagactcgtagaaggccattccacatctaccagagaacaattccatagaacacgctagtactcttaacaaatgaaacngcctaggaagacgccgaacgacgacggtccgtatattaccggnggtcggacgggaacgggaggtacggggaacgggggacggacggacgtaaggtacggtaacgttaaccgttacggaaacccgtacgggggtacgggggaaccg

SEQ ID NO: 427099 - DNA, 592 bp, Homo sapiens
  misc_feature: GZ8MTXP02GEW0W.21.76.G10.1.454.CMB.2.raw
  modified_base (297)..(297): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagactggaggagacttgatccaaccgtggggggtccctgagactctcctgtgcggtctcgtggttcaccgtcactactaactccatgagctgggtccnccaggctccgaggggaaggggctggaggtgggtctcgtagttatttagtagtggtggtggtgcagtattacgcagacgtccggtgaaacgggccgaattccaacctatcctaccaagacgaacaattcccaatacgaaaccacgtccttagtactcttaacgaaaatgaaactagccctaggagacgaccgacgacacggcctatatacgtggtcgacggtacgggagtacgggacggggaggacgggacaagtgggaacttacgttaggaacccgtagggtacggggaacccgg

SEQ ID NO: 427100 - DNA, 525 bp, Homo sapiens
  misc_feature: GZ8MTXP02I8RGT.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggttcaccgtcactactaactccatgagctgggtccgccaggctccgagggaggggctggagtgggtctcgagttatttagtagtggtggtggtgcagattacgcagactccgtgaagggccgatccacatctccagagacaattccatgaacacgctgtatcttacaaatgaacagcctagagacgccgacgacacggccgtactatactgtgcggacgggagtggacgggaggaggcaagtggatacttggaccagtgggggacg

SEQ ID NO: 427101 - DNA, 498 bp, Homo sapiens
  misc_feature: GZ8MTXP02JX6OH.21.76.G10.1.454.CMB.2.raw
  modified_base (194)..(194): a, c, t, g, unknown or other
  modified_base (220)..(220): a, c, t, g, unknown or other
  modified_base (400)..(400): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagagtcaccatcacttggccgggnggtcaggacattagacattattagcctggtatcagcagaaaccaggtaaagttccaagctctgatctatgctgcatcctctttgccaatcaggggtcccatcgtcgttcagtggcagtggatcgtgggactagtattcactctacaccatcaacgcacgcctgcagcctagaatagtgtnactaactttatactagtactaaaaatatacgactagtacgtccctctactaccgtttcggcgaacgacgggacaacggtacgactacgtacgaaaacg

SEQ ID NO: 427102 - DNA, 647 bp, Homo sapiens
  misc_feature: GZ8MTXP02GPN8W.21.76.G10.1.454.CMB.2.raw
  modified_base (457)..(457): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccaaccgtgggggtccctgacgaccctctcgtgcggtcgtcgtcggtcgtaccgtctactacctaacctaccactgacgcgtcggtccggccgacggcgtccgacggggaaggggacgtcggtaggtgggtcgtctagtttagtttagttagtggtggtggtgccgagattacgcagacgtccgtgagggaccgtacgttcaccgactctcccaagagaacaattccatagaacaccgnttagtatacttacaaaatggtaaacacggacctggaaggaccgcccccgaaacggaccaacccgggtacccgtcttaacttaacgtcggtacggaccgggtaacggggaggtcggaagggggaacggggaggtccggaatcggggtaattaacgtttcggaaccgacgggttcgggggacaaccccgggg

SEQ ID NO: 427103 - DNA, 596 bp, Homo sapiens
  misc_feature: GZ8MTXP02GGUCD.21.76.G10.1.454.CMB.2.raw
  modified_base (369)..(369): a, c, t, g, unknown or other
  modified_base (452)..(452): a, c, t, g, unknown or other
  modified_base (507)..(507): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagactggaggagacttgatccaacgtgggggtccctgagactctcctgtgcggtctcgtgggttcaccgtcactactaactccatgagcgtcgggtccgccaggctccgaggggaaggggctggagtgggtctcgtagttatttagtagtggtggtggtgctagatacgnacgactccggtagaacgggccgattccgacctatcctaccagtacgactaaactccaatacgaaccaacgctagtattctaanaaatacgaaactgcctagagacgccgaacgaccgacggcccgtactaacgttacngtacggacggtacgggagtcggggaacgggagggacgggacaaggttacggaacttacggttacgaaccggtacggtcgggggaaccgg

SEQ ID NO: 427104 - DNA, 606 bp, Homo sapiens
  misc_feature: GZ8MTXP02IZG1G.21.76.G10.1.454.CMB.2.raw
  modified_base (293)..(293): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagctctcctgtgcgtctcgtggttcaccgtcactactaactccatgagctgggtccnccaggctccgagggagggctggagtgggtctcgtagtttatttagtaggtggtggtggtcgcagtattacgcagactccggagaacgggccgtattccaccatcctaccgagagaactaagttcccaatacgaacacgtcttagtactcttaacaaattcgaaactacgacctaggaacgacgaccgacgacgaccggtcgtactagttcgtgtacggaccgggacgggtagtacggggaacgggggaagggtacggggactaaggttagggaactttacggtttacgacccgtacggggtacgggggaaccg

SEQ ID NO: 427105 - DNA, 684 bp, Homo sapiens
  misc_feature: GZ8MTXP02H979V.21.76.G10.1.454.CMB.2.raw
  modified_base (596)..(596): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtgggggtccctgagactctcctgtgcgtctcgtggttcaccgtcactactaactccatgagcgtcgggtcccgccgaggcctccggaggggaacggggcgtgggaggtcggggtctacgtagtttattaagtaggttgggtagggtggtcgacgtaagtacgttaccgacgtacggtaccgtcccggggtagggaaaccgggggtcccgtaacgtttcccaacccgtacttcccgtaacccgaaagaacggtaaacctaaactttcccgaagttacgaaaacctcgtccttagtactctttaaaccaaattacgaaactcgacctggaaacgacgaccgaaccgacgaaccgggtcctagttacttaccgnggtacggacggtacgggagtcgggacgggggaggtacggagaaggttacggaacttacggttacgaccggtacggtcggggaacccgg

SEQ ID NO: 427106 - DNA, 527 bp, Homo sapiens
  misc_feature: GZ8MTXP02JY2IV.21.76.G10.1.454.CMB.2.raw
  modified_base (436)..(436): a, c, t, g, unknown or other
  modified_base (444)..(444): a, c, t, g, unknown or other
  modified_base (453)..(453): a, c, t, g, unknown or other
  modified_base (459)..(459): a, c, t, g, unknown or other
  modified_base (490)..(490): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctggggggtccctgagactctcctgtgcggtctctgggttcaccgtcactactaactacatgagctggggtccgccaggctccgaggggaaggggctggagtgggtctcagttattatagtggtggtggtgcagattacgcagctccgtggaacggccgattcacatctccagagacaattcccatgaacacgctgtactcttacaaatgaacngcctgagnccgacgacncggctntatactgtgcgacggggatcggacgggaggnggcaagtggacttacttgaccgtacggtgggggaccg

SEQ ID NO: 427107 - DNA, 546 bp, Homo sapiens
  misc_feature: GZ8MTXP02HYAP3.21.76.G10.1.454.CMB.2.raw
  modified_base (294)..(294): a, c, t, g, unknown or other
  modified_base (393)..(393): a, c, t, g, unknown or other
  modified_base (464)..(464): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctggttcaccgtcactactaactccatgagctgggtccnccaggcctccgagggaaggggctggagtggggtctcgagtttatttatagtggtggtggtgcagattacgcagactccgtgaagggccgattcacatcncagagacaattccatgaacagctgtatcttacaaatcgaacagcctagagacgccgacgacacggcccgtntacttactgtgcggacgggaggtcggacggggaggagggacgaagtgggacttacgtttgacccgtacggtacgggggaccg

SEQ ID NO: 427108 - DNA, 622 bp, Homo sapiens
  misc_feature: GZ8MTXP02IXDZV.21.76.G10.1.454.CMB.2.raw
  modified_base (474)..(474): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccaaccgtggggggtccctgagactctcctgtgcggtctcgtggttcaccgtcactactaactccatgagctgggtcccgccgaggctccgaggggaggggctggaggtgggtctcgtagtttatttagtagtgggtggtggtgcagtatacgcagactccggtaggaacgggccgtattccaaccgtatccctaccaagtacgaactaacttcccatacggaaccacgtctagtactcttaacaaattgaaaacngtaccctaggacgaacgcccggaacgaccgaacgggtccttactagtttaccgtggtacggaccgggacggggaggtacgggaacgggggaggtacggggctaaggtggtaacttacggttcgaacccgtagggtacgggggaacccg

SEQ ID NO: 427109 - DNA, 583 bp, Homo sapiens
  misc_feature: GZ8MTXP02FSK1U.21.76.G10.1.454.CMB.2.raw
  modified_base (294)..(294): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctgggggtccctgagactctcctgtgcggtctctgggttcaccgtcactactaactccatgagctgggtccnccaggctccgagggaaggggctggagtggggtctcagttatttagtagtggtggtggtgcagattacgcagactccgtgaacgggccgattcacatctaccagacgacaattccatgaacacgctgtatcttacaaaatgaaacaggccctaggaacgacgacccgacgaaccgtaccggtccgtacttagttaccgtggtcgggaccggacgggggagtcggaacgggggagggacgggacgaagtggggaacttacgtttacggaccgaacggttcgggggaacccg

SEQ ID NO: 427110 - DNA, 526 bp, Homo sapiens
  misc_feature: GZ8MTXP02JMBTL.21.76.G10.1.454.CMB.2.raw
  modified_base (295)..(295): a, c, t, g, unknown or other
  modified_base (361)..(361): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggttcaccgtcactactaactccatgagctgggtccnccaggctccgagggaggggctggagtgggtctcagttatttatagtggtggtggtgcagattacgnagactccggtgaacggggccattcaccatctccagagacaattccatgaacacgctgtatcttacaaatgaacagcctgagagccgacgacacggcctctatactgtgcgacgggagtcggacgggaggagggcaagtggatacgttagaccgacgtgggggacg

SEQ ID NO: 427111 - DNA, 582 bp, Homo sapiens
  misc_feature: GZ8MTXP02HUC0B.21.76.G10.1.454.CMB.2.raw
  modified_base (295)..(295): a, c, t, g, unknown or other
  modified_base (415)..(415): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtgggtcaccgtcactactaactccatgagctgggtccnccaggcctccgaggggaagggctggagtgggtctcgagtttattataggtggtggtggtgcagattacgcagctccgtgaacggccgattcaccatccacagagacaattccatagaacncgtctagtactcttacaaatgaaactagcctagacgagacccgaacgtacgaccgggtcctacttaataccgtggtacggccggaacgggtaggtcgggaccgggggaaggagggtccaagttcgggaactttacggtttacgacccgtacgggtcgggggaacccg

SEQ ID NO: 427112 - DNA, 535 bp, Homo sapiens
  misc_feature: GZ8MTXP02JU0DN.21.76.G10.1.454.CMB.2.raw
  modified_base (500)..(500): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtgggttcaccgtcactactaactccatgagctgggtccgccaggctccgagggagggctggagtgggtctcagttatttatagtggtggtggtgcagattacggcagactccgtgaacgggccgattcaccatctccagagacaattccatgaacacgtctgtatcttacaaatgaacagcctgacgagcccgacgaccgacggccgtatactactcggtgcgacgggagtacgacggggagnggcaagtcggatacgttgaccgacgtgggggaccg

SEQ ID NO: 427113 - DNA, 544 bp, Homo sapiens
  misc_feature: GZ8MTXP02HN9ND.21.76.G10.1.454.CMB.2.raw
  modified_base (309)..(309): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatcgacccagtcctccatcctccctgtctgcatctgtaggagacagagtcaccatcacgttggcccgggcggtcaggacattagacattatttagcctggtatcagcaagaaaccaggtaaacttcccaagctcctgatctatgctgcactcctntttgacctagtcgacggggtccctatccgttcggttcaggtggtacgaggttgagttcgtgggacgtagtatttcaactctacacatcacgcacgctgctagccgttagagtatgttcgacttaacttatttactaagttaactaaaaatatacgactaggtcctaccctactaccgtacgtttccggacgtaaccgacgggaccgtaggtacggaacacgttaacgaaaaccgg

SEQ ID NO: 427114 - DNA, 627 bp, Homo sapiens
  misc_feature: GZ8MTXP02F0SAV.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccgaaccgtgggggtccctgagactctcctgtgcggtctcgtgggttcaccgtcactactaactccatgagctcgggtccgccaggcctccgaggggaacggggctgggaggtgggtctcgtagtttatttatagtggtggtggtgcagtattacgcagactccggtggaacggggccgattccaaccatcctaccaagacgaacaaattcccaatacgaacacggtcttagtactcttaacaaatcgaaacagcctagaagacgccgacgaccgacggtccgtataacgttaccgtggtacggaccggaacggggtaggttacgggaccgggggaagggacgggggacctaaggtacgggtaactttacggtttacggaacccgtacggggttacgggggaaacccgg

SEQ ID NO: 427115 - DNA, 567 bp, Homo sapiens
  misc_feature: GZ8MTXP02GGCFJ.21.76.G10.1.454.CMB.2.raw
  modified_base (297)..(297): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtgggggtccctgagactctcctgtgcggtctcgtggttcaccgtcactactaactccatgagcgtgggtccncaggcctccgaggggaggggctggagtgggtctcgagtttatttagtagtggtggtggtgcagtattacgcagactccggtgaacgggccgtattccaacatcctaccagaagacaattccatacgaacacgctgtactcttacaaatagaacagcctagagacgaccgacgacgacggccgtactattactggtcgacggacgggaggtcggacggggaggacgggagaagtggtaacttacgttgacccgtacggtacgggggaaccg

SEQ ID NO: 427116 - DNA, 548 bp, Homo sapiens
  misc_feature: GZ8MTXP02IS209.21.76.G10.1.454.CMB.2.raw
  modified_base (195)..(195): a, c, t, g, unknown or other
  modified_base (222)..(222): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatcgacccagtctccatcctccctgtctgcatctgtagganacagagtcaccatcacgttggccgggnggtcaggacattagactattattagcctggtatcagcaagaaaccaggtaaacgtccaagctacctgatctatcgctgctacttccttctttcgacctaacgtccgacggggtcccctagttccgttcggttcgtagtcggctaggtgatcggtagggactagtactttcactctacacatcacgacacgctgcacgcctagatagtagttacacttaacttagttaactagtaaactaaaattataacgtactaacgtcctaccctctccgtaccgttcggacgaacgacggaacgtaacggtacgaactacgaacgtaaaacgg

SEQ ID NO: 427117 - DNA, 611 bp, Homo sapiens
  misc_feature: GZ8MTXP02HWRB2.21.76.G10.1.454.CMB.2.raw
  modified_base (291)..(291): a, c, t, g, unknown or other
  modified_base (367)..(367): a, c, t, g, unknown or other
  modified_base (402)..(402): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacgtgggggtcctgagactctcctgtgcgtctctggtcaccgtcactactaactccatgagctcgggtccnccgaggctccgaggggaaggggctggagtggggtctcgtagtttatttagtaggtggtggtgtcgctagattacgnagactcggtgaaacggccattcactatccacaganacattccaagtgaacctgctagtactcgttaacaaatagaaactgtaccctaggacgaacgcccggaacgacgaccgggtccgtaactactttaacgtcggcgggaccgggaacggggtaggtacggggaaccgggggaagggacggggtacaaaggttcggggaaactttaccggtttaggacccggtaagggttcgggggaaacccg

SEQ ID NO: 427118 - DNA, 616 bp, Homo sapiens
  misc_feature: GZ8MTXP02F4OS0.21.76.G10.1.454.CMB.2.raw
  modified_base (478)..(478): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagactggaggagacttgatccaaccgtcgggggtccctgagactctcctgtgcgtctcgtggttcaccgtcactactaactccatgagcgtcgggtccgccaggcctccgaggggaacggggcgtggaggtgggtctcgtagtttatttagtaggtggtggtggtcgcgagattacgcagacgtccgtaggaacgggtccgtattccacatcctacagaacactaattcccaatacgaacctacgcgttagtacttacttaacaaaattcggaaaaccncgtaccgtagaacggaccgaccgaacgacgaccggtcttactacgtcgtggacgcgggaacggggagacggggacggggagggacggactaacggttaggtaacttacggttacgaaccggtaggggacggggtaacg

SEQ ID NO: 427119 - DNA, 666 bp, Homo sapiens
  misc_feature: GZ8MTXP02JE65X.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttcctgttactatttcaaaaggtgtccagtgtgaggtgcagctggtggagacgtggaggagacttgatccgaaccgtgggggtcctgagctctcctgtgcgtctcgtggttcaccgtcactactactccatgacgcgtcgggtccgcgaggctccgaggggaaggggctagggaggtgggtctacgtagtttatttagtaggttggtggtggtcgcgaagtacgttacgcacgtaccgtccgggtaggaacggggtccgtattccgaacctatcccgtaccaagaacgtaactaacgttcccagtacgaaaccacgtctacgttaacttccttaacaaagttcggaaactacgtacctaggaacgacggacccggaacgtaccgaccgggtacccttacttaaacgttaccggtggtacggtaccgggaaacgggggttagacggggacgggggaaggacgggacgtaaggtcggtaacgttaccgtttacggaaccggtcgggtacgggggaaccg

SEQ ID NO: 427120 - DNA, 555 bp, Homo sapiens
  misc_feature: GZ8MTXP02JMN3Z.21.76.G10.1.454.CMB.2.raw
  modified_base (295)..(295): a, c, t, g, unknown or other
  modified_base (435)..(435): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctggggggtccctgagactctcctgtgcggtctctgggttcaccgtcactactaactccatgagctgggtccnccaggctccgagggaggggctggagtgggtctcagttatttatagtggtggtggtgcagattacgcagactccgtgaagggccgattcacctatcctccagagacaattccatgaacacgctgtatcttacaaatgaacngcctgagacgccgagacacggccgtactattacgtggtcgacggacgggaggtacggacggggtaggacggggacaaggtacggtaacttacgtacggaccggtacgggtacgggggacg

SEQ ID NO: 427121 - DNA, 606 bp, Homo sapiens
  misc_feature: GZ8MTXP02GRDWY.21.76.G10.1.454.CMB.2.raw
  modified_base (297)..(297): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgactccgaaccgtgggggtccctgagactctcctgtgcggtctcgtggtcaccgtcactactaactccatgagctcgggtccnccgaggctccgaggggaacggggctgggaggtgggtctcgtagtttatttagtaggtggtggtggtgcagtattacgcagactccggtaggaacgggccgtattccaacctatccctaccaagacgaactaacttcccaatacgaactacgcctagtactcttaacaaaattcgaaactgcctaggaagacgaccgacgaacgaccggccgttactacgttaccgtggcgaccggacgggagggtacggacgggggaggacggtcaaggtggtaacttacgttcgaacccggtaggtacgggggacccg

SEQ ID NO: 427122 - DNA, 586 bp, Homo sapiens
  misc_feature: GZ8MTXP02FLSJL.21.76.G10.1.454.CMB.2.raw
  modified_base (403)..(403): a, c, t, g, unknown or other
  modified_base (419)..(419): a, c, t, g, unknown or other
  modified_base (444)..(444): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggcttagctgggttttccttgttactatttcaaaaggtgtccagtgtgaggtgcagctggtggagactggaggagacttgatccaaccgtgggggtccctgagactctcctgtgcggtctcgtgggttcaccgtcactactaactccatgagctgggtccgccaggctccgaggggagggctggagtgggtctcgtagttattagtaggtggtggtggtgcagattacgcagactcgtggaacgggcgtattccgactatcctcaganaactattccatgaacncgctgtatacttacaaatcgaaacncgcctaggaagtacgacccgaacggaccacgggtcccgtactaagttaccgtggtacggccggaaggggtacgtcgggaacggggagggacgggcaaaggtggaacttacgttcggaacgacggtcgggggacaacccgggg

SEQ ID NO: 427123 - DNA, 587 bp, Homo sapiens
  misc_feature: GZ8MTXP02H4LQT.21.76.G10.1.454.CMB.2.raw
  modified_base (195)..(195): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatcgacccagtcctccatcctcctgtctgcatctgtagganacagagtcaccatcacgttggccgggcggtcaggacattagactattattagcctggtatcagcaagaaaccgaggtaaacgttccaagtctacctgatctatgctgctatcctctttgacctatccgacggggtccctatcgttcgttcgagtggcgagtggatcgtaggactagtacttcactctactacctagtcacgtacacgctgacacgtcctagaacgtagtagtacgtactaaaccgtttagtaacttaacgtaactaaaaattacgtaacggtactaacggttcctaccccttacgttaccgttaaccgtttccggaccggtaacgtaaccggggaaaccgtaacggggtacggaaacgttacgttaaaaccgtaaaacccgg

SEQ ID NO: 427124 - DNA, 619 bp, Homo sapiens
  misc_feature: GZ8MTXP02GLHKA.21.76.G10.1.454.CMB.2.raw
  modified_base (273)..(273): a, c, t, g, unknown or other
  modified_base (308)..(308): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggtagttttggctgagtcttgggtttttccttgttactatttacaaaaggtgtccagtgtgaggtgcagctggtggagactgggaggagacttgatcccgaaccgtggggggtccctgagactctcctgtgcggtctcgtggttcnccgtcactacaactccatgagtcgtcggggtcccnccgagggcctaccggaaggggaacggggtctggggagtggggtcctagtagtttaagtttagtaggtgggtggtggtgcgagagtttacgcagtaccgttccggagggaaacgggggccctaattccaccattccaccgagactaacaaattcccaattcggaaactcgcttattaatcttaaacgaaatagaacacgacagagacgacgacgacgacgccgtacctattactgtgacggacgggaggacggacggggagggaggagaagtaggtagttacgtttacgtacgtaacggcggggaaccgggg

SEQ ID NO: 427125 - DNA, 562 bp, Homo sapiens
  misc_feature: GZ8MTXP02FRXX7.21.76.G10.1.454.CMB.2.raw
  modified_base (303)..(303): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagactgggaggagacttgatcccgaaccgtggggggtccctgagactctcctgtgcggtctcgtgggttcaccgtcactactaactccatgagcgtgggtcccncaggctccgagggaggggctggagtgggtctcgtagttatttagtagtggtggtggtgcagattacgcagactcgtgaacgggctattcacatctacagagacaattccatagacacgcttgattctacaaatgaacagcctaggagacgccggacgacgacgggcctatacttacgtggtcggcgaacggggtagtacgggacggggaaggcgggacaaggtcggaagttacgttggaacccgcggtagggggaaccg

SEQ ID NO: 427126 - DNA, 645 bp, Homo sapiens
  misc_feature: GZ8MTXP02G4VL4.21.76.G10.1.454.CMB.2.raw
  modified_base (463)..(463): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagcgtggtggagacgtgggaggagacttgactccgaaccggttcggggggtccctggacgactctcctgtgtcgtctcgtggtcaccgtcactactaactcatgagcgtcggtccgccgaggcctaccggaaggggaacggggcgtaggggaggttgggtactacgttagtttatttagtaggtggtggtggtcgcgagtattacgcaggtaccgtcggtaggaacggtcgtacttccacatcctacagaacactaacgttccataggaaccncgtacttagtactctaaagaaatacgaacacgcctaggaacgaccgaccggaaccgaccgtacccgggtaccttacttaacgtacgtgggacgacgggtaccggggtagtacggggacgggggaaggccggagtaacgttaggtactttaacgttcggacccgtaggggtcggggaaacccg

SEQ ID NO: 427127 - DNA, 583 bp, Homo sapiens
  misc_feature: GZ8MTXP02HYDMP.21.76.G10.1.454.CMB.2.raw
  modified_base (295)..(295): a, c, t, g, unknown or other
  modified_base (387)..(387): a, c, t, g, unknown or other
  modified_base (390)..(390): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtggttcaccgtcactactaactccatgagctgggtccncaggctccgagggagggctggagtgggtctgtagtttattagtagtgggtggtcggtgcagtattacgcagactcgtgaagggccattcacntcnccagagacaattccatacgaacacgctgtactctacaaatcaacacgcctaggagacgaccgaacgacgacggacccgttactaacttacgtggtacggaccgggtaacggggagggtacggacgggggaggggaacgggaccgaaggtacgggtactttacggttcgaaccggtacggtacgggggaacccg

SEQ ID NO: 427128 - DNA, 666 bp, Homo sapiens
  misc_feature: GZ8MTXP02I9NZ8.21.76.G10.1.454.CMB.2.raw
  modified_base (297)..(297): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtgggttcaccgtcactactaactccatgagcgtgggtccnccgaggctccgagggagggctggagtgggtctcgagtttatttagtaggtggtggtggtcgcagtattacgcgagacctccgggtaggaacggggtccgtaattccgacctagttcctacccgagtacgaactaacttcccaagtacgaaacctacgtcttagtacttcgtttacaaaaacgttcgaaaccagtcccgttaggaacgacggccccggaacgaaccgtaaccggggtcccttaccgttaaagttaacccgttgggtacggaccgggaaccgggggtagtacggggaccgggggtaggggacgggactaaggtcggaagtttaccggttacggaacccggtaccgggtaggggggaacccg

SEQ ID NO: 427129 - DNA, 617 bp, Homo sapiens
  misc_feature: GZ8MTXP02HGNPH.21.76.G10.1.454.CMB.2.raw
  modified_base (418)..(418): a, c, t, g, unknown or other
  modified_base (438)..(438): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtgggttcaccgtcactactaactccatgagcgtgggtccgccgaggctccgaaggggaacggggctggagtgggtcctgtagtttattagtaggtggtggtggtcgacaggtattaacgcagactccggtagaacggggcctattccacattccaccaganaacaacttccaatgaaaccncgtactagtacttactaacaaatacgaacacgacgtaggagacgacccggaacgaccgtaccggtaccttactaacgttacgtcggtacggaccggacgggagggtacgggaacgggggacggacggtacgtaaggtaggtaacgttacgttacgaaccggtacgggtacgggggaccg

SEQ ID NO: 427130 - DNA, 551 bp, Homo sapiens
  misc_feature: GZ8MTXP02IOWUV.21.76.G10.1.454.CMB.2.raw
  modified_base (298)..(298): a, c, t, g, unknown or other
  modified_base (335)..(335): a, c, t, g, unknown or other
  modified_base (455)..(455): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtgggggtccctgagactctcctgtgcggtctctgggttcaccgtcactactaactccatgagctcgggtcccnccaggcctccgaggggaggggctgggaggtgggtctntagtttatttagtaggtggtggtggtgcagtattacgcagactccggtgaacggtccagttccacatcctaccagacgacaattcccaatcgaacacgctagtatcttacaaatgaaacngcctgagacgccgacgtacgacggcgtatatactgtcgcggagggagtcggacggggagcggactaagtaggacttacgtgaccaggtcggggacg

SEQ ID NO: 427131 - DNA, 648 bp, Homo sapiens
  misc_feature: GZ8MTXP02G2V6X.21.76.G10.1.454.CMB.2.raw
  modified_base (296)..(296): a, c, t, g, unknown or other
  modified_base (372)..(372): a, c, t, g, unknown or other
  modified_base (439)..(439): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtgggtcaccgtcactactaactccatgagcgtcggtccnccgaggcctccgaggggaggggctggaggtgggtctcgtagttatttagtagtggtgggtgtcgctagtattacgnagactccgggtgaacgggcctattccgaaccatccaccaagacgaactaacttccaatacgaaaccncgtcttagtaacttcttaaacaaaattcgaaactacgcctaggaacgacggacccgaacggaccgaccgggtccttataacgttacggtggtcggacggggtaacgggggagtacgggggaaccgggggtaaggacgggtaccgtaaaggttcgggtaaaactttaccggttacggaaaaccccggttgggggtacggggggaaacccg

SEQ ID NO: 427132 - DNA, 541 bp, Homo sapiens
  misc_feature: GZ8MTXP02J1G3O.21.76.G10.1.454.CMB.2.raw
  modified_base (358)..(358): a, c, t, g, unknown or other
  modified_base (392)..(392): a, c, t, g, unknown or other
  modified_base (502)..(502): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggttcaccgtcactactaactccatgagctgggtccgccaggcctccgagggaaggggctggagtgggtctcagtttattagtagtggtggtggtgcagnttacgcagactccgtgaaagggccatcaccatcnccagagacattccatgaacacgctgtatcttacaaatgaacagcctgagacgaccgacgacgacggcctacgtatactgtgcggacgggagtcggacgggagggacgggngaagtggtacgttacgttacgaccgtacggtcggggacg

SEQ ID NO: 427133 - DNA, 708 bp, Homo sapiens
  misc_feature: GZ8MTXP02H1GB2.21.76.G10.1.454.CMB.2.raw
  modified_base (296)..(296): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactattttcaaaaggtgtccagtgtgaggtgcagctggtggagactggaggagacttgatccaaccgtgggggtccctgagactctcctgtgcggtctcgtgggtcaccgtcactactaactccatgagctgggtccnccgaggcctaccgagggaaggggctggagtggggtctcgtagtttatttagtagtgggtggtggtcgcagtattacgcagactccggtaggaacgggccgtattcaccatcctacgagacgaactaaacgttcccaagttacggaaaccctacggtacttaggttaaacttccttaaaccgtaaaagttcggaaaacttagacccgttagggaaccggacgacccggtaacggacccgtaaccggggtcccctagtttaaactttaacccggttggacgggtacccgggtaacgggggtaaggttacggggaaaaccgggggtacgggggaaggggtaccgtaaaggttagggtaaacgtttacgtttaccggggaaaccccgttacgggggtttaccggggggaaacccgg

SEQ ID NO: 427134 - DNA, 543 bp, Homo sapiens
  misc_feature: GZ8MTXP02GDBII.21.76.G10.1.454.CMB.2.raw
  modified_base (297)..(297): a, c, t, g, unknown or other
  modified_base (392)..(392): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagactggaggagacttgatccaaccgtggggggtccctgagactctcctgtgcggtctctgggttcaccgtcactactaactccatgagctgggtccncaggctccgaggggaggggctggagtggggtctcgagtttatttataggtggtggtggtcgcagattacgcagctccgtgaaggcattcacatcncagagacaattccatgaacacgctgtatcttacaaatgaaacagcctagagacgccgacgacgacggccgtactattactgtcgcgacggggagtggacggggaggagggacaagtacggattacgttcgaccgtacggtcgggggaaccg

SEQ ID NO: 427135 - DNA, 636 bp, Homo sapiens
  misc_feature: GZ8MTXP02JB9HY.21.76.G10.1.454.CMB.2.raw
  modified_base (248)..(248): a, c, t, g, unknown or other
  modified_base (298)..(298): a, c, t, g, unknown or other
  modified_base (470)..(470): a, c, t, g, unknown or other
  modified_base (498)..(498): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactgggaggagacttgatcccgaaccgtgggggtccctgagactctcngtgcgtctcgtgggttcacgtcactactaactccatgagcgtcgggtccnccgaggcctccgaaggggaagggctgggagttgggtcttacgtagtttattagtaggttggtggtggtacgctaaggtacttacggcgaagtacgtccgggtagaaacggggcccgtaattccaactattccaccgagaacgaactaagttccaaagtacggaactaccggnttagaacttactaaagaaagtagaaacncgtacaggaacgaccgaccgaacgaccgtacggtacctatacgtacgtggcggacgggaacggggagacggggacgggaaggacggtctaaaggtacggtaaactttcggtacggaaccggtaggggacggggaaccg

SEQ ID NO: 427136 - DNA, 583 bp, Homo sapiens
  misc_feature: GZ8MTXP02HZXDH.21.76.G10.1.454.CMB.2.raw
  modified_base (431)..(431): a, c, t, g, unknown or other
  modified_base (445)..(445): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgactccaaccgtgggggtccctgagactctcctgtgcgtctcgtggtcaccgtcactactaactccatgagcgtcgggtcccgccgaggcctccggaggggaacggggcgtgggaggtgggtctcgtagtttatttagtagtggtggtggtgcagtatacgcagactccggtgaacggccattccacatctaccagacgacaattccatacgaaccncgctgtactctaanaaatgaaactgcctagacgacgccgaacgacgaccggtccgtatacttacgtaggtcgacggtacggggagtcgggaacggggtacggagggacaaggtggtaacttacgttacggaccgtacgggtcgggggaaccg

SEQ ID NO: 427137 - DNA, 662 bp, Homo sapiens
  misc_feature: GZ8MTXP02HTYMZ.21.76.G10.1.454.CMB.2.raw
  modified_base (295)..(295): a, c, t, g, unknown or other
  modified_base (471)..(471): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatacccgaaccgtgggggtccctgagctctcctgtgcgtctcgtggtcaccgtcactactaactcatgagctcgggccncgacggctccggaggggagggcgtggtagtcgggtctgtagtttattagtaggtggtggtggtcgacgtagtacttacgcacgtacgtccggtagggacggacgtacttccactactccgaccaagtacaactaacttcccgaattagaaacctcgtctagtaacttccttaaaanaaacgtcgaaacgtcgactaaggaccgaacgcccgtaacgaccgtacggtaccttagtacgttcggtaggtccggggaacgggtaacgggtgggtaacggggacgggggaacgggtacggtagtaaacggttacggtaaacggtttaccggtaccggaaacccgggtacgggggtaaccgggggtaacccg

SEQ ID NO: 427138 - DNA, 584 bp, Homo sapiens
  misc_feature: GZ8MTXP02IRUOO.21.76.G10.1.454.CMB.2.raw
  modified_base (295)..(295): a, c, t, g, unknown or other
  modified_base (436)..(436): a, c, t, g, unknown or other
  modified_base (446)..(446): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagactgggaggagacttgatccaaccgtgggggtccctgagactctcctgtgcgtctctggttcaccgtcactactaactccatgagctgggtccnccaggctcgaggggaggggctggagtgggtctcgtagtttattagtagtggtggtggtgcagattacgcaggactccggtgaacgggccgattccgactatctccagagacaatccaatgaaccacgtctagtactcttanaaatgaaacngaccctggaacgacgacccgacgtaaccgacgggtccttactaatttacctggttcggaccgggtacggggaaggtcgggaacgggggagggagggacaaggtggactttacgttcgaccgtacggtacgggggaccg

SEQ ID NO: 427139 - DNA, 632 bp, Homo sapiens
  misc_feature: GZ8MTXP02I3103.21.76.G10.1.454.CMB.2.raw
  modified_base (420)..(420): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctctgggttcaccgtcactactaactccatgagctgggtccgccaggctccgagggaggggctggagtgggtctcgtagtttatttataggtggtggtggtgcagtattacgcagactccgtgaacgggccattccacatctccagacgacaattccatacgaacncgctgtatcttacaaattcgaactagccctaggaacgtacggcccggtaacgaccgtaaccggggtcccttacgttaacgtttaaccgtcgggttcggaaccgggtaccgggggtaggttacggggaccgggggaaaggggacggggtaccaagggttcggtaaacgtttaccggtttacggaacccgtacggggttacggggggaaacccg

SEQ ID NO: 427140 - DNA, 687 bp, Homo sapiens
  misc_feature: GZ8MTXP02I3S3X.21.76.G10.1.454.CMB.2.raw
  modified_base (292)..(292): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttcctgttactatttcaaaaggtgtccagtgtgaggtgcagctggtggagactgggaggagacttgatccaaccgtgggggtccctgagactctcctgtgcgtctctggttcacgtcactactaactccatgagctgggtccnccaggctccgaggggagggctggagtgggtctcgtagtttatttagagttggtggtggtcgcgagtacttacggcaacggtacctccgggtaggaaacggggtcccgtaatttcccgaaccaattccctacccgaaaggtaaccgaactaaaacgtttcccaaagttacggaaaccctacggtccttaggtaaacttcctttaaacaaaaagtttcggaaaaccctagggtacccctaagggaacggaacccggacccggtaaacgaccgtaaccggggtccttacgtaaactttacgtggtacgaccgggacggggtagtcggacgggggaggacgggactaagggtcggtaacttaacccgttggaaaacccgtcggggttagggggaacccg

SEQ ID NO: 427141 - DNA, 695 bp, Homo sapiens
  misc_feature: GZ8MTXP02JEICU.21.76.G10.1.454.CMB.2.raw
  modified_base (294)..(294): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtggttcaccgtcactactaactccatgagctggtccncgagctccgagggagggctggagtgggtctcgtagttatttagtagtgggtggtggtcgcgagtattacgcagacgtccggtaggaaacgggtccgtagttccaactatcccgtacccgaagaacgtaacctaaattcccaagttacgaaaccgtacgtacttagttactacctttaacaaaacgttgaaacccgtacgtacccgtagggaaaccggaccgaccccgggaaacgaccggtaaccccgggttccgttaacgtttaaagttaaacggtgggttaccggacgggggaaacgggggtaggtacgggggaaccgggggaaggggaacggggtaccaagggttacgggtaaactttacgtttacggaacccggtacggggttacggggggaaacccg

SEQ ID NO: 427142 - DNA, 531 bp, Homo sapiens
  misc_feature: GZ8MTXP02GA3RB.21.76.G10.1.454.CMB.2.raw
  modified_base (297)..(297): a, c, t, g, unknown or other
  modified_base (371)..(371): a, c, t, g, unknown or other
  modified_base (382)..(382): a, c, t, g, unknown or other
  modified_base (385)..(385): a, c, t, g, unknown or other
  modified_base (402)..(402): a, c, t, g, unknown or other
  modified_base (461)..(461): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctcgtgggttcaccgtcactactaactccatgagctgggtccncaggctccgagggaggggctggagtgggtctctagttatttagtagtggtggtggtgcagattacgcagctcgngaggcatcacntcncagagacatcatgaacncgctgtactcttacaaatgaacagcctagagacgccgacgaccgacggcctatattacngtgacggacgggagtcggacggggaggacggcaagtggacttacgttacgaccgtacggtgggggaaccg

SEQ ID NO: 427143 - DNA, 693 bp, Homo sapiens
  misc_feature: GZ8MTXP02JE3X8.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtgggggtccctgagactctcctgtgcggtctcgtgggttcaccgtcactactaactccatgagcgtcgggtccgccaggctccgaggggaacggggcgtggagtgggtctcgtagtttatttagtaggtggtggtggtgcgagtagttacgcaggtactccggtaggaacggggccattccgaccatcctaccagacgaactaacttcccaagtacgaacctacggtcttagtaacttccgtttaacaaaattcggaaaactggtaccctagggaacgacggaccccggaacgaacgtacccggggtaccgttacttaaacgttccgtgggttacggaccggggtaaaccgggggtaaggttacggggaaaccggggggaagggaccgggggtactaaggggtttacggggaaaacttttacccggtttaggaacccccggttagggggttaccggggggtaaacccg

SEQ ID NO: 427144 - DNA, 634 bp, Homo sapiens
  misc_feature: GZ8MTXP02IDLYI.21.76.G10.1.454.CMB.2.raw
  modified_base (299)..(299): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagactgggaggagacttgatccaaccgtgggggtccctggagactctcctgtgcgtctcgtggtcaccgtcactactaactccatgagcgtcgggtcccnccgaggcctccgaggggaaggggcgtgggaggtggggtctcgtagtttatttagtagttggtggtggtgcgagtattacgcacgacgttccggtaggaaacggggtccctattcccgaacctatccctacccaaggaactaacctaacgttccaatacgaaacacgtctagtactctaacaaatcgaaacagcctagacgcgaccgacgacgaccggtccgttactaacttacgtggcggtaccgggaacggtaggtacgggacgggggaggaccgggataaagggtggtaaaactttaccggtttaggacccgtaggggttcgggggaacccgg

SEQ ID NO: 427145 - DNA, 566 bp, Homo sapiens
  misc_feature: GZ8MTXP02JROMW.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtggttcaccgtcactactaactccatgagctgggtccgccaggctccgagggaaggggctggagtgggtctcgaggttatttatagtggtggtggtcgcgagattacgcagactccggtagaagggccgatcaccatctaccagagacaattccatgaaaccacgctgtatcttacaaatgaaacagcctaggagtaacggcccgaacgacgaaccggcccgtactagttaactggtcgaccgggacgggagtacggacggggaggagggcaagtgggattacggttacgacccgaagtcgggggaacg

SEQ ID NO: 427146 - DNA, 543 bp, Homo sapiens
  misc_feature: GZ8MTXP02FU0XS.21.76.G10.1.454.CMB.2.raw
  modified_base (340)..(340): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggttcaccgtcactactaactccatgagctgggtccgccaggctccgagggaaggggctggagtgggtctcagcttatttanagtggtggtggtgcagattacgcagctccgtgaaacggggccgattcaccatcctccagagacaattcccatcgaacacgctgtatcttacaaatgaacagcctgacgagccgacgacacggccgtctattactgtacgcggacgggagtcggacggggaggagggcgagtaggacttacgtttacgaccgtacgtacggggg

SEQ ID NO: 427147 - DNA, 667 bp, Homo sapiens
  misc_feature: GZ8MTXP02HD0J9.21.76.G10.1.454.CMB.2.raw
  modified_base (299)..(299): a, c, t, g, unknown or other
  modified_base (439)..(439): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtgggggtccctggagactctcctgtgcggtctcgtgggttcaccgtcactactaactccatgagcgtgggtccnccgaggctcgagggaggctggagtgggtctcgtagtttattagtaggtggtggtggtcgcagtattacgcagactccggtgaacgggtccagttccacctatcctaccgaagacgtaactaattcccaagtcggaaaccncggtctagttactctttaacaaagtcgaaactgacccttagggaaacgacgacccggaaacggaccgtaaccgggcccttagttaaacttaccggtggtcggaccggggtaaacgggggttaggtacggggaaaccggggggaaggacgggggtacctaagggttcggggtaaaacctttacggtttaaccggaacccggtacgggggtttacggggggtaaacccgg

SEQ ID NO: 427148 - DNA, 720 bp, Homo sapiens
  misc_feature: GZ8MTXP02IZ4OI.21.76.G10.1.454.CMB.2.raw
  modified_base (301)..(301): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagacgtggaggagacttgactccgaaccgtgggggtccctgagactctccgtgtgcggtctcgtggttcaccgtcactactaactccatgagctgggtcccnccgaggctccgaggggaggggctggagtgggtctacgtagtttatttagtagtggtggtggtcgacagtattacgcacgacctccgggtgaacggggtccgtacttccactactcctaccgagaaacgtaactaaacttacccgaatacgaaaccacgtacttacgtaacttactttaacaaaactcgaaaccgacgtacccgtaggaaaccgaccggaccccggaaaccggacccggtaaccggtcccgttaaccgttaacgtttaaccggttgggttaccggggaaccggggaaccgggggtaaggttacgggggaaccggggggtaaacggggagggggtaccgtaaaggtacggggttaaacgtttaccggtttacggaaccccgggtaaccggggtaggggggtaaacccccgg

SEQ ID NO: 427149 - DNA, 670 bp, Homo sapiens
  misc_feature: GZ8MTXP02FQ103.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggcttagctgggttttccttgttactatttcaaaaggtgtccagtgtgaggtgcagctggtggagactggaggagacttgatccaaccgtgggggtccctgagactctctgtgcggtctcgtggtcaccgtcactactaactccatgagctggtccgccaggctccgaggggaagggctggaggtgggtctcgtagttatttagtaggtgggtggtcggtgccgtagatttacggctacggaccgttccggtgggaaacggggcccgtaagtttacccaaccctattccgtacccaaggaaacgaacctaaattacccattaacggaaaccacggtcttagttaacttaccttaacaaaagttcggaaaacctagccctagggacgaacgccccgaaaggacccacgggtacctacttaattaccgtggtcgacgggaacgggtaggtaggggaaccgggggaggggacggggcctaaggtcggggtaactttacggttacgacccgtaaggggtcgggggacctaaaccggggg

SEQ ID NO: 427150 - DNA, 553 bp, Homo sapiens
  misc_feature: GZ8MTXP02FJKNE.21.76.G10.1.454.CMB.2.raw
  modified_base (295)..(295): a, c, t, g, unknown or other
  modified_base (325)..(325): a, c, t, g, unknown or other
  modified_base (381)..(381): a, c, t, g, unknown or other
  modified_base (513)..(513): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtggggggtccctgagactctctgtgcggtctctgggttcaccgtcactactaactccatgagctggtccnccaggctcgagggagggctggagtgggtcncagttatttatagtggtggtggtgcagatacgcagactcgtgaagggcgattcacntctcagagacaattccatcgaacacgctagtatcttaacaaatacgaaacacgacctggaacgacgccgaacgaccgacggccgtacttactacgtgtacggacggtacgggagtcgggaacggggacgggnggacgaagtggtactacgttacgaccacggtgggggaccg

SEQ ID NO: 427151 - DNA, 681 bp, Homo sapiens
  misc_feature: GZ8MTXP02GCDMC.21.76.G10.1.454.CMB.2.raw
  modified_base (382)..(382): a, c, t, g, unknown or other
  modified_base (462)..(462): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtgggttcacgtcgtactactaactaccacagtagacgtcggtccggcccgacggacgtccgtaccgggaaggggacggtcggtaggtagggtcggtctagttaagtttattagtggtggtggtgngtagagtacgtcgagacgtcgtcgagggacggctactacactctcctagacgacaactactacctagactaacgacgttntacttacttacctaaagtaagtaacccaaagaccgttacggaagaaccgtacccggaaccgaaccggtaaccggaccgttcccgtaaaacttacgtttacggtacggacgggtaccggggaacggggttacggacgggggaaaacggggaggggaccggaaacgtggttaacggtaaccgtttacggttacccgacccgggttagggggaacccggggg

SEQ ID NO: 427152 - DNA, 526 bp, Homo sapiens
  misc_feature: GZ8MTXP02GXMV0.21.76.G10.1.454.CMB.2.raw
  modified_base (193)..(193): a, c, t, g, unknown or other
  modified_base (218)..(218): a, c, t, g, unknown or other
  modified_base (247)..(247): a, c, t, g, unknown or other
  modified_base (347)..(347): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctcctgtctgcatctgtagganacagagtcaccatcacttgccgggnggtcaggacattagacattattagttccnggtatcagcagaaacaggtaatccaagctcctgatctatgctgcatcctctttgacctaatcgacgggtccatcgtcgtcagtgctagtgatcgtggacngtattcactctcaccatcagcacgctgcagcctagagtactgtacgactaactttattacgtataactaaaaatataacgtctaacgtccgtaccccttactaccgttaccgtttaccggacgtaacggtaacgggaacccgtaagggttaccggaaactaacgtaacgtaaaaaccgg

SEQ ID NO: 427153 - DNA, 632 bp, Homo sapiens
  misc_feature: GZ8MTXP02I5RM8.21.76.G10.1.454.CMB.2.raw
  modified_base (294)..(294): a, c, t, g, unknown or other
  modified_base (480)..(480): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctggttcaccgtcactactaactccatgagcgtggtccnccaggctccgagggagggctggagtgggtctcgtagtttattagtagtggtggtggtgcgagtattacgcagacctccgggtagaacggggccgtattccaacctattcccaccgaaggactaaacctaacttacccagttacgaaaccacgtcttaagtacttcgttaacaaaatcggaaaaccngaccctaggaacgacgcccgaacgactaccgggcccttactaattacgtcggtcgacgggtaacggggtagtacgggaccgggggaaggcggggacctaaggtcgggtaactttacgttcggaacccgtacggggttacgggggaaaccccg

SEQ ID NO: 427154 - DNA, 547 bp, Homo sapiens
  misc_feature: GZ8MTXP02FTO7V.21.76.G10.1.454.CMB.2.raw
  modified_base (299)..(299): a, c, t, g, unknown or other
  modified_base (329)..(329): a, c, t, g, unknown or other
  modified_base (360)..(360): a, c, t, g, unknown or other
  modified_base (369)..(369): a, c, t, g, unknown or other
  modified_base (422)..(422): a, c, t, g, unknown or other
  modified_base (431)..(431): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactgggaggagacttgatccgaaccgtggggggtccctgagactctcctgtgcggtctcgtgggttcaccgtcactactaactccatgagctgggtccncaggctccgagggagggctggagtgggctnagttattagtagtggtggtgtgcagatacgnagactccgngaacggccatcacatctacagagactaactcatacgaacacgctgtatcttanaaatgaacngcctagagacgccgacgacgacggcctactagtactggtacgacggacgggtagtcggaacggggaggaggcgaagtacggtactacgtttcgaaccgtacgggtcgggggaaccg

SEQ ID NO: 427155 - DNA, 661 bp, Homo sapiens
  misc_feature: GZ8MTXP02H98ZV.21.76.G10.1.454.CMB.2.raw
  modified_base (298)..(298): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtgggtcaccgtcactactaactccatgacgcgtcgggtccnccgaggcctaccggaggggaagggctgggagtgggtctcgtagtttattagtaggttgggtaggtggtgctagtacttacggctaaggtacgtcccggtaggaaacggggcctagtttacccaacgattcccgactagaacgaactaacttcccaagtacgaacacgtacctagttacttacttacaaaagtgaaacacgtacctaggagaccgacccggaacgaaccgccgggttacctccttaaacgttacgtcggtacggacggggaacggtacgggcgggaaaccgggggaagggtcggacggtaacggtaggtacgttaacgtttaccggaaccggtacgggttacgggggaacccgg

SEQ ID NO: 427156 - DNA, 688 bp, Homo sapiens
  misc_feature: GZ8MTXP02GNMX8.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtgggttcaccgtcactactaactccatgagcgtgggtcccgccgaggcctccgaggggaaggggctggaggtggggtctcgtagtttatttagtaggtgggtgggtggtcgcagtattacgcagactccggtaggaacggggcctattccacatcctaccagacgactaattcccaatcgaaaccacgtcttagtacttacttaacaaaattcgaaaccagtaccctaggaacgacggaccccggaacggaaccgaccggggtacccttacgttaaacgtttaacccgtgggttacgggaccggggtaacgggggtaaggttacgggggaaccggggggaagggggtaacgggggccgtaaagggttcgggggtaaactttaaccgggtttacggaaaccccggtacgggggtttacgggggggaaacccg

SEQ ID NO: 427157 - DNA, 749 bp, Homo sapiens
  misc_feature: GZ8MTXP02IQSSD.21.76.G10.1.454.CMB.2.raw
  modified_base (321)..(321): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcgtctcgtggttcaccgtcactactaactccatgagctggtccgccgaggcctcgagggaacggggcgtggnggtgggtctcgtagtttatttagtaggtggtggtggtcgacgagtacgttaccgacgtacgtacgtcccgggtaggaacggggaccgtacttaccgacctatccctaccgaagaacgacctaaacttcccgaaagtaccgaaacccgtacgtccgttaagttacttacttaaaacgtaaagttacgaaaaccgcgtacccgtaagggaaccggaccgacccgggaaaccgacccggtaaacccgggtcccgtttaacgttaaacgtttaccggttacgggtacggggtacccggggtaacgggggtaaacgggtcgggggaaaaccggggggtagggggaacggggttacgaaagggttacggggttaaacgttttaccggtttaacggggaacccccgttaggggggtaccgggggtaaaccccggg

SEQ ID NO: 427158 - DNA, 555 bp, Homo sapiens
  misc_feature: GZ8MTXP02HBVBU.21.76.G10.1.454.CMB.2.raw
  modified_base (371)..(371): a, c, t, g, unknown or other
  modified_base (380)..(380): a, c, t, g, unknown or other
  modified_base (396)..(396): a, c, t, g, unknown or other
  modified_base (399)..(399): a, c, t, g, unknown or other
  modified_base (403)..(403): a, c, t, g, unknown or other
  modified_base (419)..(419): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtggttcaccgtcactactaactccatgagcgtgggtccgccgaggcctccggaggggaaggggctgggagtgggtctcgtagtttattagtagtggtggtggtgcagtatacgnagactcggngaacgggccatccacntcncganagacattccatgaacncgctgactctacaaatgaacagctagagacgccgacgacgacggccgtatagttacctggtcgacggacgggtaggacggacgggggaggcggataagtggaacttacgttagaaccgtacgggtgggggaacccg

SEQ ID NO: 427159 - DNA, 692 bp, Homo sapiens
  misc_feature: GZ8MTXP02ICUIK.21.76.G10.1.454.CMB.2.raw
  modified_base (194)..(194): a, c, t, g, unknown or other
  modified_base (324)..(324): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatcgacccagtctccatcctcctgtctgcatctgtagganacagagtcaccatcacgttggccggggcgggtcaggactagttagactattatttagccttaggtatcagacaagaaacccgtaggttaaacgttcccaagctcctagatctatgcttgctacttccttntttagaccctaaacgttccggtaacggggtcccctagttcccgttcggttccgtagggttggaccgtaaggttcggggtacttcggtacggggtaacctagtacttttaccaaccttcccgtacctaaccctaacttaccgaaacgtccgtacccgccttacggccctacgggtacccttaaggaaacgttgtttacgttacgaacctttaaatttacttaaaccgttaagtaaaactaaaaattagtaacgtaccgtaacggttcccgttcccccttaacttaaccgttacccggtttccgggaaccgtaaccggaacggggtaaaccgtaacggggtacggaacctaaggttaaaaccaaaaccgg

SEQ ID NO: 427160 - DNA, 651 bp, Homo sapiens
  misc_feature: GZ8MTXP02HY1AS.21.76.G10.1.454.CMB.2.raw
  modified_base (276)..(276): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccgaaccgtgggggtcctgagtctctctgtgcgtctcgtggtcaccgtcactactacnccatgagcgtcgggtccgccaggcctaccgaggggaacggggcgtggaggtggtctcgtagtttattagtagtgggtggtgtcgcagtacttacgcagtaccgtccggtaggaaacgggtccgtacttccgaacctactcccgtaccgagaacgaactaacttccaagtacgaaccacgacttagtacttctttaaacaaagttacgaaacgtacgtacccgaggaacggaccgacccggaacgaaccgacggtacccgttattacgttaccgtcggtacggcgggaaacggggtggtacggggaacggggtaggggacggacgtaaggtacggtaacttacggttacggacccgtagggggtacggggaaccgg

SEQ ID NO: 427161 - DNA, 668 bp, Homo sapiens
  misc_feature: GZ8MTXP02GLQXR.21.76.G10.1.454.CMB.2.raw
  modified_base (311)..(311): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaggtgtccagtgtgaggtgcagctgggtggagacgtgggaggagacttgactcccgaaccggtcgggggtccctggacgaccttctccgtgtcgcggttctcgtgggttcaccgtcacctactaactcatgagcgtcggtccncgaggcctcggaggggaggggctggagtggtctacgtagtttatttagtaggtggtggtggtgcgtagtacttacggacaacggtaccgttccgggtagggaaaccggggtccgtaacttccaacccgtatccgtaacccagaacgaactaactttcccaatacgaacctacgtcttagtaactcttaaacgaaattcgaaacgcgacctagggaacgaccgacccgaacgtacccgaacgggtccctattaacgttacgtcggtcggacggtaacggggacgtaggggaccggggaggacgggactaaggtacggtaactttacgttacgaaccggtacggggtaggggaaccccg

SEQ ID NO: 427162 - DNA, 616 bp, Homo sapiens
  misc_feature: GZ8MTXP02I64HR.21.76.G10.1.454.CMB.2.raw
  modified_base (298)..(298): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactgggaggagacttgatccaaccgtgggggtccctgagactctcctgtgcggtctcgtgggtcaccgtcactactaactccatgagcgtgggtcccnccgaggctccggagggaggggctggaggtgggtctcgtagttatttagtagtggtggtggtcgctagtattcgcaagcctcggtagaagggcctattccacgatccgtaccaggtacaacctaagtttcccaattacgaaacctcgcttagtacttcttaacaaagttgaaaacctgcctaggaacgacgacccgagaccgacgggtccctattaacgttacgtgggtacgacgggacggggtacgtcgggaacggggaggtccgggataaggttcgaacgtttacgttacggaccgtacggggtcggggtaacccgg

SEQ ID NO: 427163 - DNA, 569 bp, Homo sapiens
  misc_feature: GZ8MTXP02FS5JO.21.76.G10.1.454.CMB.2.raw
  modified_base (493)..(493): a, c, t, g, unknown or other
  modified_base (531)..(531): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactgggaggagacttgatccaaccgtgggggtccctgagactctcctgtgcggtctcgtgggttcaccgtcactactaactccatgagctggtccgcaggctccgagggagggctggagtgggtctcgagttatttagtagtggtggtggtgcagattacggcagactccggtgaaacgggccgattcgaccatctccaagacgacaattcccgatcgaaacacgctgtaatcttaacaaatcggaaacagtcctagaagacgaccgacgaccgaacgggcctactagttacnggtacgcggacgggagtgggaacggggaggacgggtanaaggtggtacttacgtacgaccgtacgggtcggggacg

SEQ ID NO: 427164 - DNA, 621 bp, Homo sapiens
  misc_feature: GZ8MTXP02JC9LE.21.76.G10.1.454.CMB.2.raw
  modified_base (367)..(367): a, c, t, g, unknown or other
  modified_base (374)..(374): a, c, t, g, unknown or other
  modified_base (386)..(386): a, c, t, g, unknown or other
  modified_base (430)..(430): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttcctgttactatttcaaaaggtgtccagtgtgaggtgcagctggtggagactgggaggagacttgatccaaccgtgggggtccctgagactctcctgtgcggtctcgtggttcaccgtcactactaactccatgagcgtgggtccgccaggcctccgaggggaggggctggagtgggtctcgtagtttatttagtgtggtggtggtgcagattacgnagctcgngacggcatcacntctacagagactagttccagtcaaccacgtcttgtactcttaanaaaagtcgaaaactgtccctaggaacgcggaccccgaacggacgtaccgggccttacctaagttacccgtggtaccgggacggaaacgggggtgttacggggaaccgggggtaaaggggccgggtataagggttacggaaacgttttaccgtttcggaaaccccggttagggggttccgggggaaacccgg

SEQ ID NO: 427165 - DNA, 944 bp, Homo sapiens
  misc_feature: GZ8MTXP02IFI38.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagacgtggaggagacttgatccgaaccgtgggggtccctgagctctctgtgcgtctcgtggtcacgtcactactactcatgagcgtcggtccgccgaggccgtaccggaagggggaacggggtcggtaggggtacggttcggggtaccttacgttaaggtttttaagtttagtaggggttggggttgggttggtacgacgtaagtacgttacgacgtacggtaccgttccgggtagggaaaccggggtcccgttaacgttacccgaccctaacttccccgtaacccgtaaagggaaacctaaaccttaaaccgtttccccgaaaagtttaaacccgggaaaacccgtacggtttacccgttaacggtttaaacctttaccccgtttaaaaacgaaaaacgtttaccgaaaacccgttaccgggtaaccccgttaagggaaaacccgggacccggaacccccgggtaaaaccggtaacccccgggtacccggggtttacccccgttacgttttaaaacgtttaaccccgggttcgggggttaaaccgggaccccggggggtaaaacgggggtttaaagggggtaccgggggggtaaaaacccggggggacggggggttaaaaggggaccccggtttaaaagggggtttacgggggtttaaaaacccgtttttaaacccgggtttacccgggggaaaaccccccggggtttaggggggtttaaaccccggggggggtaaacccccgg

SEQ ID NO: 427166 - DNA, 606 bp, Homo sapiens
  misc_feature: GZ8MTXP02ILXI8.21.76.G10.1.454.CMB.2.raw
  modified_base (506)..(506): a, c, t, g, unknown or other
  modified_base (525)..(525): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagactggaggagacttgatccaaccgtgggggtccctgagactctcctgtgcggtctcgtgggttcaccgtcactactaactccatgagctggtccgcaggctccgagggaggctggagtggctgtagttattagtagtggtggtgtcgctagattacgcagcgtccgtggaacgggccgtattccgaccatccctaccgaagacgaactaattccaatcgaaacacgctagtactcttaacaaagtcgaaactgaccctaggacgacgacccgaacgtaaccgacggtcccgtattacgttaccgnggtcggacgggaaacgggnggtacgggaaccgggggaggacgggactaaggtacggaaacgtttacgttacggaccccgtaggggttacgggggaacccg

SEQ ID NO: 427167 - DNA, 657 bp, Homo sapiens
  misc_feature: GZ8MTXP02H8M85.21.76.G10.1.454.CMB.2.raw
  modified_base (276)..(276): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagactgatccaaccgtgggggtccctgagactctcctgtgcgtctcgtggtcaccgtcactactaacnccatgagcgtgggtccgcgaggcctccggaggggagggcgtggagtgagtctctagttatttagtaggtggtggtggtgctagattacgcagtccgtcggtagaacggggccgtattccaacctactcctaccgaagtacgaactaaacttcccaaattacggaaactacggtacttacgtacttacttacctaaaagtacgtaacgaacgtaccgtaggaaccgacggacccgaaccgaaccgtacccgggaccttacgttaactttacgtcggttacggacgggtaaaccgggggaggttacggggaacgggggaaggggaccggggaagtacggtagggtaaacttacggtttacggacccgtaacggggtacggggg

SEQ ID NO: 427168 - DNA, 743 bp, Homo sapiens
  misc_feature: GZ8MTXP02G4BOD.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttacaaaaggtgtccagtgtgaggtgcagctggtggagacgtgggaggagacttgatccgaaccggtgggggtccctgagactctcctgtgcgtctcgtggtcaccgtcactactactccatgagcgtcggtccgaccgtaggcctccggaaggggaaggggcgtaggaggtgggtcctacgtagtttatttagtaggtggtggtggtgacagtattacgacgtacgtacctccggggtaggtaaaccggggtacccgtaacgtttcccaaacccgttaacttcccgttaacccgaaacgtaacggaaactaaaccgttaaccctaagttaaccgaaaccgtaacgtcggtttaacgtaacttacctttaaaccaaaagttaaccggaaactacggaccccttaaggggaacgaaccggaccccggaaccggaccgtaccggggtaccttaccgttaagttacccgtagggtcggaccggggtaaaccgggggcgggtaacggggacgggggaacggggacggtagtaacggtacggttaacgttacggtaccggaccggtacgggtacggggtaaccg

SEQ ID NO: 427169 - DNA, 664 bp, Homo sapiens
  misc_feature: GZ8MTXP02H2713.21.76.G10.1.454.CMB.2.raw
  modified_base (250)..(250): a, c, t, g, unknown or other
  modified_base (290)..(290): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaggtgtccagtgtgaggtgcagctggtggagactggaggagacttgatccgaacgtgggggtcctgagactctctgtgcgtntcgtggtcaccgtcactactaactccatgagctgggtccnccgaggcctccggaggggaaggggcgtgggagtgggtctcgtagtttattagtaggtgggtggtggtgcagtatacgcagactccggtaggaaacggggcctagttaccaccgtatcctaccgaagaacgtaacctaacgttacccaagtacgaaaccacgtccttagttactactttaaacaaaagttacgaaaacgtacgtaccctagggaacgaaccgacccggaaaccgaacggaccggtacccgtttactaaacgttaaccgtggacgggccggggaaacgggtaggacgggaacgggggagggacgggacgtaaggtcggtaaactttacccggttaggaccccgtagggggtacgggggaaccccgg

SEQ ID NO: 427170 - DNA, 651 bp, Homo sapiens
  misc_feature: GZ8MTXP02G3M9H.21.76.G10.1.454.CMB.2.raw
  modified_base (470)..(470): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtgggggtccctgagactctcctgtgcggtctcgtggttcaccgtcactactactccatgagctgggtccgccgaggcctccgaggggaacggggcgtggaggtgggtctcgtagtttatttagtagtggtggtggtgcgagtattacgcagactccgtggaagggccattcgaccatcctaccagacgtacaacgttcccaagtacgaaacctcgactgttactacgttaacaaaatcggaaacngtaccctaggaacgacgcccggtaacgacgtaccggccgttactagttacgtcggtacggccgggaacgggggttacgaggggaacccggggggaaggggtacggggtaaccgaaggttacgggaaacgttttacccggtttacgggaaccccgtacgggggttaccggggggaaacccgg

SEQ ID NO: 427171 - DNA, 603 bp, Homo sapiens
  misc_feature: GZ8MTXP02IWBGC.21.76.G10.1.454.CMB.2.raw
  modified_base (285)..(285): a, c, t, g, unknown or other
  modified_base (295)..(295): a, c, t, g, unknown or other
  modified_base (322)..(322): a, c, t, g, unknown or other
  modified_base (364)..(364): a, c, t, g, unknown or other
  modified_base (435)..(435): a, c, t, g, unknown or other
  modified_base (492)..(492): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttgctgagctgggttttccttgttactatttacaaaaggtgtccagtgtgaggtgcagctggtggagacgtggaggagacttgactccgaaccgtgggggtccctgagactctccgtgtgcgtctcgtggtcaccgtcactactactcatgngcgtggtccnccagctcgagggaggctggagtggctntagtttatttagtagttgggtggtggtcgcgtagtattacgnacgtaccgtcggtagaacgggcctagttccactatcctaccgaagacgtaactaacttccaagtacgaacncgtactgtaactcttaaacaaaattcgaaaccgtagccgtaggacgacgcccggaanaccgaccggtcctataacgtacgtggacggacgggacggaggtacgggacggggaggtacggagtaaggtacggtacgttaaccgtggaaacccgtgggtacggggacccg

SEQ ID NO: 427172 - DNA, 610 bp, Homo sapiens
  misc_feature: GZ8MTXP02H2YKC.21.76.G10.1.454.CMB.2.raw
  modified_base (295)..(295): a, c, t, g, unknown or other
  modified_base (458)..(458): a, c, t, g, unknown or other
  modified_base (516)..(516): a, c, t, g, unknown or other
  modified_base (548)..(548): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtgggggtccctgagactctcctgtgcggtctcgtggtcaccgtcactactaactccatgagctgggtccnccgaggcctaccggaggggaaggggctagggaggtggggtctacgtagtttaagtttagtaggttggtggtggtcgacgagtattacggactagacctcggtaggaaagggcccgtaattccaaccatcctaccgaagaagaacaaacttccatacgaaaccncgtctagtactcttaaacaaatgaaactagctagaagacgaccgacacacgggcttanaagttacctggaggtaccggaacggggttagngggaaccggggagcgggacaaggtcggaaaacttcgtacgacccgaagggttggggaacccg

SEQ ID NO: 427173 - DNA, 641 bp, Homo sapiens
  misc_feature: GZ8MTXP02GMZLW.21.76.G10.1.454.CMB.2.raw
  modified_base (301)..(301): a, c, t, g, unknown or other
  modified_base (493)..(493): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagacgtggaggagacttgactccgaaccgtggggggtccctgagactctcctgtgcggtctcgtggtcaccgtcactactaactccatgagcgtcgggtccnccaggcctaccggaggggaacggggcgtggaggttcgggtctcgtagtttatttagtaggttggtggtcggtgcgagtattacgcgacgacgtccggtaggaacggggtcctacttccactactcctaccgaagacgaactaaacttccaagtacgaacacgtctataactcttaaacaaagtcgaaaaccncgtacgtaggacgaccgaccgaacgaccgaccggtccttactacgtacgtcggtacggacgggacgggaggtacgggggaacggggagggacggactaaggtacggtaacttacggtacggaaccggtacgggggtacgggggaaccg

SEQ ID NO: 427174 - DNA, 609 bp, Homo sapiens
  misc_feature: GZ8MTXP02JGASA.21.76.G10.1.454.CMB.2.raw
  modified_base (372)..(372): a, c, t, g, unknown or other
  modified_base (468)..(468): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtggttcaccgtcactactaactccatgagcgtgggtcccgccgaggcctccgaggggaaggggctgggaggtgggtctctagtttattagtagtggtggtggtgcagtattacgnagactccggtagaacgggccgtattccaccatcctaccgagaacgaactaacttcccaatacgaaaccacgtctagtactcttaacaaatgaaacngcctaggaacgacgacccgaacgacgaccgggccttactaagttacctggtcgaccgggacggggaagtcggggaacgggggagggacgggtacaaggtggtaacttacgtttacggaaccgtacgggtacgggggaaccg

SEQ ID NO: 427175 - DNA, 653 bp, Homo sapiens
  misc_feature: GZ8MTXP02JRZ7N.21.76.G10.1.454.CMB.2.raw
  modified_base (195)..(195): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatcgacccagtctccatccctcctgtctgcatctgtagganacagacgtcaccatctacgttcggccggggcggtcaggactagttagactattattacgccgttaggtatcagacaaggaaaaccaaggttaactaccaagtctacctagattactatcgtctgactacttcctcgttagacctaacgtcggtacgggtccctagtcgttcgttcgagggtcgtcgtaggtgattccgagggactagtactttcactctaccactacgacagaccacgtccgtagaccggtagacccgtaagtaacgtacgttacgttaacgaacgtttaactttaacgttaacgtaacggttaaaactaaaaaggtaccttaacggacccgttaaaccggtccccgttaccccttaccgttacccgttaccggtttacggaaccggtaaccgggaaaccggtaaccggtaacgggtacggtaaacctaaccgtaaccgtaaaaccgg

SEQ ID NO: 427176 - DNA, 655 bp, Homo sapiens
  misc_feature: GZ8MTXP02G1QJN.21.76.G10.1.454.CMB.2.raw
  modified_base (285)..(285): a, c, t, g, unknown or other
  modified_base (522)..(522): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttacaaaaggtgtccagtgtgaggtgcagctgggtggagacgtgggaaggagacttgactccgaaccggtcgggggtccctgagactctcctgtgcgtctcgtggtcacgtcactactacnccatgagcgtcggccgcgacggccgtaccggaggggaacgggcgtagggtaggtcggtctacgtagtttagtttagtaggtggtggtggtcgacgtaagtacgttacgacgtaacggtaccgtccgggtagggaacgggtaccgtacttacccgaacctactccctaaccgaagtaacgaactaaacttccaaagtacaaccgacgtcttagtacttactaaacaaagtagaaaccngtacctaggacgaccgaccgaacgaccgtcggccttataacgtcgtggacgtaccgggacgggtagtacggggacggggaggacggacaaggttacgtaacttacgtacgaccgtacggggtacgggaacccg

SEQ ID NO: 427177 - DNA, 652 bp, Homo sapiens
  misc_feature: GZ8MTXP02I8WWB.21.76.G10.1.454.CMB.2.raw
  modified_base (271)..(271): a, c, t, g, unknown or other
  modified_base (460)..(460): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatccctccctgtctgctatctgtaggagacagagtccactatactaagttcggccgggtcgggtcgaaggactagttaagactattagttagccgtaggtacngacgacaaacggtaaaaccctaaggttaaacctacctaaaggtcctaccgtagtactactagtcgtacgtgacctacttccttactttcgaccctaacgtccgtacggggttacccctagttccgttcggttcgaaggtggaaccgtggtacgtagtcgtaggatagtactttacgcctactccaaccnctacgacgcgacgtccgacgtacacgtacgtagtacgtagttaacgtacgtaacttaacttaacgtaacgttaaacgtaaaactaaaacgtacgtaacgacgtacgtaccctacccgttaccgtaccgtaccggttaccggacggtaacggtacggtaaccggacgtacgtaacctaacgtaaaccgtaacg

SEQ ID NO: 427178 - DNA, 621 bp, Homo sapiens
  misc_feature: GZ8MTXP02IQ54N.21.76.G10.1.454.CMB.2.raw
  modified_base (292)..(292): a, c, t, g, unknown or other
  modified_base (388)..(388): a, c, t, g, unknown or other
  modified_base (394)..(394): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctggttcacgtcactactaactccatgagctgggccnccaggcctcgagggacgggctggagtggtctcagttattatagtggtggtggtgcgagtattacgcagctccggtgacgggctattccaacattcncgaagngacaatcaatagaacacgctagtactcttacaaaagttcaaaactcgaccttaggaagaccggacccggaacgaacgtaccggggtacccgttacttaaacgttaaccgtagggttcggaccggaaccgggggttaaagggacggggtaaaccgggggaaggtacgggacgtaaggttcggtaaacgtttaccgttaccggaaccggtacggggtaccgggggaacg

SEQ ID NO: 427179 - DNA, 549 bp, Homo sapiens
  misc_feature: GZ8MTXP02GAEBC.21.76.G10.1.454.CMB.2.raw
  modified_base (446)..(446): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctcctgtctgcatctgtaggagacagagtcaccatcacgttcggccgggtcgggtcaggacatagacattattagcctggtatcagacaagaaaccaggtaaacttccaaagctcctagatctatgctagctacttcctctttgccaatcgacggggtcccagttcctcggttcagtcggacagtggatcgtagggacagtatttcactctacacatcacgtcacgctgcacgtcctaggaagacgttagttacggacttaactttattaacgtntaaaactaaaaagttactaacgactacggtcctcccttacgtccttaccgttacggaccgaacggaacggaaccgtacggtacggaactacgactaaaaccgg

SEQ ID NO: 427180 - DNA, 680 bp, Homo sapiens
  misc_feature: GZ8MTXP02F9LMF.21.76.G10.1.454.CMB.2.raw
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctccctgtctgcatctgtagagacagagtcaccatcacgttcggccgggcggtcaggacatagactattattagctggtatcagacaagaaaccgaggtaaacgtccaagtctccgtagatctatgctcgctatcctctttgacctagtcgtacgggtcccctagttccgttcgttcgtagggtacggtcgtaggttcgggactttacgggtaggggtaaccgtacgttaaccgttttacctaacccttcccttaaccctaacccgtactaccgaacgtaccgaaccgtcccgttacgacccgtaaccggtacccgtaaaggtaaacggttacgtttaccgggttaacgtaaacccgtttaaactttaaacgtttaaaccgttaacgttaaaacctaaaaaagttcgtaaacgtacgtaaccgttcccgtaccccgtcgttacccgtaccgttccggacgaaccggtaacgggaaccgtaacggtacgtaccaacgtaaccgtaaacgg

SEQ ID NO: 427181 - DNA, 733 bp, Homo sapiens
  misc_feature: GZ8MTXP02IGZYB.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagacgtgggaggagacttgactccaaccgtgggggtccctgagactctcctgtgcggtctcgtgggttcaccgtcactactaactccatgagcgtgggtcccgccgaggcctccgaaggggaggggctggaggtgggtctcgtagtttatttagtaggttgggtggtgggtcgcgagtactttacggcgtaacgaccgttccgggtagggaaacggggtacccgtagttaccaacccgtaacttcccgtacccgaaggtaacgaacctaaactttacccaaatacggaaaccaccggtccttagttaacttcctttaaacaaaagttcgaaaacccgaggtaccccgttagggaaccggacggaccccggaaccggaccgtaacccggggtcccgttaacttaacgtttaccgtgggtacggtaccggggacgggggtaaggttacgggggaaccgggggaaggggacggggtacgtaagtacggggtacttaccggtttacggaacccggtaacggggtcggggggaacccgg

SEQ ID NO: 427182 - DNA, 600 bp, Homo sapiens
  misc_feature: GZ8MTXP02HAZOG.21.76.G10.1.454.CMB.2.raw
  modified_base (291)..(291): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccgaacgtgggggtccctgagctctcctgtgcggtctgtggtcacgtcactactaactccatgagcgtggccncgaggctccggaggggagggctggaggtggtctgtagtttattataggtgggtggtggtcgcgagtagttacgcaggtacctcggtaggaacggggtccattccgacatccgtaccagagactaacttcaatacgacacgtctagtactctaacgaaatacgaactagccgtagacgacgaccggtaacgacgacgggtccttacgtacttaacgtggtacggaccggtaaggggacggtacggggacggggaaggcgggagtaagtagggtactacggttacgaccgtttacggggacgggtaaccgg

SEQ ID NO: 427183 - DNA, 676 bp, Homo sapiens
  misc_feature: GZ8MTXP02HJYGO.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtggggggtccctgagactctcctgtgcggtctcgtggttcaccgtcactactaactccatgagcgtggtccgccaggcctccgagggaggggctggagtgggtctcgtagtttatttagtaggtggtggtggtcgacgagtattacgcacgactccggtagaacgggccgtattccacctatccgaccaagacgaactaacttcccaagtacgaacctacggtcttaggttacttcctttaaaccgaaattacggaaaccgtagtcccgttaggaaaccgggaccgacccgggaaacgaacccgtaccggggacccttacgttaaacttaccgttacgggtcggcccgggtaaacgggggtaggtacggggaaaccgggggtagggacggggacgtaaggtacggtaacgttaccgtttacggacccgtacgggggtacgggggaacccgg

SEQ ID NO: 427184 - DNA, 623 bp, Homo sapiens
  misc_feature: GZ8MTXP02IBKAZ.21.76.G10.1.454.CMB.2.raw
  modified_base (194)..(194): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggcccccagataccagatgtgacatccagatgacccagtctccatcctccctgtctgcatctgtagganacagagtcaccatcacttggccgggcggtcaggacattagactattattagcctggtatcagcaagaaaccaggttaaagtcccaaagctcctgatctatgctgacattcctctttgactaacgtccgtacggggtcccagttcgtcggttcaggtgcgtagtggattcgaggacagtattctactctaccaccatacacgcacgccctagacacgtacccgtagaacgtagttagttacgtacttaaacctttaattaaccgttagttaaaacctaaaaattacgtaaaacgtacgtaacggttacccgtacccccttaccgttaccgttacccggttttaccgggacccgttaccgggaaccggggtaaccccgtaaaggggttaccgggaaacctaaacggtaacccgtaaaaacggtaacccggg

SEQ ID NO: 427185 - DNA, 557 bp, Homo sapiens
  misc_feature: GZ8MTXP02G4Q5K.21.76.G10.1.454.CMB.2.raw
  modified_base (293)..(293): a, c, t, g, unknown or other
  modified_base (396)..(396): a, c, t, g, unknown or other
  modified_base (511)..(511): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaggtgtccagtgtgaggtgcagctggtggagactggaggagacttgatccaaccgtgggggtccctgagactctcctgtgcggtctcgtgggtcaccgtcactactaactccatgagctgggccnccaggcctccgagggagggctggagtgggctcagtttattataggtggtggtggtgcagtatacgcagactccggtgaacgggccattccacatctaccaganacaattccaatagaacacgctagtactcttacaaatgaaactgacctggagacgccgacgacacggccgttactacttacgtcgtcgacggacggggtgtacggacggggtaggngggacaaggttcggaattacgtttgaccgtacggtcgggggaaccg

SEQ ID NO: 427186 - DNA, 744 bp, Homo sapiens
  misc_feature: GZ8MTXP02HOBIE.21.76.G10.1.454.CMB.2.raw
  modified_base (277)..(277): a, c, t, g, unknown or other
  modified_base (294)..(294): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcgtggtttctgttactattcaaaggtgtcagtgtgaggtgcagctggtggagacgtggaggagacttgactccgaaccggtgggggtccctggagtactctcctgtgcgtctcgtggttcaccgtcactactacncatgacgcgtcggtccncgaggcctccgggaagggaggggctagggagtgggtctgtagtttattagtggtgggtgtggtgcgtagtacgttacgcgtaacgcgttccggtagggaaacggggtccctaagttcccaaccgtaaacgtttccctaaacgaaacggaacgtaaaccgttaaacttcccgaaagttaccggaaaacctcgtaccggttagttaacttactttaaacgaaaacctagaaacccgtagaccgttagggaaacgtaccgacccggaacgtaccgaaccggggtcctttaccgtaaagttttacccggtacgggtaccggggtaacggggtaaacggggtacggggtaacggggtaacgggggaacggggtaacggtacggttaacgggttacgttaaacggtttaacccgttaacggaacccggggtaacgggggtaccgggggtaaaccgg

SEQ ID NO: 427187 - DNA, 691 bp, Homo sapiens
  misc_feature: GZ8MTXP02JR0NA.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggtagttttggctgagtcttgggttttccttgttactatttacaaaaggtgtccagtgtgaggtgcagcgtgggtggagacgtggaggagtacttgactacccgtaaccggtcgggggtccctgacgtacctctccgtgtcggtcgttctcgtcggtccaccgtcactactaactcatgacgtcgtcggtccgccgaggccgtacgggaaggggacgggcgtgggtaggttcggtcttacgttaagtttaagtttagtagggttgggtgggttggtccgagtaagtacgttacgacgacggtaccgtccgggtaacgggaacgggtccgtaacttacccgaaccgtacttacccgaccgaaagtaactaacctaacgttcccaaagtacgaaacccgtgtaccgttattaacctacttaaacgaaagttacgaacgtcgaccgtagggaaccgaccgaccgaacgacgtacggtccttatacgtcgtggcggaacgggtaggcgaggggacggaggcgataaggtcgtaacgttcgtacgaccggtacggggacggtaacccgg

SEQ ID NO: 427188 - DNA, 629 bp, Homo sapiens
  misc_feature: GZ8MTXP02HND0F.21.76.G10.1.454.CMB.2.raw
  modified_base (491)..(491): a, c, t, g, unknown or other
  modified_base (502)..(502): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccgaaccgtgggggtcctgagactctctgtgcgtctcgtggtcaccgtcactactactccatgacgcgtcggtccgccaggcctaccggaggggaagggcgtggaggtgggtctacgtagtttatttagtagtggtggtggtgacagtacgttacgacgacggtacgtccgggtaggaaacgggggtcccgtatttacccgaaccctacttcccaccgaaaggaacgtaaaccaatttcccaaagtacgaaaccgtcgctagttactactaanaagtacgaacncgcgtagacgccgaaccgacgaccggcgtactacgttacgtacggtcgaggaccgggtaggaggacggggacggggaggaggctaaggtacgtactttacggacgacccggtagggtcggggaaccg

SEQ ID NO: 427189 - DNA, 554 bp, Homo sapiens
  misc_feature: GZ8MTXP02JQMFI.21.76.G10.1.454.CMB.2.raw
  modified_base (295)..(295): a, c, t, g, unknown or other
  modified_base (370)..(370): a, c, t, g, unknown or other
  modified_base (400)..(400): a, c, t, g, unknown or other
  modified_base (414)..(414): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggagagacttgatccaaccgtgggggtccctgagactctcctgtgcggtctcgtgggttcaccgtcactactaactccatgagctgggtccnccaggctccgaaggggaacggggctggagtggggtactcagtttaatttagtagtggtggtgtgcagattacganagactcgagaacggctatcacatcacaganacatcatacgaacncgtctatactctaaacaaagtaacgaacgacgacgagagacgaccgacgacgacgacgtactactacgtacgtgacggacgggaggacggacgggacgggaggagaagtagtacgtacgtacgtacgacggacgggacgg

SEQ ID NO: 427190 - DNA, 686 bp, Homo sapiens
  misc_feature: GZ8MTXP02G00BZ.21.76.G10.1.454.CMB.2.raw
  modified_base (489)..(489): a, c, t, g, unknown or other
tcagtcgtcgctcgcacgaccggtgctcgatttagtcactcatacaggggctgggagaggagcccagcactgggattccgaggtgtttccattcggtgataagcactgaacacagaggactcaccatggagttttggctgagctgggttttccttgttactatttcaaaaggtgtccagtgtgaggtgcagctggtggagactggaggagacttgactccaaccgtgggggtccctgagctctcctgtcgcggtctcgtcggttcaccgtcactacctaactccatgacgctcgggtccgcacggcctcgaggggaagggctgggaggtggtactcgtagtttatttagtaggtggttggtggtgaccgtagtacgttacgacgacgaccgtccgtagggaacgggtccgtactttaccaccgtactcgtacccagaacgtactaaacttccgaagtcaaaacgcgtacgttctaaattcccttaaaanaaacgtcgaaaacgtcgtacgtaggacggaaccgaccccgaacgtacccgtacggttaccttacgttacgttacgtcggtacgggaccggggtaaggggtcgggtaacggggaacgggggaggtacggtacgtacggttaaggtacctttacggttacccggaccgggtacggggtacgggggaaccgtaacccggg

SEQ ID NO: 427191 - DNA, 581 bp, Homo sapiens
  misc_feature: GZ8MTXP02FSN2A.21.76.G10.1.454.CMB.2.raw
  modified_base (300)..(300): a, c, t, g, unknown or other
  modified_base (441)..(441): a, c, t, g, unknown or other
  modified_base (450)..(450): a, c, t, g, unknown or other
  modified_base (524)..(524): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgactccgaaccgtggggggtccctgagactctcctgtgcggtctcgtgggttcaccgtcactactaactccatgagctgggtccnccgaggcctccgaggggaaggggctggaggtgggtctcagtttatttagtaggtggtggtggtcgctagattacgcacgactcggtagaacgggccattcacatctcagagacaacttcaatacgacacgctgtatcttanaaatgaacngcctagagacgccgacgacgacggcctactattcgtggtcgacggaacggggtgtacgggaccggggaacgggnggactaaggtacggtaacgttaccgttcggaacccgtacggggtcgggggaacccgg

SEQ ID NO: 427192 - DNA, 600 bp, Homo sapiens
  misc_feature: GZ8MTXP02HG7GE.21.76.G10.1.454.CMB.2.raw
  modified_base (197)..(197): a, c, t, g, unknown or other
  modified_base (262)..(262): a, c, t, g, unknown or other
  modified_base (329)..(329): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatcgaccctagtctccatccctccctgtctgcatctgtagganacagagtcacatcacgttggccgggcggtcaggactattagactattatttacgccgttaggtancgtagacaagaaaaccctaggtaaacgttcccaaagtcctcctagacttctatgctgctacttcctntttacgacctaagtccgacgggtccctagttccgttcgttcgagtgacagtaggtatcgtagggactagtactttcgactctaccacactcacgcacgtcgtagcacgtccgtaataaacgttgttacaaaccttatttaaactttacgtaacgttaaaccaaaaagttacgtaacggttacacggttccctacccttacgttacttaccgttccgacgtaccggtaacggaaccgaaggttacggaactacgtaaacctaaaacgtacgg

SEQ ID NO: 427193 - DNA, 619 bp, Homo sapiens
  misc_feature: GZ8MTXP02HE1AF.21.76.G10.1.454.CMB.2.raw
  modified_base (523)..(523): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaagtgtccagtgtgaggtgcagctggtggagacgtggaggagacttgatccgaaccgtgggggtcctgagactctcctgtgcgtctcgtggtcaccgtcactactaactccatgagcgtgggtccgccgaggcctccgaggggaaggggcgtgggaggtgggtctacgtagtttatttagtagtggtggtggtcgcagagttacgcagacgtcggtagaacggggccgtattcgaccatcctaccaagacgaactaattccaatacgaacacgtcgttagtactaccttacaaattcgaacacgtacctaggacggacgaccggacgtaaccgaccggtaccgttatacgtttacncggtacggacggtacggggaggtacggggacggggaggacggggagtaagtggggtaacttacggtttacggaccgtacgggtacgggggaacccg

SEQ ID NO: 427194 - DNA, 728 bp, Homo sapiens
  misc_feature: GZ8MTXP02GNVSV.21.76.G10.1.454.CMB.2.raw
  modified_base (251)..(251): a, c, t, g, unknown or other
  modified_base (280)..(280): a, c, t, g, unknown or other
tcagtcgtcgctcgcacgaccggtgctcgatttagtcactcatacaggggctgggagaggagcccagcactgggattccgaggtgtttccattcggtgatcagcactgaacacagagaactcaccatggagttttggctgagctgggttttccttgttactatttcaaaaggtgtccagtgtgaggtgcagctggtggagacgtggaggagacttgatccgaaccgtgggggtccctgacgactctcctgngcggtctctggtcaccgtcactactaacnccagtgagcgtcgggcccgcgaggcctaccggaggggaaggggcgtaggaggtcgggtctacgtagtttatttagtaggtgggtggtggtgcgagtattacgcacgtacgtccggtaggaacgggtaccgtattccgaaccacttcccgtacccgaaggacgtaaactaacgttacccaagttaacgaaacctacggtaccttagttaacttaccgtttaaaccgaaaagtcggtaaaaacccgaccgtaccgtaacgggaaacgaacccgggaccggaaacccggaacccggtaacccgggttacccgttaacgtttaacgtttacgtacgggtaccgggaccggggtaacggggtacgggaacggggaacgggggaacgggacgggtacgtaaggttacggtaacgttacggttaaccggaccggtacgggggtacgggggaaccg

SEQ ID NO: 427195 - DNA, 664 bp, Homo sapiens
  misc_feature: GZ8MTXP02IKDJO.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttacaaaaggtgtccagtgtgaggtgcagcgtggtggagacgtggaggagacttgactccgaaccggtgggggtccctgacgactctcctgtgcgtctcgtggtcaccgtcactactaactcatgagcgtcgggtccgccgaggcctcggaaggggaggcgtggagtggtctacgtagtttattagtaggtggtggtggtcgacgtagtagttacgagtacgtacgtccgggtaggaacgggtccgtaacttccactaactccgtaacgaaggaaaccgtaactaaacttccgaaagtacgaaacctcgtacgttaagttactacctttaaacgaaaacgttcgaaaaccgtcgtaccgtaaggaaccgaccggacccgtacgaaccgtaccggtactttacgtaaagtcgtggacggacgggaacgggtaggacgggacggggaacggtgacgtaaggtacgtaacttacggtacggaccgtacggggtgggaaacccg

SEQ ID NO: 427196 - DNA, 779 bp, Homo sapiens
  misc_feature: GZ8MTXP02GBXYG.21.76.G10.1.454.CMB.2.raw
  modified_base (257)..(257): a, c, t, g, unknown or other
  modified_base (301)..(301): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctgggtggagacgtggaggagacttgactcccgaaccggtggggggtccctgagtactctcctgngcgtctcgtggtcaccgtcactactaactcatgagcgtcggccnccgaggcctaccggaggggaacggggctaggagttggggtacctagtagtttaagtttagtagggttgggtggggttcgggtagacgtaagtacgtttacggaccgacggtaaccgttcccggggttaagggaaaccggggtcccgtaaacttacccgaaccctaagttccctaacccgaaaggtaaacgtaacctaaaactttcccgaaaattaccgaaaccgtacggtactttaaggtaaccttacttaaactaaaagtaacggtaaaccacggttacccgtaagggaaacgaacccggacccggaaaccgaacccggtaacccggtccgttaactttaaacgttcggtacgggtaccggggacgggtaaaccgggggtaggtacgggaaccgggggaaggaccggggtaacgtaaggttacgggtaacttaacgggttaccgaaaccggttcgggggtacggggtaaacccgggg

SEQ ID NO: 427197 - DNA, 777 bp, Homo sapiens
  misc_feature: GZ8MTXP02GICYA.21.76.G10.1.454.CMB.2.raw
tcagtcgtcgctcgcacgaccggtgctcgatttagtcactcatacagggactgggagaggagcccagcactgggattccgaggtgtttccattcggtgatcagcactgaacacagaggactcaccatggagttttggctgagcttgggttttccttgttactatttacaaaaggtgtccagtgtgaggtgcagctggtggagacgtggaggagacttgactccgaaccgtgggggtccctgagactctctgtgcgtctcgtggtcaccgtcactactaactccatgagcgtcgggtccgccgaggcctccggaggggagggcgtggaggtggtctcgtagtttatttagtaggtggtggtggtgacgagtagttaagcaagtaccgtccggtaggaacgggtcccgtattcccaaccgtactcctacccgaagtaacgaactaacttaccaagttacgaaacctacgtacttagtaacttaccgtttaaacgaaaagttacgaaaacccgtacggtaccccgttaagggaaaccgaaacccggacccccggtaaaccggaaacccccggtaaccccggggtaccccgtttaactttaaaccggtttaacccgtggggttaccggggaacccgggggtaaaaccgggggtaggttaacggggggaaacccggggggaaaggggtaaccgggggaacttaaaggggttacggggtaaaaccttttaccgggtttaccggaaaacccggttaccgggggttacggggggaaaacccccgg

SEQ ID NO: 427198 - DNA, 656 bp, Homo sapiens
  misc_feature: GZ8MTXP02GABZN.21.76.G10.1.454.CMB.2.raw
  modified_base (568)..(568): a, c, t, g, unknown or other
  modified_base (594)..(594): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagcgtggtggagacgtgggaggagacttgactccgaaccggtgggggtccctggacgactctcctgtgcgtctcgtcggttccaccgtcactactaactccagtgagtcgtcgggtccgccgacggctaccggaggggaaggggctgggaggtgggtctcgtagtttatttagtaggtgggtggtggtcgcgtagattacgacgacgaccgtccggtagaacggggccgtattaccaaccgtactcctaccgaaggaactaactaaacttccaagtcgaaactcgtcttagtactcttaaacaaagtcgaaaccgtgaccctagggaacgaaccgcccgaaacggtacccgtacgggtcccttataacgttacgtgggngtcccggggaagggtaggtaacgggngggggaaacggcgggtacaaggttacggactttacgtcggacctacggggcggggtaacccg

SEQ ID NO: 427199 - DNA, 766 bp, Homo sapiens
  misc_feature: GZ8MTXP02HNPHL.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttacaaaaggtgtccagtgtgaggtgcagctgggtggaggacgtgggaggagacttgatccaaccgtgggggtccctgacgactctcctggtgcggtctcgtggttcaccgtcactactaactccatgagcgtcggtccgccgacggcctaccgggaaggggaacggggcgtagggaggttcgggtctacgttaaggtttatttagttagggttggggtacggggttgggtcgtacgtagtacgtttacggacgtacgtaaccgtccgggtaggaacgggaccgtattaccgacctacgtacctaccgaagacgtaactaaacttacccgaagttacgaaccgtaacgtacttacgttaacttaccttaaacaaaacgtacgtaaacgtacgacccgttagggaaacggtaaccgggacccggaacgaaccggtaacccgggtccgttaaccgtttaacgttaacgttcggtacggggaccgggtaaccggggtagggtaacggggaccgggggaaacggggaaggggtaccggtaaggtttcggtaaacgttttacgggttaaccggaccgggttaccggggtacggggggtaaaccccggg

SEQ ID NO: 427200 - DNA, 627 bp, Homo sapiens
  misc_feature: GZ8MTXP02IMAI2.21.76.G10.1.454.CMB.2.raw
  modified_base (459)..(459): a, c, t, g, unknown or other
  modified_base (546)..(546): a, c, t, g, unknown or other
  modified_base (578)..(578): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagtcttgggttttccttgttactatttacaaaaggtgtccagtgtgaggtgcagcgtggtggagacgtgggaggagacttgatccgaaccggtcgggggtccctgagactctctgtcgcgtctcgtggtccaccgtcactaactaactcatgacgcgtcggtccgccaggcctccggaggggaggcgtggaggtggtcctagtagtttattagtaggtgtgggtggtcgacaagtactacgcgtaagacgtccggtaggaacgggtcctattacccaactattcccgacaagacaaactaacttacaagtagaaaaccncgtacttatacttaccttaagaaaacttgaaaacctgacccagaacgtaccgaccgaacgtaacccgacggtaccctattactacgngtacggaggacgggagtacgggaacgggaggnggactaaggttacgactttacgtacggaccgttaggggacgggaacccg

SEQ ID NO: 427201 - DNA, 560 bp, Homo sapiens
  misc_feature: GZ8MTXP02FL31J.21.76.G10.1.454.CMB.2.raw
  modified_base (341)..(341): a, c, t, g, unknown or other
  modified_base (482)..(482): a, c, t, g, unknown or other
tcagtcgtcgctcgcacgaccggtgctcgatttagtcactcatacaggggctgggagaggagcccagcactgggattccgaggtgtttccattcggtgataagcactgaacacagaggactcaccatggagttttggctgagctgggttttccttgttactatttcaaaaggtgtccagtgtgaggtgcagctggtggagactggaggagacttgatccaacctgggggtccctgagactctcctgtgcggtctctgggtcaccgtcactactaactccatgagctgggtccgccaggctccaggggaagggctggagtgggtctcagttattatagtggnggtggtgccagatacgcagactcgtgaagggccattcaccatctcagagacaattccatgaacacgctgtatcttacaaaatgaaacagccctaggaacgacgccccgaaacgaaccaccgggcccgttactaagtttacnggtacgaccggacggggtacgtagggacggggagggacgggcaagtggattacgttgaccacgtcgggggcaacgggg

SEQ ID NO: 427202 - DNA, 751 bp, Homo sapiens
  misc_feature: GZ8MTXP02GWH1G.21.76.G10.1.454.CMB.2.raw
  modified_base (289)..(289): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagacgtggaggagacttgactccgaaccggtgggggtccctgacgactctcctgtgcgtctcgtggtcaccgtcactactaactccatgngcgtcgggtcccgcgaggcctaccggaggggacggggcgtggaggttcgggtctcgtagtttagtttagtaggtgggtggtggtcgcgagtagtacgcgacgtacgtccggtaggaacgggtccgtacttccgaacctactcccgtaaccgaggaaacgtaacctaacgttacccaagttaacggaaaccacggttaccttagttaaacttacctttaaaacaaaattacggaaactaccggtacccgtaagggaacgaacccgggtacccgaaacccggaaccggtaacccggggtacctttaccgttaaaagtttccccggtaagggggttaccgggaccgggggaaccgggggttaaaggaccgggggaacgggggaaaggggtcggactaaaggggtttacggaacttttaaacgggttcccggaaaccgggtcccggggtttaagggggaaccccgg

SEQ ID NO: 427203 - DNA, 574 bp, Homo sapiens
  misc_feature: GZ8MTXP02FL6CF.21.76.G10.1.454.CMB.2.raw
  modified_base (296)..(296): a, c, t, g, unknown or other
  modified_base (374)..(374): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtggttcaccgtcactactaactccatgagctgggtcccncaggctccgaggggaggggctaggagtgggtctcgtagttatttatagtggtggtggtcgcagattacgcagactcgngaaggccattcacatctcagacgacaattccatacgaacacgtctagtactcttaacaaatgaacagcctagagacgacccgagaccacggcccgttataatacgtgttcggaccggtaaggggacgtagggaccggggaagggacgggactaaggtacggtaacttacgttcggaccgtaacgggtcgggggtaaccgg

SEQ ID NO: 427204 - DNA, 699 bp, Homo sapiens
  misc_feature: GZ8MTXP02HBB1I.21.76.G10.1.454.CMB.2.raw
  modified_base (196)..(196): a, c, t, g, unknown or other
  modified_base (306)..(306): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatcgacccagtctccatccctccctgtctgcatctgtagganacagagtcaccatcacgttcggccgggcggtcaggacattagactattattagcctgtatcagcaagaaaccaaggtaaactacccaagctacctagatctatgcttacnctacttccttctttacgaccctaaacgtccgtaacggggtacccctaagttcccgttcgggttaccgtaagggttcggaccggtaggttacggggaaacttcgggttagggggaaacctaaaggtttcttttacccaaacctttccgtaaccctaaccccgaaagttccgaaaccgaccgtaccgtaccgtacgtaccgtaacgaccgtaacgtaaacgttacgttaacgttacgtaaacgttaaactttaaacttaaacttaaacgtaaaacgtaaaaacgtaaacgtaaacgtacgtaccgttaccgtacccttacctaccgttaccgttacggtaccggtaacggaacggaaacggtaacggtaacgaaacgtaaacgtaaacgtaaacg

SEQ ID NO: 427205 - DNA, 756 bp, Homo sapiens
  misc_feature: GZ8MTXP02GX7VL.21.76.G10.1.454.CMB.2.raw
  modified_base (314)..(314): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtcctgagactctcctgtgcggtctcgtggttcaccgtcactactaactccatgagctgggtccgcaggctccgagggagggcnggagtggtctctagtttatttagtagtgggtggtggtcgtcgagtactttacggcgaagtaccgtccgggtaggaaacggggtcccgtaagtttcccaacccgtaaattcccttacccgaagggaaacgtaaccctaaaattttcccccggaaattaacggaaaccctaaccggtaccttttagggtaaactttcccgttttaaacaaaaacgttacgaaaaccgagtaccccctagggaaccgaaccggacccgaacgaaccgtacccgggtacccgttacgtttacgttaaaccgtggttacggaccgggtaaacgggggtaaacgggtagggaaccggggggtaaaacgggggtacgggaaccgtaaggttaaacgggttaaccgttttaaccggtttaccgggaaaaccccggtaccgggggttacgggggtaacccg

SEQ ID NO: 427206 - DNA, 557 bp, Homo sapiens
  misc_feature: GZ8MTXP02H2OM5.21.76.G10.1.454.CMB.2.raw
  modified_base (297)..(297): a, c, t, g, unknown or other
  modified_base (395)..(395): a, c, t, g, unknown or other
  modified_base (519)..(519): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctggggggtccctgagactctcctgtgcggtctcgtgggttcaccgtcactactaaactccatgagctgggtccnccaggctccgagggaaggggctggagtgggctcgagtttatttatagtggtggtggtgcagattacgcagactccggtgaaagggcccgattcgaccntctccagagacaatttccatagaacacgctgaactcttaacgaaattgaaacgagccctgagacgccgaacgacacggccttatattactgtgaccggagggaggtgacgggggaggagggtanaagtggtaacttacgttggaccgtacggtacggggacg

SEQ ID NO: 427207 - DNA, 579 bp, Homo sapiens
  misc_feature: GZ8MTXP02JJOLX.21.76.G10.1.454.CMB.2.raw
  modified_base (295)..(295): a, c, t, g, unknown or other
  modified_base (402)..(402): a, c, t, g, unknown or other
  modified_base (472)..(472): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtgggggtccctgagactctcctgtgcggtctctggtcaccgtcactactaactccatgagcgtgggtccnccgaggctaccgaggggacggggctggagtgggtctcgtagtttattagtagtggtcgtacacctatactacacagactccgtgaacgggcatccacatctacaganacaatccgaaggtaacacattagtatctacaaatagaatacagagagaccgagacacgacatgattacgngtgtagggtcctagttccgtacggaccccggtcgggggacccgggaacctcggtaacccgacccgtacccgttacccccgacccgtacccaaccggaaccggtcccc

SEQ ID NO: 427208 - DNA, 747 bp, Homo sapiens
  misc_feature: GZ8MTXP02HAYCF.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcgttgggttttccttgttactatttacaaaaggtgtccagtgtgaggtgcagctggtggagacgtgggaggagacttgactccgaaccggtcgggggtccctggacgtactctccgtgtgccgtctcgtggtcaccgtcactactaactccatgacgtcgtcggtccgccgaggccgtaccggaaggggtaacggggcgtagggaggttcgggtctacgtaagtttagtttagtaggttggtggtggtcgtagagtagttacgcgtaagtaccgttccggtaggaaacggggtcccgtaactttaccaaccgtacgttacccgtaacccgaagggtaaaaccgtaaaccttaaaacttaccccgtaaagtttaaaccggaaaacccgtaccgttacccgtttaacgttaaactttaacccgtttaaataaaacgttaacggaaacccttacgacccgttagggaaaccgaaccgacccggaaacgaccggaccgggtccccttaatacgttaaccgtggtacggacgggaaccgggtaggtacggggacggggacgggaggcgtaaggtggtaaccttacgttagcgttacggacgggaccgggg

SEQ ID NO: 427209 - DNA, 554 bp, Homo sapiens
  misc_feature: GZ8MTXP02GPIFD.21.76.G10.1.454.CMB.2.raw
  modified_base (437)..(437): a, c, t, g, unknown or other
  modified_base (469)..(469): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctcgtgggttcaccgtcactactaactccatgagctgggtccgccaggcctccgaggggaaggggctggagtggggtctcagttatttatagtggtggtggtgcgagattacgcagactccgtgaagggccgattcacatctccagagacaattccatgaaccagctagtatcttacaaagtnaactagcctgagacgccgacgacacggccgtntaattactgtcgaggacggggagtgggaacggggaggagggtacaagttagggattacgtttcggaccgacggtcgggggaaccg

SEQ ID NO: 427210 - DNA, 607 bp, Homo sapiens
  misc_feature: GZ8MTXP02HRXFW.21.76.G10.1.454.CMB.2.raw
  modified_base (265)..(265): a, c, t, g, unknown or other
  modified_base (299)..(299): a, c, t, g, unknown or other
  modified_base (375)..(375): a, c, t, g, unknown or other
  modified_base (386)..(386): a, c, t, g, unknown or other
  modified_base (428)..(428): a, c, t, g, unknown or other
  modified_base (445)..(445): a, c, t, g, unknown or other
  modified_base (451)..(451): a, c, t, g, unknown or other
  modified_base (471)..(471): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagacgtggaggagacttgactccaaccgtgggggtccctgagactctcctgtgcgtctcgtggtcnccgtcactactaactccatgacgcgtgggtcccnccgaggcctccggaaggggaaggggcgtaggaggtcggggtcttacgtagtttatttagtaggttggtggtgtcgnagtagttacgnagactcggtaggaacggccgtattccaccagttccacaaganaactaacttccaagtanaaaccncgtcgtatatacctttaaanaaagtacaacgtagtacgaggacgaccgaccgacgacgccgtactactagtacgtggacggacggacgggtaggacgggacgggaggacggagtaaggtcgtacgttacggtacgtaccggtacgggtacgggacg

SEQ ID NO: 427211 - DNA, 738 bp, Homo sapiens
  misc_feature: GZ8MTXP02HVD3I.21.76.G10.1.454.CMB.2.raw
  modified_base (298)..(298): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccgaacgtgggggtccctgagactctcctgtgcggtctcgtgggtcaccgtcactactaactccatgagcgtcgggtccncgaggcctccggaggggagggctggagtgggtctgtagtttattagtaggtggtggtggtgacagtattacgcacgacgtccggtaggaaacggggcctacgttaccacccgtattcccgtaccgaaggtaaacgaccttaaaactttcccaaagttacggaaaacctccggtacttacgttaaacttaccgtttaaacaaaaagttacgggaaaacccttacggaccccgttaggggaaccgtaacgggacccccggaaacggtaacccggtaccggggtaccccttagttaaaacgtttaccgtgggtaccgggacggggtaaaaccgggggtggtacgggggaaaccgggggaaggggaccggggacgtaagggttaggggtaaactttaacccggtttcggaaacccggtacgggggttacggggggaaaccccgg

SEQ ID NO: 427212 - DNA, 643 bp, Homo sapiens
  misc_feature: GZ8MTXP02JG3JH.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtggttcaccgtcactactaactccatgagcgtgggtccgccaggcctccgaggggaacggggcgtggagtgggtctcgtagtttatttagtagtggtggtggtcgcgagtattacgcagactccggtggaaacgggccgtagttccacactcctaccaaggacaactaacttccaagttacgaaaccacgtctagtactcttaaacaaattcggaaaactggaccctaggaacgaccgaccggaaaccgacgaaccggggtcccttaagttacgtacgttcggacggtaccgggaacggggtaggtcgggaaaccgggggaaggcgggactaaggtgggtaaacctttacgttaccgggaacctacgggggtcgggggtaaacccg

SEQ ID NO: 427213 - DNA, 612 bp, Homo sapiens
  misc_feature: GZ8MTXP02G39CX.21.76.G10.1.454.CMB.2.raw
  modified_base (299)..(299): a, c, t, g, unknown or other
  modified_base (456)..(456): a, c, t, g, unknown or other
  modified_base (530)..(530): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttacaaaaggtgtccagtgtgagtgcagctggtggagactgggagagacttgactccgaaccgtgggggtccctgagactctcctgtgtcggtctcgtggtcaccgtcactactaactccatgagtcgtggtccnccgtaggctccggaaggggaggcgtggagttcgggtctagtagtttacttagtaggttggtggtggtgacgtagtattacgacgtaggtacctccgggtagaaacgggggtcctagttccaacctagtcctaccgagacaactactccatacgaacncgtcttagattctaaataaactagaacacgtccaggacgaacgccgaccgaacgacggttcctattaacgtacnggtacggacggacgggtagacgggacgggggaggtacggataagtggaactttacgtcggacccgtagggtcggggaaaccg

SEQ ID NO: 427214 - DNA, 725 bp, Homo sapiens
  misc_feature: GZ8MTXP02IUQRK.21.76.G10.1.454.CMB.2.raw
  modified_base (342)..(342): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaggtgtccagtgtgaggtgcagcgtggtggagacgtgggaggagtacttgactaccgaaccggtcgggggtccctgacgtactctccgtgtcggcggtctcgttcggtccaccgtcactactaactcatgagtcgtcggtccgccgaggtcctcggaaggggacggtcgtggnggttggtcttcgtagtttattagtagtggtgggtggtcgcgtagtactacgacgtacgtacgtcgggtaggaacgggccgtacttccacctactcctaaccgaagtacctaactaaacttccaagttaacgaccctacggttcttagttaacttacgtttaaacaaaacttaggaaaacccgtgttacccgaggggaaacgaacccggaccggaaccggtaaacgtcccggggttacccttagttaaacttccgggtgggtaccggggtaccggggtaacgggggtaggaccgggggaacgggggtacggaccggtgtaaacggtcgggtaaacgttttaaccccggtgggaacccggtttacgggggagggggtaacccccg

SEQ ID NO: 427215 - DNA, 575 bp, Homo sapiens
  misc_feature: GZ8MTXP02IXIU3.21.76.G10.1.454.CMB.2.raw
  modified_base (396)..(396): a, c, t, g, unknown or other
  modified_base (415)..(415): a, c, t, g, unknown or other
  modified_base (425)..(425): a, c, t, g, unknown or other
  modified_base (439)..(439): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctggagactctcctgtgcggtctcgtgggtcaccgtcactactaactccatgagctgggtccgccaggcctccgaggggaggggctggagtggggtctctagttatttagtagttggtggtggtgcgagtattacgcagctccggtgaaggcgatcacatcncagacacattccatgaacncgctgtactntacaaatgaaactncctagagacgccgaacgacacgggcccttataattccgtaggtcgaccgggaacggggaggttaccgggacggggagggacgggctaaggtggaactttaccggttacggaacccgagggtacggggggtaacccg

SEQ ID NO: 427216 - DNA, 850 bp, Homo sapiens
  misc_feature: GZ8MTXP02HJJM7.21.76.G10.1.454.CMB.2.raw
  modified_base (299)..(299): a, c, t, g, unknown or other
tcagtcgtcgctcgcacgaccggtgctcgatttagtcactcatacagggggctgggagaggagcccagcactgggattccgaagtgtttccattcggtgatcagcactgaacacagaggactcaccatggagttttggctgagctgggttttcctgttactatttcaaaggtgtccagtgtgaggtgcagctggtggagacgtgggaggagacttgactccgaaccggtggggggtcctggagactctcctgtgcggtctcgtggtcaccgtcactactaactcatgagcgtcggtccncgaggctccggaaggggaaggggctggggacggtggggtctacgtagtttatttagtaggttgggtgggttgacgacgagtacttacggactacggaccgtccggtagggtaaacggggcccgtaagttcccaaccgtaacgttcccgtacccgaaagggtacctaaaaccgtaactttaccccaaaagttaccgggaaaaaccctccgggtacctttaggtttaaaacgttaccccttttaaaaaacgtaaaacgtaaccggtaaaaccgtaccggtaacccggtaaagggtaaaccgggaacccgggaaccccggggttaaaccggaaccccggtaacccgggggttaccccgtttaacgttaaaacggtttccggggtacggggtaccggggtaacgggggtaaacggggggtacgggtaaccggggggaaacgggggtaacgggggtaaccggggtaagttaacgggttaaccggggttaaaccgtttaaaccggggttaaccggggtaacccgggggttaacggggggtaaccggggggtaacccg

SEQ ID NO: 427217 - DNA, 735 bp, Homo sapiens
  misc_feature: GZ8MTXP02GZNME.21.76.G10.1.454.CMB.2.raw
  modified_base (301)..(301): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtgggaggagacttgactacccgaaccgtggggggtccctgacgactctcctgtgcggtctcgtggtcaccgtcactactactcatgagcgtgggtccnccgaggcctccggaggggacgggctagggagtgggtctcgtagttatttagtaggtggtggtcgtgcagtagtacgcgagacgtccggtaggaaacggggcctaagttacccgacctacgttacccgcccgaaaggtaacccgtaaactaaacctttcccgaaattaacccgggaaaacctacgcctttaggtaaacttcccctttaaaaacaaaagtaccgaaacgtcgaacccgtagggaaacgacccgacccggtaaccgaccggtaacccggtaccttaagttaacgttaccggtgggtaacccgggtacggggaaacgggggtaaggtaacgggggaaaccgggggtacggaacgggttacaaagggttacggttaaccgtttaaccggttcccgggaaaacccgggtcgggggttaacgggggacccc

SEQ ID NO: 427218 - DNA, 793 bp, Homo sapiens
  misc_feature: GZ8MTXP02F7PPG.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtggggggtccctgagactctcctgtgcggtctcgtggtcacgtcactactactccatgagctggtccgccaggtctaccggaggggaacggggctggaggtcgggtctacgtagtttatttagtaggtggtggtggtcgcgtagtattacgcgagtaccgtcccgggtaggaaacggggtcccgtaattaccgaccgtaacttccctaaccgaagaagtaaaccctaaatttcccgaaagttaccggaaacctaacggtccgtttagtaaacctttccgtttaaaaccgtaaaaagttacgggaaaacccgagtaccccggtttaaggaaaccgggtaacccggtaccccggtaaaccggaaccccgtaaccgggggttcccccgttaactttaaacggtttaccgtacgggttaccggttaccgggggaaacccgggggttaaagggttacgggggaacccgggggttaaagggggtacggggaaccgtaaaaggttcggggaaaacgtttaacccggttttacggaaaaccccggtttaacggggtcgggggtaaaaaccccgggg

SEQ ID NO: 427219 - DNA, 605 bp, Homo sapiens
  misc_feature: GZ8MTXP02HYJ04.21.76.G10.1.454.CMB.2.raw
  modified_base (292)..(292): a, c, t, g, unknown or other
  modified_base (434)..(434): a, c, t, g, unknown or other
  modified_base (455)..(455): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacgtgggggtccctgagactctctgtgcgtctcgtggtcaccgtcactactaactccatgagctcgggtccnccgaggctccggagggagggcgtggagtgggtctcgtagtttattagtaggtggtggtggtcgcgagtattacgcagacgtccggtagaaacggggtcctattccgacctatcccaccaagacgactaattccatacgaacncgctgtactctacaaatgaangaccgtagagacgccgaacgaccgacgggtacccttatacgttaccgtggtcggaccgggtaacggggtggtacgggacgggggaggaacgggccgtaaggtacgggaactttacgttacggaccccgtagggtaccgggggaaacccgg

SEQ ID NO: 427220 - DNA, 598 bp, Homo sapiens
  misc_feature: GZ8MTXP02FNUVN.21.76.G10.1.454.CMB.2.raw
  modified_base (240)..(240): a, c, t, g, unknown or other
  modified_base (259)..(259): a, c, t, g, unknown or other
  modified_base (299)..(299): a, c, t, g, unknown or other
  modified_base (370)..(370): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagactgggaggagacttgatcccgaaccgtggggggtcccngagactctcctgtgcggtntctgggttcacgtcactactaactccatgagctgggtccncgaggctccgagggaggggctggagtgggtctcgtagtttatttagtagtggtggtggtgcagtattacgnagactccggagaacgggcattcacatctacagagacaattccatagaacacgtctagtattcttacaaatagaacagacctagagacgaccgaacgaccgacggtaccgtacttattacgtggtacggacggtaacgggggaggtacgggaacggggtaggggaacgggttaagtgggtaacttaaccgtttacggacccgtacgggtacgggggactaaaccggggg

SEQ ID NO: 427221 - DNA, 751 bp, Homo sapiens
  misc_feature: GZ8MTXP02H7R4E.21.76.G10.1.454.CMB.2.raw
  modified_base (311)..(311): a, c, t, g, unknown or other
  modified_base (515)..(515): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagtcttgggttttccttgttactatttcaaaaggtgtccagtgtgaggtgcagctgggtggagacgtgggaggagtacttgactacccgaacccggtgggggtccctggacgactctccgtgtgcgtctcgtggttcaccgtcactactaactccatgagcgtcgggtccnccgaggcctccggaggggacgggcgtggaggtgggtctacgtagtttagtttagtaggtggtggtggtcgcgtagtacgttacgcgacgtacctcgggtaggaacgggggccctagttcccaacgtacttcccgtaccaaggaacaaaccgtaattacccgaatacggaaacctacgtaccgtttagtaacctttaccttaaanaaaacgttacggaaaacccgtcgtaaccccggttgggaaacgggaacccggtaacccggaaacccggacccggtaaaccccggggttccccgttaagtttacgttaacccggttgggtaccgggaccgggtaacgggggtaggtaccggggaacgggggaagggggtacggaccgtaaggttacggttaacgttacccggtttacggacccggttaacggggtcgggggaacccgg

SEQ ID NO: 427222 - DNA, 660 bp, Homo sapiens
  misc_feature: GZ8MTXP02FUR1Y.21.76.G10.1.454.CMB.2.raw
  modified_base (371)..(371): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttacaaaaggtgtccagtgtgaggtgcagcgtggtggagacgtggaggagacttgactcccgaaccggtcgggggtccctgagtactctcctgtgcggtctcgtggtcacgtcactactactcatgacgcgcggtccgcaggctcggagggaggcgtggaggtggtctctagttattagtggtggtggtggtcgagtagattacganacgtcgtccgggtaggaacggggtcctacgttaccaaccgtactccgtaccgaagtaacgtaactaaactttaccaagttaccggaactaccggtacttagttactaccttaaacaaacgtacgaaaaccgcgtccctaagggaacgaccggaccgaacgaccgtacggtctaacgtagttacgtcggtacggacgggacgggtaacggcggggtaacggggacggacgggtacgtaaggtaacgtacgttaccggttacggaacggtacggggtacggggtaacccgg

SEQ ID NO: 427223 - DNA, 692 bp, Homo sapiens
  misc_feature: GZ8MTXP02JEQOX.21.76.G10.1.454.CMB.2.raw
  modified_base (294)..(294): a, c, t, g, unknown or other
  modified_base (315)..(315): a, c, t, g, unknown or other
  modified_base (390)..(390): a, c, t, g, unknown or other
  modified_base (411)..(411): a, c, t, g, unknown or other
  modified_base (635)..(635): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcgttgggttttccttgtttactatttacaaaaggtgtccagtgtgaggtgcagctggtggagacgtgggaggagtacttgactaccgaaccggtcgggggtccctgacgtactctcgtgtgcggtctcgtggtcaccgtcactactactcangagcgtgggtccgcgacggcncggagggacggtcgtggagtggtctgtagttagttagtggtggtggtggcgtcgagtatacgcagtaccgtcggnggaacgggcctatccgactcncctacagaactaacgtacttccagtacaaccgtcgtattacgttacttaccttaaaacgtaaacgttacgaaacgtccggtacccgttaggggaacccgaaccggggacccgtaaacccggaaccggtaccggtacccgtttaacgttaaccggttacgtcggggtaacccggcggggaaacgggggtacgtacgggggaaacgggggacggggaccggtaagnggttacggtaaacgtttacccgtacggaccgggttaacgggccgggggtaaacccgg

SEQ ID NO: 427224 - DNA, 651 bp, Homo sapiens
  misc_feature: GZ8MTXP02HR0RP.21.76.G10.1.454.CMB.2.raw
  modified_base (424)..(424): a, c, t, g, unknown or other
  modified_base (601)..(601): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggtagttttggctgagtcttgggtttttccttagtttactattttacaaaaggttgtccagtgtgaggtgcagctgggtggagacgtgggaggagacttgactacccgaaaccggttcggggggtccctggacgacctctccgtgtggtccggtctcgttcggttcaccgtcactactaacctccatgcgcggtcggtcccgcgacggccgtaccgggaggggacggggcgtgggaggtcgggttccttagtagttttaagtttagttaggtggtgggtggtcgatagtattacggnacggtctcgggtagggaacggcgtacgttcacctacttcccacagactaacacttacgatacgaactcgtactgtaatcttaaataaatacgaaactacgctagacgaacgcccgacgacgtaccggcttacgtattacgtggtcggacgggcggaggtagggacggggaggtacgngtaaagtcgggtaactttacgtcggtaccgagggggttacgggaacccgg

SEQ ID NO: 427225 - DNA, 629 bp, Homo sapiens
  misc_feature: GZ8MTXP02IIDY6.21.76.G10.1.454.CMB.2.raw
  modified_base (326)..(326): a, c, t, g, unknown or other
  modified_base (473)..(473): a, c, t, g, unknown or other
  modified_base (573)..(573): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagacgtgggaggagacttgactccgaaccgtgggggtcctgagactctctgtgcgtctcgtggtcacgtcactactaactcatgacgcgtcggtccgccgaggcctacgaggggaacgggcgtaggnggtggtctagtagtttattagtaggtggtggtcggtgacagtactacgcgaacgtacgtcggagaacggggcctattaccgactataccacaggacaacgtaacttcgaagtacggaaacctacgtcttagttactaccgtttaaanaaaagtcgtaaacacggtacctaggacgaccgaccgacgacgaccggcttactacgtacgtagtcgacggggaagggtacggtacgggacgggggtaggnggacaaggttacggtaacgttacgtttacggaccgttaccggggagggtaacccgg

SEQ ID NO: 427226 - DNA, 619 bp, Homo sapiens
  misc_feature: GZ8MTXP02ITQ4A.21.76.G10.1.454.CMB.2.raw
  modified_base (457)..(457): a, c, t, g, unknown or other
  modified_base (576)..(576): a, c, t, g, unknown or other
tcagtcgtcgctcgcacgaccggtgctcgatttagtcactcatacaggggctgggagaggagcccagcactgggattccgaggtgtttccattcggcgatcagcactgaacacagaggactcaccatggagttttggctgagctgggttttccttgttactatttcaaaaggtgtccagtgtgagtgcagctggtggagactggaggagacttgatccaaccgtgggggtccctgacgactctcctgtgcgtctctggtcacgtcactactaactccatgacgcgtcgggtccgccgaggcctccggaaggggaaggggtctaggggtaggtgggtctacgtagtttatttagtaggttgggtggtggtgacgtagtattacgcaggactccggtagaaacgggtccacgttcaactatctaccaggaacgactaacttccgaatacgaaacacgtntacgtattacttacaaaagttacgaactcgaccgtaggagaccgaccgtacgacgacggccgtacttataccgttgacgggacggacggggtaggtcgggaacggggagggacggacgngtaggtacttacgttacgaccggtaacggtcgggggaaacccg

SEQ ID NO: 427227 - DNA, 641 bp, Homo sapiens
  misc_feature: GZ8MTXP02IRU4H.21.76.G10.1.454.CMB.2.raw
  modified_base (296)..(296): a, c, t, g, unknown or other
  modified_base (492)..(492): a, c, t, g, unknown or other
  modified_base (500)..(500): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactattcaaaaggtgtccagtgtgaggtgcagctggtggagacgtggaggagacttgatccgaaccgtcgggggtccctgagactctcctgtgcgtctcgtggtcaccgtcactactaactccatgagcgtggtcccnccgacggcctaccggaaggggaaggggcgtagggaggtcgggtctacgtagtttagtttagtaggtggtgggtggtgcgtagacgttacgcacgtactcgggtagaacgggccacgttccacgtatccctacgaagacgaactaacgtccaaagtacgaaacctacgtccgttaataacttcttaaacaaagttanaaccgtanccgtgaaacgcgacccgaacggaccgtaaccgggtccttaactaagttcccgtaggtcggaccgggaaggggtaccgtagggaccggggaaggggtcgagtaagtcggtaacttaccgtacgaccgtcgggacggggaacg

SEQ ID NO: 427228 - DNA, 675 bp, Homo sapiens
  misc_feature: GZ8MTXP02I3CPP.21.76.G10.1.454.CMB.2.raw
  modified_base (194)..(194): a, c, t, g, unknown or other
tcagtcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatcgacccagtctccatcctcctgtctgcatctgtagganacagacgtcaccatcacgttcggccgggcggtacaggactagttagactattagttacgcctggtactacgagacgaacgaaaccgtaggttaaaccttccaaagtcctacctagtacttcgtatcgctagactacttccctatttacgacctaacgtcgacgggtccctagttcccgttcgtcgaggtcggactaggtggacttacgggtacgggtaactagttacctttccacttacctaccaactactacgaacggtccacgtcccgtacgaccgtacggtaccgttaaggtaacgttacgtttacggtactaaccgtttaatttaacgttaactaaccgttaaaactaaaaagttacgtaacgtaccgtaacggttccccgtacccgtacctttaccgtacccggtttaccggacggtaaccggtacgggaaaccgtaggggttaccgtaaaccgtaacgtaaaccgtaaaaccggg

SEQ ID NO: 427229 - DNA, 623 bp, Homo sapiens
  misc_feature: GZ8MTXP02IJ4NR.21.76.G10.1.454.CMB.2.raw
  modified_base (306)..(306): a, c, t, g, unknown or other
  modified_base (484)..(484): a, c, t, g, unknown or other
  modified_base (548)..(548): a, c, t, g, unknown or other
  modified_base (579)..(579): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctgggtggagacgtgggaggagacttgatcccgaaccgtcgggggtccctgacgactctcctgtgcgtctcgtggtcaccgtcactactaactccatgagcgtcgggtccgccnggctccggaggggagggcgtggaggtggtctgtagtttattagtaggtggtggtggtcgacgagtagtacgcgacgtaccgtccgggtaggaacggggtccgtacttcccgactactcctacagacgtaacaacgtttcccaaagtacaaacccgtacgcttagtaacttccttaaanaaaagttcgaaaccgtagtccgtagacgacgaccgacgaccgtacgccgttataactgtacggnggccggaacggggtgacgggacgggacgggnacgtaaggtgtaacttcgtacgaaccggtcgggacggggaccgg

SEQ ID NO: 427230 - DNA, 557 bp, Homo sapiens
  misc_feature: GZ8MTXP02FV4AR.21.76.G10.1.454.CMB.2.raw
  modified_base (298)..(298): a, c, t, g, unknown or other
  modified_base (346)..(346): a, c, t, g, unknown or other
  modified_base (377)..(377): a, c, t, g, unknown or other
  modified_base (471)..(471): a, c, t, g, unknown or other
  modified_base (487)..(487): a, c, t, g, unknown or other
  modified_base (500)..(500): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactgggaggagacttgatccaacgtggggggtccctgagactctcctgtgcggtctcgtgggttccaccgtcactactaactccatgagctgggtccnccaggctccaggggaaggggctggagtgggtctcgagttatttatagnggtggtggtcgctagattacgcagactccgngaagggccgattcactatctccgagacgacaatttcccaagtagaacacggtctgtactcttacgaaatgaacagcctagagacgccgacgacncgggcctactatacgngtgacggacgggngtacggggacgggaggaggtacaagcggtatacgtttgacctacggcgggggaaccg

SEQ ID NO: 427231 - DNA, 699 bp, Homo sapiens
  misc_feature: GZ8MTXP02JGCZK.21.76.G10.1.454.CMB.2.raw
  modified_base (292)..(292): a, c, t, g, unknown or other
  modified_base (298)..(298): a, c, t, g, unknown or other
  modified_base (313)..(313): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactgggaggagacttgatccaaccgtgggggtccctgagactctcctgtgcggtctcgtggtcaccgtcactactactccatgagctggccncaggcncgagggagggctggngtgggtctgtagtttatttagtggttggtgggttggtgcgtagtattacgcgagactccgggtaggaaacggggccgtattccaccgtactcctaccgaagacgaacctaaacttccaagttagaaaacccctcgtaccttagtaacctttctttaaacgaaaacttacggaaaccacgaccccgtagggaaacgaccggaaccccggaaccggaaccgacccgggtccctttaacgttaactttaaccggttcggtacgggaccgggaaccgggggtaaacgttcgggggaaaccgggggaagggggaaccggggctaaagggttacggtaaaactttaccggtttaggaaacccccggtacgggggttcggggggaaaccccgg

SEQ ID NO: 427232 - DNA, 679 bp, Homo sapiens
  misc_feature: GZ8MTXP02IW9KQ.21.76.G10.1.454.CMB.2.raw
  modified_base (386)..(386): a, c, t, g, unknown or other
  modified_base (471)..(471): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttcctgttactatttcaaaggtgtcagtgtgaggtgcagctggtggagacgtggaggagacttgatccaaccgtgggggtccctgagactctcctgtgcggtctcgtggttcaccgtcactactaactccatgagtcgtcgggtccccaccgacggcgtaccgaggggaacggggcgtggaggttcggtctcgtagtttatttagtaggttggtggtggtgcgaagtacttacggnacgtacgtccggtaggaaacgggccgtattcccaaccgtattccgacgaacgacgtaaacctattacccgaaattacgaaacccncggttaacttgttaaacttctttaaacgaaaacgtttcgaaaacttacggacctagggaaagacccggacccgaacggaaccgacccgggtccttagttaaagtaccgtggtacggacggtaaagggacggtacggaggggacgggaggcgtaagttacggggaaacttttccggttaacgacccggtaagggttacgggggaacccg

SEQ ID NO: 427233 - DNA, 615 bp, Homo sapiens
  misc_feature: GZ8MTXP02G718T.21.76.G10.1.454.CMB.2.raw
  modified_base (279)..(279): a, c, t, g, unknown or other
  modified_base (292)..(292): a, c, t, g, unknown or other
  modified_base (355)..(355): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtgggaggagacttgatccgaaccgtgggggtccctgagactctctgtgcgtctcgtggtcaccgtcactactaacncatgagctggccncaggctcgagggaggctggagtgggtctgtagttattagtaggtggtggtgtgcagtatacgnagctccggtgaacggccgtattccactatcctacagacgaactaacttcgaatacgaaaccacgtacttagtacttacttaacaaattacgaaactgaccctaggaacgaacggacccggaacgaccgaccggccgttacttagttacgtcggtcggaccgggaacggggtagggtacggggaacgggggaagggtacgggacgtaaggtcgggtaaactttacggttacggaaacccgtacggggtacgggggaacccg

SEQ ID NO: 427234 - DNA, 741 bp, Homo sapiens
  misc_feature: GZ8MTXP02JM8PM.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcgtgggttttccttgttactatttcaaaaggtgtcagtgtgaggtgcagctggtggagacgtgggaggagacttgatccgaaccggtgggggtccctgacgtactctccgtgtggcgtctcgttgggtccaccgtcaactactaactcatcgagcgtggtccgccgacggtcctacggaaggggaacggggcgtagggaggttcgggtctacgtagtttatttagtaggttgggtgggtgtacggtactaggtacttacggacgaacgtaccgtccgggaagggaaaccgggggtccgtaattacccgaaccctaaatttccccgaaccgaagggtaaaccctaactaaacgtttaccaaagttaacggaaaccctccgtagtttacgtaacttactttaaaaccgaaagttacccggaaatccgccgtagggaaccgaccggaccgtaacgaaacccggcggttaaccccttagtttacgtaaccggtggtaggaaccgggtaccgggggtagacgggggtaacgggacgggtagaacgtaagtacgggggttaaactaccggttacgaaccccgggtaggggttacccgggaaccgg

SEQ ID NO: 427235 - DNA, 609 bp, Homo sapiens
  misc_feature: GZ8MTXP02FX9WL.21.76.G10.1.454.CMB.2.raw
  modified_base (412)..(412): a, c, t, g, unknown or other
  modified_base (472)..(472): a, c, t, g, unknown or other
  modified_base (594)..(594): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagcgtggtggagactggaggagacttgactccgaaccgtgggggtccctgagactctcctgtgcggtctcgtcgggttcaccgtcactactaactccatgagctcggggtcccgccgaggcctaccggaggggaacggggcgtgggaggttcggggtctacgtaggtttatttagtagtggtggtgtcgcagtatacgcagctcggagaacggcacttcactntctcgagacgacaattccaatgaaccacggtcttagacttacttaacgaaaatcgaaacncgtacctaggaacgacgcccgaacgtaccgacgggtccttatacgttactggcggacggtacggggagttacgggacgggtagggagggacaaggtacggaactttaccgttagaacccggnggtacggggaaccgg

SEQ ID NO: 427236 - DNA, 591 bp, Homo sapiens
  misc_feature: GZ8MTXP02FQIHP.21.76.G10.1.454.CMB.2.raw
  modified_base (287)..(287): a, c, t, g, unknown or other
  modified_base (304)..(304): a, c, t, g, unknown or other
  modified_base (458)..(458): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagacgtgggaggagacttgactcccgaaccgtcggggggtccctgagactctcctgtgcgtctcgtgggttcaccgtcactactaacnccatgagcgtgggtccnccgaggctccggaggggaacggggctggaggtgggtctcgtagtttatttagtagtggtggtggtgctagtattacgcagactcggagagggcctattcacatcctacagagacaattcatcgaaccatctagtactcttaacgaaatgaaacncgtcctaggacgacgaccgacgaacgacggtccgtactagtaccgtgtcgacgggacggggtagtacgggacggggagggacggacgaaggtggtaacttacgtttacggaccgtacgggtcgggggaacccg

SEQ ID NO: 427237 - DNA, 644 bp, Homo sapiens
  misc_feature: GZ8MTXP02GCGUG.21.76.G10.1.454.CMB.2.raw
  modified_base (295)..(295): a, c, t, g, unknown or other
  modified_base (532)..(532): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtggttcaccgtcactactaactccatgagcgtggtccnccaggcctcgagggagggctggagtgggtctcgtagttatttagtagtggtggtggtgcgagtattacgcgagactccggagaacggggtccgattccaacatccaccaagacgaactaaacttcaaatcgaaaacctcgacttagacttacttaacaaaaagtcgaaaacctagtcccgtaaggaacgaaccggcccgaaacggacccgaacggtccccgttagttaaattaccgngggtacgaccgggggaaacgggtaggtacgggaccgggggaaggacggggtctaaagggttcgggtaaaactttacggttacggaaaccccgaggggttacgggggaccccg

SEQ ID NO: 427238 - DNA, 657 bp, Homo sapiens
  misc_feature: GZ8MTXP02H2KC1.21.76.G10.1.454.CMB.2.raw
tcagtcgtcgctcgcacgaccggtgctcgatttagtcactcatacagggggcagaagtctctctcagtcaggacacagcatggacatgagggtccctgctcagctcctgggactcctgctgctctggctccagataccagatgtgacatccagatcgacccagtctccatcctcctgtctgcatctgtaggagacagagtcacctatctacgttcggccgggtcggtcaggactagttagactatttagttacgaccgttaggtactcgaacgacgaaacggaaaaccgtaagggttaaaccgttacccgaaggtcctaccgtagtacttacttagtcgtctacgtacctacttccctcgtttacgacctaacgtccggacgggttaccctattccggttacgttcgaggtcgtacgtagggtacggtactcgtacgggactagtacgttaccactctaccacctactacgagaccgtcgcctacgccgacggtaccgtaagtaacgtacgttgttaacgtaacttaactttaacgttaactaagtaaactaaaaattacgtaacgtacgtacggtaccctacccgttacctaccgttaccgttcgaccggtaacggtaacggaacgtacggtacgaactaacgtaaactaaaccgg

SEQ ID NO: 427239 - DNA, 558 bp, Homo sapiens
  misc_feature: GZ8MTXP02IBCZK.21.76.G10.1.454.CMB.2.raw
  modified_base (247)..(247): a, c, t, g, unknown or other
  modified_base (278)..(278): a, c, t, g, unknown or other
  modified_base (280)..(281): a, c, t, g, unknown or other
  modified_base (283)..(283): a, c, t, g, unknown or other
  modified_base (289)..(289): a, c, t, g, unknown or other
  modified_base (292)..(292): a, c, t, g, unknown or other
  modified_base (295)..(295): a, c, t, g, unknown or other
  modified_base (303)..(303): a, c, t, g, unknown or other
  modified_base (316)..(316): a, c, t, g, unknown or other
  modified_base (336)..(336): a, c, t, g, unknown or other
  modified_base (408)..(408): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttcctgttactatttcaaaagtgtccagtgtgaggtgcagctggtggagactggaggagacttgatccgaaccgtgggggtccctgagactctctggngcggtctcggtggtacgcgtcactacgtacncnngncgcgcncgngcncgaggagngtgtagtgctgtnttatagtgtggtggtgtcgngagtagtacgcgacgtacgtcgtacggacggacgtactacactactctacagatacaactactatacacacnctactatactactatacgacacgacgagacgacgacgacgacgacgtacgtactacgtacgtcgcggacggtacgggtacggacgggacgggacgggacggacgtaacggtacgtacgtacgttacgtaccggtacggtacgggtaccgg

SEQ ID NO: 427240 - DNA, 624 bp, Homo sapiens
  misc_feature: GZ8MTXP02FMZ1I.21.76.G10.1.454.CMB.2.raw
  modified_base (295)..(295): a, c, t, g, unknown or other
  modified_base (377)..(377): a, c, t, g, unknown or other
  modified_base (385)..(385): a, c, t, g, unknown or other
  modified_base (400)..(400): a, c, t, g, unknown or other
  modified_base (407)..(407): a, c, t, g, unknown or other
  modified_base (424)..(424): a, c, t, g, unknown or other
  modified_base (426)..(426): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagacgtggaggagacttgatccgaacgtgggggtcctgagactctcctgtgcgtctctggtcaccgtcactactaactccatgagcgtcgggtccnccgacggcctccggaaggggagggctagggaggtgggtctcgtagtttatttagtaggtggtggttggtgacgagtatacgnacgctcgngaacggctatcactnctacganagactaatcatagaacncncttagtacttcttaaacaaagtacgaaaccgtagtaccctaggaacgaacgacccggaaccggaccgtaccgggccttactaacgttacctgggtacgaccggggtaagggtagacggggaccggggaaggcggggtaactaaggttaagggtactttaaccgggttacgaacccggtacgggtacgggggaaacccg

SEQ ID NO: 427241 - DNA, 732 bp, Homo sapiens
  misc_feature: GZ8MTXP02JXFYY.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagcgtggtggagacgtggaggagacttgatccgaaccgtgggggtccctgggactctcctgtgcggtctcgtggttcaccgtcactactaactccatgagcgtcgggtcccgccgaggtccgtaccggaagggggaacggggcgtgggtaggtcgggtctacgtagtttagtttagtagggttgggttgggtcggtgaccgtaagtacgttaccgacgtacggtaacccgttcgggtaggaaacggggtccctaacttacccaaccgtattccctaccgaaagtaacgtaaacctaaacgtttcccaaagtacgaaaccctaccggtcttaacgttaacttacctttaaacgaaaagttcgaaaaccgtcggacccgtagaaacgggaccgacccggaaccgtaccgaccggtccgttattaacgtttacgcggttcggacggggacgggtaggtacggggaacgggggagggacggggctagggtaacgtaacgtttaccggttacggaacccgtacggggtacgggggactaaacccgggg

SEQ ID NO: 427242 - DNA, 702 bp, Homo sapiens
  misc_feature: GZ8MTXP02GHZVW.21.76.G10.1.454.CMB.2.raw
  modified_base (301)..(301): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactattcaaaggtgtccagtgtgaggtgcagctggtggagacgtgggaggagacttgactccgaaccgtgggggtccctggagactctcctgtgtcggtctcgtgggttcaccgtcactactaactccatgagcgtgggtccncgaggctccgagggaggctggagtggtctcgtagtttagttataggtggtaggtggtcgtacgagtacgttacgcgtagaccgtccggtaggaaacggggtcctaagttcccaaccgtacttcccgtacccgaaggaactaaacctaaacgtttacccaaagttaaccggaaaccctaacggtccctttaaaggtaacttccccgttttaaaaacgtaaacgttaacggaaaaccgtacggtaccgtaggaacgaaccggtacccggaacgaaccgtaccggtaccgttactaacgttacgtcggtacggacgggtacggggtaggacgggaacgggggacggaggacgtaaggtacggttaacttaccggttacggaaccggtacggggtacgggtaccg

SEQ ID NO: 427243 - DNA, 604 bp, Homo sapiens
  misc_feature: GZ8MTXP02ICVAJ.21.76.G10.1.454.CMB.2.raw
  modified_base (299)..(299): a, c, t, g, unknown or other
  modified_base (374)..(374): a, c, t, g, unknown or other
  modified_base (451)..(451): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactattcaaaaggtgtccagtgtgaggtgcagctggtggagactgggaggagacttgatccgaaccgtggggggtccctgagactctcctgtgcggtctcgtggttccaccgtcactactaactccatgagcgtcgggccnccgaggcctccgaggggaggggctggagtgggtctcgtagtttattagtagtggtggtggtcgcgagtattacgnacgacctccggtaggaacgggcgtattccgactatcctacagagacaattccatagaaccacgtctgtattactaanaaatacgaactacgactggaagacgacccggacgaccgaccggccttataacgtacgtcggtagcgggaaacggggtcggtacggacgggggaagggcggacgtaaggtcgggtaattacctttacggaccgtaacggggtcgggggaaccgg

SEQ ID NO: 427244 - DNA, 829 bp, Homo sapiens
  misc_feature: GZ8MTXP02I94RB.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttacaaaggtgtccagtgtgaggtgcagctgggtggagactggaggagacttgactcccgaaccggttcggggggtcccctggacgtacctctcccgtgtcggcggttctcgtgggttccaccgtcactactaactccatcgagcgtcgggtcccaccgaggcctccggaaggggaacggggtccgtagggacggtggggtacctcgtagtttatttagtaggtgggtggtggtcgacgagtattaccgcgtacgtaccgtccgggtaggaacgggggtcctaacgtttcccaaaccgtacttccctaacccgaaggtaaaccgtaaacctaaactttcccgaaagttacggaaaaccccttacggtctttacggttaaacttacccttaaaacgaaaacgttaccggaaaaccgccgttaaccccggttaagggaaaccggaacccggaccccggtaaaaccggaacccggtaaaaccccggggttccctttaaaaccgtttaaacgtttaaccccggttagggtaaccggggtacccgggggtaaaaccgggggtaggttaacccggggggaacgggggaaagggggacccggtaagtaaccggttaaggggtaacctttacgggttacggaaaacccggtcggggtaacgggggtaaacccg

SEQ ID NO: 427245 - DNA, 665 bp, Homo sapiens
  misc_feature: GZ8MTXP02GZB92.21.76.G10.1.454.CMB.2.raw
  modified_base (278)..(278): a, c, t, g, unknown or other
  modified_base (300)..(300): a, c, t, g, unknown or other
tcagtcgtcgctcgcacgaccggtgctcgatttagtcactcatacagggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactgggaggagacttgactccgaaccgtgggggtccctgagactctctgtgcgtctctgggtcacgtcactactacnccatgacgcgtcgggtaccccncgacggccgtacgggaggggacgggtcgtgggtacggttcggtactacgttagtttagttaggtaggtggtgggtgtcgacgtagtacgtacgacgtacggacgtcgggtaggacggtacctacgtccactacgtccgaacgagtaacaactacgtacgaagtacgacacgtacttaagtacttactaaacgaatacgaacgtggaccggtaggaaccgaccggacgacgtaccgtctacgtacgtacgtcggtacggacgggtagggtacggtacgggaacggggtacggtacggtacgtaaggtaacggttacgttaccggttacggaaccggtacgggggtaccggggaaccgtacccgggg

SEQ ID NO: 427246 - DNA, 680 bp, Homo sapiens
  misc_feature: GZ8MTXP02HUYVC.21.76.G10.1.454.CMB.2.raw
  modified_base (295)..(295): a, c, t, g, unknown or other
tcagtcgtcgctcgcacgaccggtgctcgatttagtcactcatacaggggctgggagaggagcccagcactgggattccgaggtgtttccattcggtgataagcactgaacacagaggactcaccatggagttttggctgagtcttgggttttccttgttactatttcaaaaggtgtccagtgtgaggtgcagctggtggagactggaggagacttgatccaacgtcgggggtcctgagctctctgtcgcggtctcgtggttcaccgtcactactaactccatgagcgtcggccncacggctccgaggggacgggctggaggtgggtctcgtagtttatttagaggtggttggtggtgccagtattacgcgtagaccgttcgtgggaaacgggccgtaacttaccaaccgtactaccgtacccaaagaaccgaactaaacttcccaataccgtaaacacgtcttagtaacttaccttaaactaaacgtacgaaacgtacgtaccgtaaggacggacgacccggaaacgaaccggtacccggtaccgttaacttacgtacgtggtaccggacgggtaacggggacggtacgggaaacgggggtacggacgggtacgtaacggtaacggtaacgtttaccgttacggaaccggtacgggtacgggggtaaccgtaacccggg

SEQ ID NO: 427247 - DNA, 658 bp, Homo sapiens
  misc_feature: GZ8MTXP02JIPW9.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagcgtggtggagacgtggaggagacttgatccgaaccggtcgggggtccctgagactctcctgtgcgtctcgtggtcacgtcactactactccatgagcgtcggtccgccgaggctcggaaggggaggggcgtggaggtggtctacgtagtttatttagtaggtggtggtggtcgtcgagtacttacgcgtacgtcgtcggtaggaacggggtcctacgttccaccgtacgttacctacccgaagaaaccgtaactaactttcccaagttaccgaaaccctacggtacttacgtaacttcggttaaaaccaaaaggttccgaaacacgtacccgtaggaacgaccggacccgtaacgaccgtacggtccgtattaactacgtggtacggaccgggtaacgggagtacggggaccggggaggacggtacaaggtacggtacttacggtcgacggtaacggtcggggaacg

SEQ ID NO: 427248 - DNA, 731 bp, Homo sapiens
  misc_feature: GZ8MTXP02FUKDA.21.76.G10.1.454.CMB.2.raw
  modified_base (301)..(301): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagactgggaggagacttgatcccaaccgtggggggtccctgagactctcctgtgcggtctcgtgggttcaccgtcactactaactccatgagctgggtcccnccaggcctccgaggggacgggctgggagtcggggtctcgtagttatttagtagtgggtggtggtcgcagtattaccggcaaggtaccgttccgggtaggaacggggtccgaacttccgaacctacttcctaccgagaacgtaactaaacgtttacccaaagttacgaaaaccgtacggtacttacggttaacttacctttaaaccgaaaaagttcggaaaacctcggtaccccgttagggaaacgaccggaccccgaaccggaaccgttacccgggggccccttacgttaaacgtttacgggtcggttacggacccggggaaaccgggggttagttacgggggaccgggggaagggaccgggggtaacgtaagggttacgggtaactttaccggttacggaaccccggtagggggtaccgggggaaccgg

SEQ ID NO: 427249 - DNA, 701 bp, Homo sapiens
  misc_feature: GZ8MTXP02JMOPJ.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttacaaaaggtgtccagtgtgaggtgcagcgtggtggagacgtgggaggagacttgactccaaccggtcgggggtcctgagacctctccgtgtcgcgtctcgtggttcaccgtcactactactcatgagcgtcggtccgaccgaggcctaccggaaggggacggggtcgtaggtaggttcgggtacttacgtagtttaatttacggttaggttggggttggtaggtacggtacgtaaggtaactttacggacgtacggtaacgttccggtaagggaaacgggtccgtaacgttaccgtaaccgacttaccgtacccgaagtaacgtaaacccttacttaccgaagtaacgtaaccgacgttacttacgttaacttaccgttaaacaaagttacgaacctagtcccgtaaggaacgacgacccgaacggactacccgggacttacgtaaactacgtgtaacggtcgggaaacggcgtaacgggaacggggtgacggagtaacgtggaacttacgttacggacgtaccggggtggaccgg

SEQ ID NO: 427250 - DNA, 704 bp, Homo sapiens
  misc_feature: GZ8MTXP02GCZT8.21.76.G10.1.454.CMB.2.raw
  modified_base (310)..(310): a, c, t, g, unknown or other
  modified_base (512)..(512): a, c, t, g, unknown or other
  modified_base (550)..(550): a, c, t, g, unknown or other
tcagtcgtcgctcgcacgaccggtgctcgatttagtcactcatacagggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtgagacgtggaggagtacttgactccgtaaccggtcggggggtccctgacgtactcgtcgtgtggcgtctcgtcggttcaccgtcactacaactccatgacgcgtcggtcccncgaggcctaccggaggggaacgggctgggaggtcggtactacgtagtttaagtttagtagggttgggttaggtggtcgtaccgtaagttaacttccggacgtaacggtaccgtccggggtacgggaacggggtccggtaactttacccgaactactacgtaccccaaggtaccaacgtaacttacgaagtacgactaacgtnttaacgtactacccttaaagaaattacgggaaaacccncgtacgtaacggaccggaaccgacccggaacgtaccgaccggttaccgttacgtaagttcgacgggtacggacgggggacgggtacggacggggacgggacggacgtacgaaggttacgtacgttacgtacggaccggtcggggtacggaccgg

SEQ ID NO: 427251 - DNA, 583 bp, Homo sapiens
  misc_feature: GZ8MTXP02H2G1H.21.76.G10.1.454.CMB.2.raw
  modified_base (279)..(279): a, c, t, g, unknown or other
  modified_base (294)..(294): a, c, t, g, unknown or other
  modified_base (324)..(324): a, c, t, g, unknown or other
  modified_base (428)..(428): a, c, t, g, unknown or other
  modified_base (444)..(444): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgactccaacgtgggggtccctgacgactctctgtgcggtctcgtggtcaccgtcactactaacnccatgagctggtccncaggctccgagggaggctggagtgggtctnagtttatttagagtggtggtggtcgcagtatacgctacggactccgggtagaacgggccgattccaaccattcccaccgagacgactaattccaatcgaaaccncgtctagtatctaaanaaatagaactagcctagacgacgaccgaacgacgacggtccgtactactactggtacgcggtaacgggaggtcgggaacggggagggagggacaaggtgggtaacttacggtttacgaccgtacggtcgggggaaccgg

SEQ ID NO: 427252 - DNA, 636 bp, Homo sapiens
  misc_feature: GZ8MTXP02FLTFP.21.76.G10.1.454.CMB.2.raw
  modified_base (485)..(485): a, c, t, g, unknown or other
  modified_base (590)..(590): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtggttcaccgtcactactaactccatgagcgtgggtccgcaggctccgaggggaggggtctgggagtggggtctacgagtttagtttagtgtagggtggtggtgacgtagagttacgcgagaccttccggtaggaacggggtccgacttcgacctatccgtaccaggaacgaactaacttaccaattacgaacctacgtacttgttaaactctttaacaaaacgttanaacgacgccctaggacgaccggacccgaaccgacgccgggtcccgttactacgtttaccgtggtacggccgggaacgggtacggagggacggggaggtacggggngaagtagggattacggtttcggaaccgtacggtcgggggtaacccg

SEQ ID NO: 427253 - DNA, 709 bp, Homo sapiens
  misc_feature: GZ8MTXP02IHFP9.21.76.G10.1.454.CMB.2.raw
  modified_base (539)..(539): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagacgtgggaggagacttgactccgaaccggtggggggtccctggagactctcctgtgcggtctcgtggtcaccgtcactactaactccatgagctgggtccgccgaggcctccgaaggggaacggggctaggggaggtcggggtctacgtagtttatttagtaggttgggtggtggtgactaggtaattaccggcaacggtaccgtccgggtaggaaacgggggtcccgtaattcccaacctaactcccgttacccgaaggaacctaactaaactttcccaaagtaccgaaaccgacgtcctttagtaaccttctttaaaacaaaattccggaaaacgngtacccgtaggaaaccggaccgcccggaaacggaccgtaccgggcccttacttaacgttaccgtcggtaggaccgggtacgggggtagtacgggggaacgggggtaaagggcgggactaaggtggtaaacttaccgggtttacgaccgtacggggtcgggggaaacccgg

SEQ ID NO: 427254 - DNA, 705 bp, Homo sapiens
  misc_feature: GZ8MTXP02ILDZD.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgtttactatttcaaaaggtgtccagtgtgaggtgcagctggtggagactgggaggagacttggatccgaaccgtggggggtccctgagactctcctgtgcggtctcgtgggttcaccgtcactactaactccatgagcgtcgggtcccgccgaggctccggaaggggaggggcgtggaggtggttctcgtaggtttaatttaggtaggttgggttaggttggtcgtagagtacgtttaccgcgtacggactccggggtaggaacggggtacccgtatttccgaacccgtacttacccgtacccagggtaaacgtaacctaaacgtttacccaagttacgaaacccgaacgttccgttagtaaacttccttaaacaaagttacgaaaccgacgtcctagggaacgacgacccggaacgtaaccgaccggtaccgttactacgttacgtggtacggacgggacgggggtacggtagggggaccgggggaagggccgggaagtggtaacggttaacgttacgttcgaaccggttacggggacgggggaaccgg

SEQ ID NO: 427255 - DNA, 784 bp, Homo sapiens
  misc_feature: GZ8MTXP02FWNTC.21.76.G10.1.454.CMB.2.raw
tcagtcgtcgctcgcacgaccggtgctcgatttagtcactcatacagggggctgggagaggagcccagcactgggattccgaggtgtttccattcggtgatcagcactgaacacagaggactcaccatggagttttggctgagctgggttttccttgttactattcaaaaggtgtccagtgtgaggtggcagcgtgggtggagacgtgggaggagacttgactacccgaaaccggtgggggggtaccctaggacgactcgtccgtgtgtcggtctcgtgggttccaccgtacactactaactccatgagcgtgggtaccgcgaggctccgaaggggaggcgtggaggtggggtctacgtaagtttatttaagtaggttcgggtgggttggtacgaccgtaaggtaacgtttaacggcgtaacgtaaccgttccggggtaagggaaacgggggtaccctaaacgtttacccaacctaactcccgtaccgaaaaggtaccaaactaaacttacccgaataacgaacccgagtcttagtaactcttaaacgaaaatcgggaaacacgtaccgttagggaacgtaacccggacccgtaaacggaaccggtaccgggtacccttaattaaccgttaacggtacggttacggggaacccggggaaacggggtaaggttacgggggaaaccgggggtaaacggggaccggaacgtaaaagggttaggggtaaacttaacccggggtttaacggaacccggttaccgggggtaagggggtaaaacccccggg

SEQ ID NO: 427256 - DNA, 737 bp, Homo sapiens
  misc_feature: GZ8MTXP02F45AP.21.76.G10.1.454.CMB.2.raw
  modified_base (298)..(298): a, c, t, g, unknown or other
  modified_base (383)..(383): a, c, t, g, unknown or other
  modified_base (432)..(432): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtggggggtccctgagactctcctgtgcggtctcgtggttcacgtcactactaactccatgagcgtggggtccnccgaggcctaccgaaggggaaggggtctggagttggggtactactagtttatttaagtaggtgggtggtggtcgcaagtatacgnagtaccgtccgtaggaaacgggccgtattccgaaccatccctccgaaanaacgtaactaactcaaatacgaactacgtactacgtacttaacttaaacgtaaacgtaacgaaccgtacgtaccggtaaggtaaaccgaacccgtaacccggaaaccggtaacccgggtacccggttacccgtttaacgtttaaacggttacggtacgggtacggggaaccgggggtaacggggtaaacgggggtacggggaacgggggaacgggtaaggggtaacggtaacggggtaaccgtaaaccgttttaaccggttacccggggtaaaccgggtaacgggggttaacccgggggaacggg

SEQ ID NO: 427257 - DNA, 620 bp, Homo sapiens
  misc_feature: GZ8MTXP02G67FD.21.76.G10.1.454.CMB.2.raw
  modified_base (288)..(288): a, c, t, g, unknown or other
  modified_base (317)..(317): a, c, t, g, unknown or other
  modified_base (471)..(471): a, c, t, g, unknown or other
  modified_base (526)..(526): a, c, t, g, unknown or other
  modified_base (538)..(538): a, c, t, g, unknown or other
  modified_base (555)..(555): a, c, t, g, unknown or other
  modified_base (613)..(613): a, c, t, g, unknown or other
tcagtcgtcgctcgcacgaccggtgctcgatttagtcactcatacagggggctgggagaggagcccagcactgggattccgaggtgtttccattcggtgatcagcactgaacacagaggactcaccatggagttttggctgagtctgggttttccttgttactatttcaaaaggtgtccagtgtgaggtgcagctggtggagactgggaggagtactgactaccgaaccggtcggggggtcctaggacgacttccgtcgtggtcgcggtctcgttggtaccaccgtanaccgttactaactccatgagcgtcggccncgaggcaccggtaggggacgggtctgggagtcggtcgtacttagtttaacgtttagtaggttggtcgggtgtaccgactaagttactacgacgacgtacgttcggaggaaacgggcgtacttccactactccaccgagtaacgactaactaccngttaacaaacgctcttagtactactttaacaaaagtgaaaccctgtccaaggganaccgcgtaacgnaccggttactgtgacgnggacggacggagcgggacgggtagagatcgtcggtaactcgtacgaacggtacggggnggtaacg

SEQ ID NO: 427258 - DNA, 664 bp, Homo sapiens
  misc_feature: GZ8MTXP02F5XKL.21.76.G10.1.454.CMB.2.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtgagactggagagcttgactccgaaccgtggggtccctgagactctctgtgcgtctcgtggttcacgtctactactaacgtccagtgacgcgtcggtcccgccgacggctaccggaggggacgggcgtggaggtgggtctacgtagtttagtttagtacggttggtggttggtgtacgagtacgttaccggacgtacgtaaccgtccggtagggaaacgggccgtattacccaacgtacttccaccgaagaccgaactaacttacccgatacggaaactcgtagtgtacttcgttaaacaaagtacgaaactgacctagggaagaccgaccgttaacgaccgtacgtcccgttaatcgtttacgacggtacggacggtacggggaggtaccgggaacgggggaagtccggggaattaaggtacgtaaagtttccccgaagggaaccgtacgggggtggggaaaccccgg

SEQ ID NO: 427259 - DNA, 663 bp, Homo sapiens
  misc_feature: GZ8MTXP02GKD4O.21.76.G10.1.454.CMB.2.raw
  modified_base (288)..(288): a, c, t, g, unknown or other
  modified_base (308)..(308): a, c, t, g, unknown or other
  modified_base (319)..(319): a, c, t, g, unknown or other
  modified_base (501)..(501): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggtagttttggctgagtcttgggttttccttgttactatttacaaaaggtgtaccagtgtgaggtgcagcgtggtggagacgtggaggagtacttgactccgaaccggtcgggggtaccctaggacgtacttctccgtggtcggtcgtctcgtgggttccnccgtcactactactcatgancgtcgggtccncgaggctccggaggggaacgggtctaggtaggtcggtactcgttaagtttactttagtaggtcgggtaggtggtcgactaggtactacgacacggtactccgggtagggaacgggcctatccgactagtcctacgaagacgactaagtccaagtacaccgactgttatactaccgttaaaanaaacgtagaaccgtgacgtaggaacgacccgaaccgaccggaccgtaccggttcctatacgtcgtcggacggacggtacgggagggtcggggaaacggggacggacgtagtaaggttacggtaacgtttacggtacggaaccggtacggggaccgggaaccg

SEQ ID NO: 427260 - DNA, 644 bp, Homo sapiens
  misc_feature: GZ8MTXP02I0VGV.21.76.G10.1.454.CMB.2.raw
  modified_base (286)..(286): a, c, t, g, unknown or other
  modified_base (311)..(311): a, c, t, g, unknown or other
  modified_base (314)..(314): a, c, t, g, unknown or other
  modified_base (482)..(482): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagactgggaggagacttgactaccgaaccggtcggggggtccctaggagacttctccgtggtcgcggttctcgtcgggttcaccgtnactactactccatgagcgtggtccncgngcctcggagggaggctaggaggtggtctcgtagtttattagtaggttggtggtgtcgctagtctacgcaagtactcgggtagaaacggggcctattccaaccgtatccgtaccgaagacgtaactaactcccgagtacgaaccgacttcctaagtattaccgttaaanaaacgttagaaacttcgaccgtagaacggccaaccggtacgaccgaccgggtcttaaactcgttacgtggtacgacggggtacggtaagggtcgggaacgggtaggggacgtacgtaagtaggtaactacggttaacgacccgttagggacgggtaacccgg

SEQ ID NO: 427261 - DNA, 683 bp, Homo sapiens
  misc_feature: GZ8MTXP02GM7AR.21.76.G10.1.454.CMB.2.raw
  modified_base (273)..(273): a, c, t, g, unknown or other
  modified_base (289)..(289): a, c, t, g, unknown or other
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagtctgggttttccttgttactatttcaaaaggtgtccagtgtgaggtgcagctggtggagacgtgggaggagacttgactaccgaaccggtgggggtccctgagactctctgtgcgtctcgtggtcaccgtnactactactccatgancgtcggccgcgaggctaccggagggacgggctggaggtggtctacgtagtttagtttagtaggtggggtggtggtcgagtagtaacttcggacagtacgtccgggtaggaacggggtcctaagttacccacgtactacccgtaccgaagtacgtaacctaacttacccgaattaacgaacctacgactttacgtacttaccttaaactaaacgtacgaacgtaacgtcgtaagggaccgaacggaaccccgaacggaccaaccggggtcccgtaattaagttaacgttcgggtacggacgggaacggggtacgggtagggaccgggggagggacggtacgtaagtacggtaatttccggttacggaaccgtacgggggtacgggtaaacccggg

SEQ ID NO: 427262 - DNA, 558 bp, Homo sapiens
  misc_feature: GZ8MTXP01D7NF4.45.49.E05.1.454.CMB.2.raw
  modified_base (257)..(257): a, c, t, g, unknown or other
  modified_base (341)..(341): a, c, t, g, unknown or other
  modified_base (469)..(469): a, c, t, g, unknown or other
tcagacgcgatcgacacgaccggtgctcgatttagagcgactagcaacacacaaagggggagaaatttggggaggctctgcttcagctgtggacacaagaggcagcactcaggacaatctccagcatggcctggtctcctctcctcctcactctcctcgctcactgcacagggtcctgggcccagtctgtgctgacgcagccgccctcagtgtcgtggggccccagggcagagggtcaccatctcctgcactgggancagttccaacagtcgggccaggttatgatgtccactggtaccagcaacttccaggaacacgacccccaaactcctaccatttanaagaaacaacaaactccgccccgcaacgggggtcccctagaacccgtacttccgtcccgccctccgaacggtcccggccaccctccacgtccctcctcggtccactcacgtcggccctcaggctgagntgaggctgtattatactgccagttcgtacgaagtatagttcggcgggaggtaactaaacgtcgacccgtcgttaggtccaacgaacccg

SEQ ID NO: 427263 - DNA, 533 bp, Homo sapiens
  misc_feature: GZ8MTXP01BHP0M.45.49.E05.1.454.CMB.2.raw
  modified_base (463)..(463): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtggggggagcttggtccagccgtggggggtccctgagactctcctgtgcagcctctggattccccttagtgactatggatgacctgggtccgccaggctccgaggggaagggggctgggagtggggtggccaagtgagatggggatgggaggtagtgtctaactagtgtggactcgtctgaagggcgattcaccatctccagagacaacgccaagactcactgtatctgcaaatcgaccagcctagagngtcgaggacacgggctggttctacttagtgtgcgccataatcaattccacgttggtaacttcccggtttg

SEQ ID NO: 427264 - DNA, 546 bp, Homo sapiens
  misc_feature: GZ8MTXP01DYMD0.45.49.E05.1.454.CMB.2.raw
  modified_base (335)..(335): a, c, t, g, unknown or other
tcagacgcgatcgacacgaccggtgctcgatttagagcgactagcaacacacaaaggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgcctcagtgtctggggccccagggcagagggtcaccatctcctgcactgggagcagttccaacagtcgggccaggttatgatcgtccactggtaccagcaacttccaggacacgccccaaatcctaccatttanagaaacaacaaactccgccccgcgacggggtccctgacccgtacttcctcccgccctccaacgtccggcaccctcacgccctcctcgtcatcactcggcctcaggcctgaggatgaggtctgtatttatactgcctagttcgtacgaagtagtagttcgggcggacgggtaactaaacgtcgacccgtccgttacggtcgaacgaaccccg

SEQ ID NO: 427265 - DNA, 528 bp, Homo sapiens
  misc_feature: GZ8MTXP01C9BKR.45.49.E05.1.454.CMB.2.raw
  modified_base (406)..(406): a, c, t, g, unknown or other
  modified_base (470)..(470): a, c, t, g, unknown or other
  modified_base (501)..(501): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctatttagaaggtgtccagtgtgaggtgcaactggtggagtcgtgggggaggcttggtccagcctggggggtccctgagactctcctgtgcagcctctggattccccttagtgactattggatgacctgggtccgcaggctccgaggggagggctggagtgggtggccaagtgagatgggatgggaggtagtgtctaactatggtggactctcgtggaaggggccattcaccatcnccagagacaacgcaagaactcactgtatcgtgacaaatcgaaccagcctgagagtccgaggacncgggctgttctacttacgtgtgcgccataanccaatccaccttggaacgttccggttc

SEQ ID NO: 427266 - DNA, 550 bp, Homo sapiens
  misc_feature: GZ8MTXP01BXF9E.45.49.E05.1.454.CMB.2.raw
  modified_base (336)..(336): a, c, t, g, unknown or other
tcagacgcgatcgacacgaccggtgctcgatttagagcgactagcaacacacaaagggggagaaatttggggaggctctgcttcagctgtggacacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagttccaacatcgggccaggttatgatcgtccacgtggtaccagcaacttcgaggacacgccccaaactcctcatttanagaaacacaaactccgcccgcacggggtccctgaccgattcctcccgcctccaacgtcccggacaccctcaccgtccctccctcggtccactcactcggccctcgacggctggagtctggaggtctgtattacgtactcgccagttcgtacgagtacgtagttcgggcgggaggaactaaacgtcgacccgtacttacgggtccaacgaacccg

SEQ ID NO: 427267 - DNA, 532 bp, Homo sapiens
  misc_feature: GZ8MTXP01EQQ7A.45.49.E05.1.454.CMB.2.raw
  modified_base (456)..(456): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggagcttggtccagccgtgggggtccctgagactctcctgtgcagcctctggattccccttagtgactattggatgacctgggtccgccaggctccgagggggaaggggctgggagtggggtggccaacggtgagagtggggatgggaggtagtgtctaactatgtggactctctggaagggcgattcacatctccagagacaacgcaagaactcactgtatcgtgacaaatcgaccngcctgagagtcgaggcacggctgttctacttacgtgtcgcgaccatctcaatccaccgttggtaacgttcccgttg

SEQ ID NO: 427268 - DNA, 551 bp, Homo sapiens
  misc_feature: GZ8MTXP01DO8W2.45.49.E05.1.454.CMB.2.raw
  modified_base (260)..(260): a, c, t, g, unknown or other
  modified_base (286)..(286): a, c, t, g, unknown or other
  modified_base (346)..(346): a, c, t, g, unknown or other
  modified_base (369)..(369): a, c, t, g, unknown or other
  modified_base (391)..(391): a, c, t, g, unknown or other
  modified_base (442)..(442): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcacgccgcctcagtgtcgtcggggccccagggcaggagggtcaccatctcctgcacgtgggancagttccaacagtcgggacaggttangatcgtccactggtaccagctaacttccaaggaaccacgacccccaaatcctacatttanaagaaacaacaaactccgcccgngacggggtccctgaccgattcnccgcctcacgtccgcacctcacgcctcctgcactcactcgctcagctgagntgagtctgtattactactgcctgttacgtcgaaagtacgtaggttacgggcggttaaacgggaaccttaaaacgtcggtacccgtcgttacgggtccgaacgtaacccg

SEQ ID NO: 427269 - DNA, 541 bp, Homo sapiens
  misc_feature: GZ8MTXP01DK92K.45.49.E05.1.454.CMB.2.raw
  modified_base (413)..(413): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtctgggggaggcttggtccagccgtggggggtccctgagactctcctgtgcagcctctggattccccttagtgactattggatgacctgggtccgccaggctccgaggggaaggggctgggagtggggtggccgaacgtgagatggggatgggaggtagtgtctaactatgtggactctctggaaggggccgattcacatcnccagagacaacgccaaagactcactgtatcgtgacaaatcgaccagcctagagagtcgaggacacggctgttctacttacgtgtcgcgaccataactcaatccacgttggtaacgttccggtttaacg

SEQ ID NO: 427270 - DNA, 548 bp, Homo sapiens
  misc_feature: GZ8MTXP01DURH5.45.49.E05.1.454.CMB.2.raw
  modified_base (258)..(258): a, c, t, g, unknown or other
  modified_base (342)..(342): a, c, t, g, unknown or other
  modified_base (391)..(391): a, c, t, g, unknown or other
  modified_base (466)..(466): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctcggggccccagggcaggagggtcaccatctcctgcactgggancagttccaacagtcgggacaggttatgatgtccactggtaccagcaacttccaaggaacacgacccccaaactcctacatttanaagaaacaacaaactccgccccgcgaacggggtccctgacccgattccncccgccctcaacgtccgcacctcacgcctcctgtcactcactcggcctcgaggctgagatgagctgtattatacngcctagttcgtacgaagtatacgttcgggcggttagggaacctaaaacgtcgtacccgtcgttagggtccaacggaaccccg

SEQ ID NO: 427271 - DNA, 681 bp, Homo sapiens
  misc_feature: GZ8MTXP01DS84Y.45.49.E05.1.454.CMB.2.raw
  modified_base (264)..(264): a, c, t, g, unknown or other
  modified_base (373)..(373): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagcccgcctcagtcgtcgtcgggggccccagggcaggacgggtcaccatcctcctgcacgtgggancacgttaccaaacgagtcgggactagggttatgatcgtaccacgtacggtaaccagacctaaaccttccgaacggaaaccaccgacccccaaactcctactaatttaanaaacgaaaaccaaactaaactcccgcccccggtacgtaaccgggggtcccctacggaaccccgtacttcccgccccgtaccctacccgaacggtcccggaccaccctccaccgtccctccgtcgtcactcacgtcggccctcgaggtcctaggagtagtcggacgtctagtaactttacttaccgtcgtaaccgtaggttaccggtaacgttaaagtaacgttacggttaccggggttacgggttaaacggtaaaccgttaaacgtcggtaacccggtaccgttacgggtccgaaccggtaaccccgg

SEQ ID NO: 427272 - DNA, 528 bp, Homo sapiens
  misc_feature: GZ8MTXP01CWO11.45.49.E05.1.454.CMB.2.raw
  modified_base (254)..(254): a, c, t, g, unknown or other
  modified_base (280)..(280): a, c, t, g, unknown or other
  modified_base (329)..(329): a, c, t, g, unknown or other
  modified_base (352)..(352): a, c, t, g, unknown or other
  modified_base (448)..(448): a, c, t, g, unknown or other
tcagacgcgatcgacacgaccggtgctcgatttagagcgactagcaacacacaaaggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcaccatctcctgcactgggancagttccaacagtcgggccaggttangatgtccatggtaccagcaacttcagacagcccccaaatcctcatttanagaaacaacaaactccgccccgngacggggtccctgaccgattccacccgcctccaacgtccgcacctcacgcctcctgtcatcactcgcctcaggctgacgatgagctgtattatacngccagttcgtacgaagtagtagttcgggcgaagggaactaaaacgtcggaacccgtccgttaacggtccgaacgaacccg

SEQ ID NO: 427273 - DNA, 570 bp, Homo sapiens
  misc_feature: GZ8MTXP01CY79W.45.49.E05.1.454.CMB.2.raw
  modified_base (511)..(511): a, c, t, g, unknown or other
  modified_base (570)..(570): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaggtgtcagtgtgaggtgcaactggtggagtcgtgggggaggcttggtccagccgtggggggtccctgagactctcctgtgcagcctctggtacttccccttagtgactagttggatgaccgtgggtccgccaggcctccgagggggagggggctgggaggtgggggtggaccgaaggtgagagtggggatgggaggtagtgtctaacttatgtgggtactctcgtaggaacgggggcctattccaaccattcctaccagacgaacaacgaccaaagactcactgtatcgtacgacaaaatcggaaccagcctaggaagacgtcggaggacncgggtctgttctacttacgtgcgccgacattaatcaattccacgttggtcttccggttn

SEQ ID NO: 427274 - DNA, 600 bp, Homo sapiens
  misc_feature: GZ8MTXP01B4M4Q.45.49.E05.1.454.CMB.2.raw
  modified_base (351)..(351): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggagcttggtccaggccgtggggggtccctgagactctcctgtgcagcctctggacttccccttagtgactatggatgacctgggtccgccaggctccgaggggaggggctgggagtgggtggccaagtgagngtgggagtgggaggtagtgtctaactatggtggtactctcgtggaacgggccgattccacatctcagagacaacgaccaagactcactagtactctagacaaatcgacctagcctaggagacggtcggaaggaccgaacgggtcttcggttacctaaccgttacgtcggtacgttcccggttaaacccttagttaactacctaacttcccgtaaccccgttggggtaaccggtttcccggttttaaccg

SEQ ID NO: 427275 - DNA, 562 bp, Homo sapiens
  misc_feature: GZ8MTXP01AFG3V.45.49.E05.1.454.CMB.2.raw
  modified_base (310)..(310): a, c, t, g, unknown or other
  modified_base (481)..(481): a, c, t, g, unknown or other
  modified_base (502)..(502): a, c, t, g, unknown or other
  modified_base (508)..(508): a, c, t, g, unknown or other
  modified_base (534)..(534): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaggtgtccagtgtgaggtgcaactggtggagtcgtgggggaggcttggtccagccgtggggggtccctgagactctcctgtgcagccctcgtggattcccccttagtgacttattggatgacctgggtccnccaggctccgaggggaaggggctgggaggtgggtggccaacggtgagagtgggatgggaggtagtgtctaatatggtggactcgtcgtggaaggggccgtattccgacctagtcctacgagagaaccgaacgccaaaggaacctcaacttgtatctggacaaatcgaaccngcctagagagtcgaggtaccncgggtntcgttctacttacgtgtgccgacatntcaatccacgttgtaacgttcccgtttg

SEQ ID NO: 427276 - DNA, 673 bp, Homo sapiens
  misc_feature: GZ8MTXP01AVNTR.45.49.E05.1.454.CMB.2.raw
  modified_base (257)..(257): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggcccagggcagagggtcaccatctcctgcactgggancagttccaacagtcgggcctaggttatggactcgtccacgtcggtaccagaccaaccttccgaacggaaccaccgacccccaaactccgtacctaatttacaacgaaaccaacaaactcccgcccgacgacggggtccctacggaccgtacttccgtacccgcctaccgaaacggttcccggacctacccgtccgaacggtccccttcccgtacgggttaccacttccgaaccgttccgggaccccttaccggacgggtccgttacgggaacgggtacgtcgggacggtaccgttaggtaactttacgttaccgtcgaaccgtaggttaccggtacgaaacgtacgtacggttccgggcgggaacgggtaacctaaacggtcggtaacccgtcgttacggtccgaacgtaacccgg

SEQ ID NO: 427277 - DNA, 529 bp, Homo sapiens
  misc_feature: GZ8MTXP01A0IKA.45.49.E05.1.454.CMB.2.raw
  modified_base (454)..(454): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctatttagaaggtgtccagtgtgaggtgcaactggtggagtctgggggagcttggtccagccgtggggggtccctgagactctcctgtgcagcctctggattccccttagtgactatggatgaccgtgggtccgccaggctccgagggagggggctgggagtgggtggccaacgtgagatggggatggaggtagtgtctaactatgtggactctctgagggcattcacatctccagagacaacgcaagaactcaactgtatctgcaaatgaccagcctagacgngtcgaggacgcggctgttctacacctggtcgacgttaccagtaatcaactcgacccttgggtaacgttccgttcg

SEQ ID NO: 427278 - DNA, 861 bp, Homo sapiens
  misc_feature: GZ8MTXP01B2KPZ.45.49.E05.1.454.CMB.2.raw
  modified_base (290)..(290): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcacgccgcctcagtgtcgtcggggccccagggcaggagggtcaccatctcctgcacgtgggagcacgttccaacacgtccggacctaggttangatcgtaccacgtacggtaaccacggtacctaaaccgtttccgaacggaaaccctaacccgaaccccccctaaaacttcccccttaaaccttaaactttttaaaacgaaaacggtaaaaaaccctaaacccgtaaaaaaccgttacccccgggaaccccccgggtaccgggttaaacccggggggttaccccccttaacggggtaacccccggttaaccgtttcccccgtacccccggtacccccgttacccgtaaaacccggggttcccccggaccctaaccccgttacccgtaaccccggttcccccgttaccccgttaccggggtaccctaccgttacccctaaccgttccccgggaccccgttacccggaacggggtaccgttacgggaaacgggtacgttaccggacggttaccgtagttaacgttttaacttaccgtcgtaaccgtaacgggttccggtaacggaaagtacgttacggttaccgggggttacggggttaacggtaaccgttaaacggtccgttaacccggttaccgttacgggttaaccgaaccggtaaccccgg

SEQ ID NO: 427279 - DNA, 729 bp, Homo sapiens
  misc_feature: GZ8MTXP01DSYJO.45.49.E05.1.454.CMB.2.raw
  modified_base (260)..(260): a, c, t, g, unknown or other
  modified_base (271)..(271): a, c, t, g, unknown or other
  modified_base (287)..(287): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagcccgcctcagtgtcgtcggggccccagggcaggagggtcaccatctcctgcacgtgggancagttccaaangtcgggactaggttangatcgtccacgtcggtaccagcctaaaccttccgaaggaaccaccgacccccaaatccctacctaatttaacaacgaaaaccaactaaaccgtcccgccccggtacgtacccgggggttccccttacggaaccccgttatttccccgtacccgtccctacccgtaacggttccccggaccaccccttcgaaccggtccccttcccgtcggtccactacccgtaccgtcccgggtacccttacccggaaggtcccgtagggaacggtacgtgggtaaccgggtacttacggttaattttaaccgtaccgttcggtaacccgttaacgggttacccggtaacggttaaaggtaacgttacgggttacggggaccgggttaaacgggtaaccgttaaaacgtccggttaacccgtccggttacggtcccgaaccggtaaccccgg

SEQ ID NO: 427280 - DNA, 530 bp, Homo sapiens
  misc_feature: GZ8MTXP01DWN0P.45.49.E05.1.454.CMB.2.raw
  modified_base (242)..(242): a, c, t, g, unknown or other
  modified_base (254)..(254): a, c, t, g, unknown or other
  modified_base (278)..(278): a, c, t, g, unknown or other
  modified_base (331)..(331): a, c, t, g, unknown or other
  modified_base (409)..(409): a, c, t, g, unknown or other
  modified_base (446)..(446): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgcctcagtgtcgtgggccccagggcagagggtcaccatcnctgcactgggancagttccaacatcggacaggttangatgtccactggtaccagcaacttcaggacacgccccaaactcctacatttanagaaaactaacaaactccgccccgcgaacggggtccccagacccgattcgtcccgcctaccaacgtcccggcaccctnacgcctacctgtcatcactcgcctcaggctgacgagngagctgtattatctcgaactgttcgtacgaagtagtacgttcggcgacggtaactaacgtcgaccgtcgacgtcgaacgaaccg

SEQ ID NO: 427281 - DNA, 580 bp, Homo sapiens
  misc_feature: GZ8MTXP01AVLR6.45.49.E05.1.454.CMB.2.raw
  modified_base (261)..(261): a, c, t, g, unknown or other
  modified_base (353)..(353): a, c, t, g, unknown or other
  modified_base (481)..(481): a, c, t, g, unknown or other
  modified_base (483)..(483): a, c, t, g, unknown or other
tcagacgcgatcgacacgaccggtgctcgatttagagcgactagcaacacacaaagggggagaaatttggggaggctctgcttcagctgtggacacaagaggcagcactcaggacaatctccagcatggcctggtctcctctcctcctcactctcctcgctcactgcacagggtcctgggcccagtctgtgctgacgcagcccgccctcagtgtcgtgggggccccagggcaggagggtcaccatctcctgcacgtgggancagttccaaacagtcgggcctaggttatgatcgtccactggtaccagcaaccttccgaaggaaccacgacccccaaactcctacctatttanaacgaaacaacaaactcccgccccgacgacggggtccctacgaccgtattcctcccgccctaccgaacgtccggccaccgtccacgccctacccgtgtaccactccacgtcggcctcgaggctgaggngnggagtctagtattactcgtgaactagttcgacgaagtactacggttcgggcggaacggtaactaacggtcgaccgtcgttacgtccgaacgaacccg

SEQ ID NO: 427282 - DNA, 540 bp, Homo sapiens
  misc_feature: GZ8MTXP01ASMAW.45.49.E05.1.454.CMB.2.raw
  modified_base (507)..(507): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtctgggggagcttggtccagccgtgggggtccctgagactctcctgtgcagcctctggattcccctagtgactattggatgacctgggtccgccaggctccgaggggaaggggctgggagtgggtggccaagtgagagtggggatgggagtagtgtctaactatgtggactctcgtgaagggcattcacatctccagagacaacgccaagactcactgtatcgtagccaaatcgaacccagccctaggagagtccggagaccgacgggctggttacctacttacgtgtcgcgaccntaatcaattcaaccgttggtaacgttcccgttg

SEQ ID NO: 427283 - DNA, 629 bp, Homo sapiens
  misc_feature: GZ8MTXP01BPFT3.45.49.E05.1.454.CMB.2.raw
  modified_base (268)..(268): a, c, t, g, unknown or other
  modified_base (317)..(317): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgaccttgggttttccttgttgcttattttagaaggtgtccagtgtgaggtgcaatggtggagttcgtgggggaggtcgttggtccaggccgtggggggtccctgagtactctcctgtncagcctctggtactttccccttagtgacttatggatgaccgtgggtccnccgaggctccgaggggaggggctgggagtggggtgccaagtgagagtgggactgggaggtagtgtactaacgtagttggtggtaccttcgtcgtagggaacggggccgtattccaccgtactcctacgaaagacgaaaccaaccgacccaaagtaacctcacttagtactccgtgaactaaaatcggacccacgtcctaggaaggacgtaccggaaggtaccacgggcttcggttactaaccttcgtacgtcgacccgttacttattcttacaacgttcccgaccgttcgggtaacgtttccccgtttaagg

SEQ ID NO: 427284 - DNA, 571 bp, Homo sapiens
  misc_feature: GZ8MTXP01BP4JV.45.49.E05.1.454.CMB.2.raw
  modified_base (497)..(497): a, c, t, g, unknown or other
  modified_base (536)..(536): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggtttcctgttgctatttagaggtgtccagtgtgaggtgcaactggtggagtcgtgggggaggcttggtccagccgtggggggtccctgagactctcctgtgcagcctctggtacttccccttagtgacttagttggatgaccgtgggtccgccgaggcctccgagggggaaggggctgggaggtgggtggccgaagtgagagtggggatggggaggtagtgtctaactagtggtggactcgtcgtgggaacgggggtccaattccacctatcctaccagaacgaaccaacgccaaagacctcaactgtatcgtgactaaatcgaaccagccgtagaacgnggtacgaggacacggctgttctacttacgtgtcgcgacntaactcaactcaccgttgggtaacgttcgttaacg

SEQ ID NO: 427285 - DNA, 618 bp, Homo sapiens
  misc_feature: GZ8MTXP01BF8NT.45.49.E05.1.454.CMB.2.raw
  modified_base (310)..(310): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggagtcttggtccaggccgtgggggtccctgagactctctgtgcagcctgtggtacttccccttagtgacttagtggatgaccgtgggtccncgaggctccgaggggaggggctgggagtgggtcggccagtgagagtgggatgggaggtagtgtcttaacgtagtggtggtaccttcgtcgtagggaacggggcctacgttccacctaagttccaccgaagacgaaaccaaccggaccaaagaacctcaactgtactcgtagactaaatcgaacctgccgtaggaacggtacggtaccggaacggtaccgaccgggtcttacggttcctacttacgtcggtcgacccgttaccttaatcctactaactccgaaccgttgggtaacgtttcccgtttaag

SEQ ID NO: 427286 - DNA, 585 bp, Homo sapiens
  misc_feature: GZ8MTXP01CLW46.45.49.E05.1.454.CMB.2.raw
  modified_base (310)..(310): a, c, t, g, unknown or other
  modified_base (355)..(355): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtggggggaggcttggtccaggccgtggggggtccctgagactctcctgtgcagcctctggacttccccttagtgactatggatgacctgggtcccnccaggctccgaggggaggggctgggagtgggtggccaaggtgagngtgggatgggaggtagtgtctaactagtgtgggacctcgtcgtggaacggggccgtattccgacctatccgtaccaaggacgaacaaccgccaaagaacctcactgtatcgtgactaaatcgaccagcctaggacgagtcgaggtacacggtctcggttcctaacttacgtgtcggaccgacccttattaactctaacttccgaccgttgggtaaccgttccgtttaacg

SEQ ID NO: 427287 - DNA, 537 bp, Homo sapiens
  misc_feature: GZ8MTXP01BKPBN.45.49.E05.1.454.CMB.2.raw
  modified_base (411)..(411): a, c, t, g, unknown or other
  modified_base (463)..(463): a, c, t, g, unknown or other
  modified_base (474)..(474): a, c, t, g, unknown or other
  modified_base (537)..(537): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtctgggggaggcttggtccagccgtggggggtccctgagactctcctgtgcagcctctggattccccttagtgactatggatgacctgggtcccgcaggctccgaggggaaggggctggaggtgggtggccaacggtgagagtggggatgggaggtagtgtctaactatgtggactcgtctggaagggcgattcacatcnccagagacaacgccaaagactcactgtatcgtgacaaatcgacagcctgagngtcgaggaccncggctgttctacttacgtgtcgcgttaccataatcaattccaccttgggtaacttcccggttn

SEQ ID NO: 427288 - DNA, 823 bp, Homo sapiens
  misc_feature: GZ8MTXP01CHY7X.45.49.E05.1.454.CMB.2.raw
  modified_base (259)..(259): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgcctcagtgtcgtcggggccccagggcaggagggtcaccatctcctgcacgtggganctacgttaccaacagtcggactaggttatgatcgtacctacgtacggtaccaggtacctaaccgtttaccgaacgggtaaacccaaccggtaaccccccctaaaaccttccccttaccctaaactttttaaacgaaaacggtaaaaaccctaaaccgtaaaaaacccgttcccccgggtaaccccccggaccggtaaacccggggggtcccccttacgggaacccccgtaaccgtttcccgtacccccggtaccccttaccccgtaaaccgggttccccgggaccctaaccccgtacccgaacccgttcccccgttaccccgttcgggttacccaaccgttcccgtaaccgttccggggtccccgttaccgtaaccggggtcccgttagggacgggtaaacgtcgggtaacggtccgttaggttaactttacgttaccgttcgaacccgttacggttccgttaacggaaacgttacgttacgggttccggggaacgggttacggggttaacctaaacggtccggtaacccggttccggttaacggtccgaaccggtaaccccgg

SEQ ID NO: 427289 - DNA, 594 bp, Homo sapiens
  misc_feature: GZ8MTXP01DHXDN.45.49.E05.1.454.CMB.2.raw
  modified_base (351)..(351): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctatttagaaggtgtccagtgtgaggtgcaactggtggagtcgtggggggaggcttggtccagccgtggggggtccctgagctctcctgtgcagcctctggtacttccccttagtgactattggatgaccgtgggtccgcaggctccgaggggagggctgggagtgggtgccaacgtgagngtgggatgggagtgtgtctaactatgtgactctcgtaggaacggggtccgattccacctatcctaccgaagagaaccaacgaccaaagaactcactgtactcgtagactaaatcgaccagcctaggaacgacggtacggaacgggacgacgggtcttacggttcctaaacgttacgtggtcgaccgaaccttacttaactacaacttccacccggttagggtaaccgtttaacccgggtttcg

SEQ ID NO: 427290 - DNA, 680 bp, Homo sapiens
  misc_feature: GZ8MTXP01CO3U7.45.49.E05.1.454.CMB.2.raw
  modified_base (359)..(359): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaggtgtccagtgtgaggtgcaactggtggaggtcgtgggggaggcttggtccaggccgtggggggtcccctgagactctcctgtgcagcctctggacttccccttagtgactagttggatgacctgggtccgccaggcctccgagggggagggcgtgggaggtgggtggccgaagtgagngtgggatggggaggttgtgtctaacttagtggtgggtaccttcgtcgtggaacgggggtccgtatttcccgacctatcctacccgaaaggacgaacccaaaccgggacccaaaaggaacccttcaaccgttaggtaacttccggtaggaacctaaacgttaccgggaacccgtaaccggccgtttacggggaaacggtacgggttaaccgggagggaaccccgaaccggggtccttacgggttcctaaaccgttacgtcggtcgaacccgccttaattaactcaacttcccgtaccgttggggtaaccgttccgtttaacg

SEQ ID NO: 427291 - DNA, 576 bp, Homo sapiens
  misc_feature: GZ8MTXP01ASMCT.45.49.E05.1.454.CMB.2.raw
  modified_base (304)..(304): a, c, t, g, unknown or other
  modified_base (546)..(546): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccagccgtgggggtccctgagactctcctgtgcagcctctggattcccctagtgactatggatgacctgggtccnccaggctccgaggggaggggctgggagtggggtcggccaacggtgagagtggggatgggaggtagtgtctaactagtgtgggactgtctaggaacggggccgtattccaccatcctcccaagacgaaccaaccgaccaaacgaactccactagtatcgtaggacaaatcggaacccagccctaggagtacggtacggacggacgacgggctcggttctacgttacgtgtcgacgaccataancaatccacgttgggtaacgttcccgttaag

SEQ ID NO: 427292 - DNA, 600 bp, Homo sapiens
  misc_feature: GZ8MTXP01CGWJU.45.49.E05.1.454.CMB.2.raw
  modified_base (302)..(302): a, c, t, g, unknown or other
  modified_base (361)..(361): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggtttccttgttgctatttagaaggtgtccagtgtgaggtgcaactggtggagtcgtgggggaggcttggtccagccgtggggggtccctgagactctcctgtgcagctctggattcccctagtgactatggatgacctgggtccncaggctccgaggggaggggctggagtgggtggccaacggtgagatgggatggaggtagngtctaactatgtgggactctcgtggaacggggccgtattcaccatctccaagagacaacgaccaaagaactcaactgtactgtagacaaatcggaacccagacccgtaggaacggagtccggacggaacgccgggcttcggttccgtaaaccttccgttaggttcggacccggaacccttataataccctaacttccccgtaaccgttcggggttaaccggttcccgggtttttaaccg

SEQ ID NO: 427293 - DNA, 616 bp, Homo sapiens
  misc_feature: GZ8MTXP01DYDO7.45.49.E05.1.454.CMB.2.raw
  modified_base (181)..(181): a, c, t, g, unknown or other
  modified_base (261)..(261): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggtttcctgttgctatttagaggtntccagtgtgaggtgcaacgtggtggagtcgtggggggagcttggtccaggccgtggggggtccctgagactctcctggtncagcctctggattcccctagtgactatggatgacctgggtccgcaggctccgaggggaaggggctgggaggtgggggtcgccgaaggtgagagtggggatgggaggttacgtggtctaaactagtggtagggacttcgtcgtagggacgggggcctattccaacctatcctacccgaagacggaaacaaccgacaaacgaacttcaactagtactcgtacgactaaactagacccgagccgtaggaacgaggtacggaacgggaccacgggtaacttggttactacgttaacgtggttacggccgaccttaataactactaacgtacgacccgttggtaacgttccccgtttaag

SEQ ID NO: 427294 - DNA, 683 bp, Homo sapiens
  misc_feature: GZ8MTXP01DH22K.45.49.E05.1.454.CMB.2.raw
  modified_base (503)..(503): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacgagggtcctgggcccagtctgtgcttacgcacgcccgcctcgagtcgtcgtcgggggccccagggcaggagggtcaccatctcctgcacgtgggacgctacgtaccaaacgacgtccgggacctaggttatgtatcgtccacgtcggtaacccagacctaaccttccgaagaaccacccgaccccctaaactcctaactaactttaacgaaacaaaaccaacgtaactccccggaccccgaacgtaccgggggtcccacgacccgtacttccccgacccgacctacccgaacgtccccggaccaacctccaaccgtccctcccgtgtaccaccnccgacgtcgcccgtacgggacgcgtaggaggtactggtacgtcttagttaacttacgttacgcgtcgtaacgttacggaacgtaagttacgttaacgggtacgggaaccggttaacggttaaccgttaaccggtcccgtaaccggtccgtacggttaccgaaccgttaacccgtaaccgg

SEQ ID NO: 427295 - DNA, 616 bp, Homo sapiens
  misc_feature: GZ8MTXP01ENP7L.45.49.E05.1.454.CMB.2.raw
  modified_base (274)..(274): a, c, t, g, unknown or other
  modified_base (313)..(313): a, c, t, g, unknown or other
  modified_base (361)..(361): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgaccttgggttttccttgttgcttattttagaaggtgtcagtgtgaggtgcaacgtgggtggagtcgtggggggaggtcttggtccaggccgtggggggtccctgagactctctgtgcagcctntggacttccccttagtgacttatggatgacctgggtccncaggctccgaggggaaggggctgggaggtggggtgccgaacggtgagngtggggatggggaggtagtgtctaactatggtgacttctcgtaggaacgggccgtattccactatctccagacaaccaacgaccaagaactcactagtactcgtagaactaaagtcgaaccagcctagggaaggtacggtacggaacgggaccgaacggggtcttcggttaccttaaccgttacgtaggttccgacggttaacccttagttaactacaacttcccgaaccgttgggttaaccgttccgtttaacg

SEQ ID NO: 427296 - DNA, 627 bp, Homo sapiens
  misc_feature: GZ8MTXP01DOXUB.45.49.E05.1.454.CMB.2.raw
  modified_base (266)..(266): a, c, t, g, unknown or other
  modified_base (276)..(276): a, c, t, g, unknown or other
  modified_base (290)..(290): a, c, t, g, unknown or other
  modified_base (357)..(357): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacaggggtcctgggcccagtctgtgctgacgcagcccgccctgagtgtccgtcgggggccccaggggcaggagggtccaccatctcctgcacgtgggancagttccaangtcggctaggttangatcgaccacgtaggtacacgactaactccgaaggaccaccgaccccaaactccttactaatttaanaacgaaaccaactaaacctcccgccccgacgtaccggggtccctacgaccgtacttccgcccgaccctaccgaacggtcccgaccaccctcaccgtccctaccgtcgtacactccacgtccggccctacgagggtctaggagagtggaggtcttaggtaactttacgtaccgtcgaacctacggttcgtaacgaaagtacgttacggttaccgggacgggttaacggtaactaacgtccgtaacccgtcgttacgtccgaacgaaccccg

SEQ ID NO: 427297 - DNA, 542 bp, Homo sapiens
  misc_feature: GZ8MTXP01EARYC.45.49.E05.1.454.CMB.2.raw
  modified_base (410)..(410): a, c, t, g, unknown or other
  modified_base (465)..(465): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattgggctgacctgggtttccttgttgctattttagaaggtgtccactgtgaggtgcaactggtggagtcgtggggggagcttggtccagccgtggggggtccctgagactctcctgtgcagcctctggattccccttagtgacttatggatgaccgtgggtccgccaggctccgaggggaagggctgggagtgggtggccaacgtgagagtggggatgggaggtagtgtctaactatgtgggactctctggaagggcgattcacatcncagagaacaacgaccaagactcactgtatcgtgacaaatcgaaccagcctgaagngtcggaggaccgcggaactgttctacttacgtgtgccgacataatcaatccaccgttggtaacgttccggtttaacg

SEQ ID NO: 427298 - DNA, 626 bp, Homo sapiens
  misc_feature: GZ8MTXP01CXYIX.45.49.E05.1.454.CMB.2.raw
  modified_base (598)..(598): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtggggggagcttggtccagccgtggggggtccctgagactctctgtgcagcctctggacttccccttagtgacttattggatcgacctgggtccgccgaggctccgagggggaagggggctgggagtgggggtggaccgagtgagagtggggatgggaggtagtgtctaacgttagtggtgtacctcgttcgagggaacggggtccgtacttaccaacccgtacttccaccgaaggaacgaaaccgaacccgaaccaaaacgtaacctacaacgttacgtaactcgtagaactaaagtccgaaccacgtccgttagggaacggtggtaccgggacggaaaccgtcgggtaactcggttactacttaccgtagcgacgacataancgaatcacgttggtaacgttccgttaag

SEQ ID NO: 427299 - DNA, 721 bp, Homo sapiens
  misc_feature: GZ8MTXP01AJMJM.45.49.E05.1.454.CMB.2.raw
  modified_base (208)..(208): a, c, t, g, unknown or other
  modified_base (260)..(260): a, c, t, g, unknown or other
  modified_base (270)..(270): a, c, t, g, unknown or other
  modified_base (286)..(286): a, c, t, g, unknown or other
  modified_base (351)..(351): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctnagtgtcgtcggggccccagggcaggagggtcaccatctcctgcacgtgggancagttccaanagtcgggccaggttangatcgtccactcggtaccagcctaacttccgaaggaccacgacccccaaactcctactaatttanaacgaaaccaacaaactcccgccccgacgacgggggtcccctacggacccgtacttccctcccgacccttaccgaaaccggttcccggacctaacccttccgaaccggtccccttcccgttcggtaccaaccttccgaaccgttccgggccccttcccggaacgggtcccgttagggaacgggtaaccgtgggaacgggtacccgtttaggtaaacgttttaacgttaccgttcggaaccccgttaagggttacccggtacggttaaaggttaaacgttacggtttacccggggacgggttaacggggtaacccttaaacggtccggtaacccgttaccggttacggttaacccgaacggtaaccccggg

SEQ ID NO: 427300 - DNA, 595 bp, Homo sapiens
  misc_feature: GZ8MTXP01BP2W0.45.49.E05.1.454.CMB.2.raw
  modified_base (209)..(209): a, c, t, g, unknown or other
  modified_base (401)..(401): a, c, t, g, unknown or other
  modified_base (417)..(417): a, c, t, g, unknown or other
  modified_base (438)..(438): a, c, t, g, unknown or other
  modified_base (443)..(443): a, c, t, g, unknown or other
  modified_base (448)..(448): a, c, t, g, unknown or other
  modified_base (496)..(496): a, c, t, g, unknown or other
  modified_base (520)..(520): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacgagggtcctggggcccagtctgtgctgacgcagccgcctnagtcgtcgtcggggccccagggcaggacgggtcacctatctcctgcacgtgggagcacgttaccaacagtccgggataggttatgacttcgtccacgtcggtaaccacgtactaacttccgaaggaccaccgaccccctaaactcctactattaataacgaaacaacaactccgcccgacgaccgggtcccngaccgtactcgtcccncctacgacgtccgcactcacncctcngcacncacgtcgcctcgaggtcaggcgtatggagtcgtgtaattacgttacgngaaccgtagttccgtaagaacgtnttaacgggttaccggggcggaaaccggtaactaacgtcgtaccggtaccgttaggtaaccgaaccgtaacccggg

SEQ ID NO: 427301 - DNA, 555 bp, Homo sapiens
  misc_feature: GZ8MTXP01AKEP1.45.49.E05.1.454.CMB.2.raw
  modified_base (308)..(308): a, c, t, g, unknown or other
  modified_base (337)..(337): a, c, t, g, unknown or other
  modified_base (348)..(348): a, c, t, g, unknown or other
  modified_base (460)..(460): a, c, t, g, unknown or other
  modified_base (490)..(490): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtggggggagcttggtccagccgtggggggtccctgagactctcctgtgcagcctctggacttccccttagtgactattggatgacctgggtccncaggctccgagggagggctgggagtgggnggccagtgagngtggggatgggaggtagtgtctaactatggtggactctcgtggaaggggctattcacatctacagacgacaacgcaagaacctcaactgtactcgtgaccaaatcggaaccngcctaggaagacggtcggaaggaccgcggntcgttctacttacgtgtcgccgacttataagtcaactccaccgttggtaacgttcccgtttaacg

SEQ ID NO: 427302 - DNA, 578 bp, Homo sapiens
  misc_feature: GZ8MTXP01ANACO.45.49.E05.1.454.CMB.2.raw
  modified_base (266)..(266): a, c, t, g, unknown or other
  modified_base (305)..(305): a, c, t, g, unknown or other
  modified_base (372)..(372): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggtttccttgttgctatttagaagtgtccagtgtgaggtgcaacgtggtggagtcgtgggggagcttggtccagccgtgggggtccctgagactctcctgtgcagccctntggacttccccttagtgactattggatgacctgggtccncaggctcgagggagggctggagtgggtgccaagtgagagtggatgggaggtgtgtctaacgtatggngtactctcgtaggaacggggcctattccacctattccaccgagacgaaccgacgactaacgaactcaactgtactcgtacgacaactacggaccagccgtagacgacgtacggaggcaacgggtctcggttctaaaccgttgtcggtcgccgaccttacttaactaccgtaactaccgacccggttgggtaaccgttcccgtttcg

SEQ ID NO: 427303 - DNA, 538 bp, Homo sapiens
  misc_feature: GZ8MTXP01C7YS4.45.49.E05.1.454.CMB.2.raw
  modified_base (352)..(352): a, c, t, g, unknown or other
  modified_base (463)..(463): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccagccgtggggggtccctgagactctcctgtgcagcctctggacttccccttagtgacttatggatgaccgtggtccgcaggctccgaggggaggggctgggagtgggtggccgacgtgagngtgggatgggaggtagtgtctaactatgtggactctcgtgaagggcgattcacctatctccagacgacaacgcaaagactcactgtatctgacaaatcgaccagcctgagngtcgaggacacgggctgttctacgttacgtgtcgacgccattcactaatccacgttggtaacgttccgtttaacg

SEQ ID NO: 427304 - DNA, 544 bp, Homo sapiens
  misc_feature: GZ8MTXP01BUUZP.45.49.E05.1.454.CMB.2.raw
  modified_base (312)..(312): a, c, t, g, unknown or other
  modified_base (356)..(356): a, c, t, g, unknown or other
  modified_base (473)..(473): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgaccttgggttttccttgttgctattttagaaggtgtccagtgtgaggtgcaacgtggtggagtcgtgggggaggcttggtccagccgtggggggtccctgagactctcctgtgcagcctctggacttccccttagtgacttattggatgacctgggtcccncaggctccgaggggaagggctgggagtgggtggccaacgtgagngtgggatgggagtgtgtctaactatgtggactctctggaacggggcctattccacgtatcctcagagaccaacgcaaagaactcaactgtatcgtgacaaatcgaccagcctagagngtcgagcacggctgttcctacttcgtgtcacgcagtaactcaacttccacgttggtaacgttccgttaacg

SEQ ID NO: 427305 - DNA, 568 bp, Homo sapiens
  misc_feature: GZ8MTXP01CZLVX.45.49.E05.1.454.CMB.2.raw
  modified_base (360)..(360): a, c, t, g, unknown or other
  modified_base (398)..(398): a, c, t, g, unknown or other
  modified_base (474)..(474): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgaccttgggttttccttgttgctattttagaaggtgtccagtgtgaggtgcaacgtggtggagtcgtgggggaggcttggtccagccgtggggggtccctgagactctcctgtgcagcctctggtacttccccttagtgactattggatgaccgtgggtcccgccaggctccgaggggaaggggctgggaggtgggtggccaaggtgagntggggatgggaggtgtgtctaactatgtgtactctcgngacgggcgattccacatctccagacaacaacgacaagactcactgtactcgtagacaaatcgaaccagcctgaagngtcgaggacacgggtctcgttactacgttacgtggtcgaccgaccttataactctaacttccgacccgttagggtaaccgttccggttttaacg

SEQ ID NO: 427306 - DNA, 737 bp, Homo sapiens
  misc_feature: GZ8MTXP01ANDUJ.45.49.E05.1.454.CMB.2.raw
  modified_base (209)..(209): a, c, t, g, unknown or other
  modified_base (244)..(244): a, c, t, g, unknown or other
  modified_base (259)..(259): a, c, t, g, unknown or other
  modified_base (271)..(271): a, c, t, g, unknown or other
  modified_base (291)..(291): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacgagggtcctgggcccagtctgtgctgacgcacgccgcctnagtcgtcgtcggggcccagggcaggcggtcacctntctctgcacgtgganctacgttccaancggtccggaccgtaggttangactcgtacccactcgggtaccagacctaaccttaccgaacgggtaacccaacccggaccccctaaacgtcccttaacctaaacttttacaaaacgaaaaacctaaaccgtaaacccgttccccggaacccccggtaccggtaacccgggggttacccctaacgggtaccccggtacctttaccccgtacccccggtaccccttacccgtaaaccggttccccgggaccctacccgtaccgacccggtccccttcccgtacggtaccaccgtccgaacgttcccggtacccgtacggtacggccgttagggacggtacgtgggacggttaccgtgttaactttactaccgtgtaaccgtggttacgtacggaagttacgtacgttccggggacggttaacggtaaccaacgtcggtaccgttcgacgggtaaccttcggaacccgg

SEQ ID NO: 427307 - DNA, 624 bp, Homo sapiens
  misc_feature: GZ8MTXP01A9KO6.45.49.E05.1.454.CMB.2.raw
  modified_base (208)..(208): a, c, t, g, unknown or other
  modified_base (262)..(262): a, c, t, g, unknown or other
  modified_base (499)..(499): a, c, t, g, unknown or other
  modified_base (523)..(523): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacaggtcctgggcccagtctgtgctgacgcacgccgccctnagtcgtcgtcgggggccccagggcaggagggtcaccatctcctgcacgtgggancacgttaccaacgagtccgggcctagggttatgatcgtccacgtcggtaccagcctaacttccgaaggaaccaccgacccccctaaatcctacctaatttaagacaaaaccacaaacgtcccgccccgcgaacggggtccctagacccgtatccgtcccgccctacgacgtcccggacacctcacgtccctaccgtcggccactcacttcggccctcgacggtcctaggaacggtgnggagtcgtgtaattacgttaccgngtaacccgtaaggttccgtacggaaagtagtacgttcggggcgggttaacgggtaactaaacgtcggtaccgtacccgttggtaaccaacggtaaccccgg

SEQ ID NO: 427308 - DNA, 621 bp, Homo sapiens
  misc_feature: GZ8MTXP01C0US1.45.49.E05.1.454.CMB.2.raw
  modified_base (358)..(358): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaatggtggagtcgtgggggagcgttggtccaggccgtggggggtccctgagactctcctgtgcagcctctggacttccccttagtgtactattggatgaccgtgggtcccgccaggctccgagggggaagggcgtgggaggtgggtggccaagtgagngtgggatgggaggtgtgtctaactatggtgactctcgtagaacgggccgattccacatctacagagacaacgccaaagaactcgactagtactcgtacgactaaagtcgaacccaacggccctaggaacgtacggtaccggaacgggaaccaacggggtcttacggttacctaaccttacgttacggtcgacccggttaccttaacttaacttcccaagttcccgtaaccggttcgggtaacccgtttcccggttttaaccgg

SEQ ID NO: 427309 - DNA, 580 bp, Homo sapiens
  misc_feature: GZ8MTXP01AHQF0.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctatttagaaggtgtccagtgtgaggtgcaactggtggagtcgtgggggagcttggtccagccgtggggggtccctgagactctcctgtgcagcctctggattcccctagtgactatggatgacctgggtccgccaggctccgagggagggctgggagtgggtgccaacggtgagagtgggactgggaggtagtgtctaactagtggtggactcgtcgtaggaacggggcccagttccaacctatccgtaccagagaccaaaccggcctaaagaactcgaactgtaactcgtagacaaagtcgaacccaggccctagacgacggtccggaaggacccacgggtctcggttcctacgttacgtcgtgcgaccattaactcaattccgacttcggggtaacttccggtttcg

SEQ ID NO: 427310 - DNA, 610 bp, Homo sapiens
  misc_feature: GZ8MTXP01AH4JS.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttcctgttgctattttagaggtgtccagtgtgaggtgcaacgtggtggagtcgtgggggagcttggtccagccgtggggggtccctgagactctcctgtgcagcctctggacttcccccttagtgtacttagttggatcgaccgtcgggtcccgccgacggctccgagggggtaacgggggctggggaggtggggtggccgaacgtggagtagtggggtagtggggaggtagtggtctaacgttagtgtggactctcgtggaacggggcctataccacatctcagagaaccaacgaccaaagaacctcaactgtatccgtagactaaactcgaaccagccctggacgtaggtcggaaggaccgacgggtctcgttcgtacttacgttcggtacgttccgacttactctccgtaactaccctacgttacgggtccgttccccggtttaagg

SEQ ID NO: 427311 - DNA, 646 bp, Homo sapiens
  misc_feature: GZ8MTXP01ACWK6.45.49.E05.1.454.CMB.2.raw
  modified_base (574)..(574): a, c, t, g, unknown or other
  modified_base (601)..(601): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgaccttgggttttccttgttgcttattttagaaggtgtccagtgtgaggtgcaacgtggtggagtcgtgggggagtcttggtccaggtccgtgggggtccctgagactctcctgtgcagcctcgtggtactttccccttagtcgacttagttggatcggaccgtggggtcccgccgaggtcctaccggagggggaacggggcgtggggaggtggggtcggaccgtaacggtggagagtggggacgtgggaggtgtgtactaacgtagtggtcggtacttcgtcgtagggaacggggtcctacttacccaactactccgtacgaagacgaaccaaccggacaaacgtaaactctaacgtagttactacggttacgaaactaacgtacgaaaccgcgtcccgaggaagacggtacggacggtaacncggtctacgttctacttacgtggtacnccgacttataactcaacgtccacgttacggtccgttccgtttaag

SEQ ID NO: 427312 - DNA, 638 bp, Homo sapiens
  misc_feature: GZ8MTXP01DI03O.45.49.E05.1.454.CMB.2.raw
  modified_base (258)..(258): a, c, t, g, unknown or other
  modified_base (310)..(310): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtctgggggagcttggtccagccgtgggggtcctgagctctctgtgcngctcgtggtacttccccgttagtgacttagttggatcggaccgtgggtcccnccgaggtctccggagggggaacgggggctggggaggtgggggtcggccaaacggtgaggagtggggagtgggaggtgtgtctaaagttagtggtggtaccttcgtcgtagggaacggggtcccgtatttccaaccacttcaccgaacggaacgaaacgaaccggaccaaagaaaccttaccaacttaggttaactcggttacgacctaaaagtcggaaccagccgtaggaagtacggtcgacggacaacgggtctgttccttaacttacgttgcgcgacccttaataactactaactccgaccgttcgggtaacgttcccgttttaag

SEQ ID NO: 427313 - DNA, 569 bp, Homo sapiens
  misc_feature: GZ8MTXP01BETPG.45.49.E05.1.454.CMB.2.raw
  modified_base (259)..(259): a, c, t, g, unknown or other
  modified_base (270)..(270): a, c, t, g, unknown or other
  modified_base (285)..(285): a, c, t, g, unknown or other
  modified_base (343)..(343): a, c, t, g, unknown or other
  modified_base (468)..(468): a, c, t, g, unknown or other
  modified_base (486)..(486): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgcctcagtgtcgtcggggccccagggcaggagggtcaccatctcctgcacgtgggancagttccaacngtcggactaggttangatcgtccactggtaccagcaacttcaacggacacgaccccaaactcctacaatttanacgaaacaacaaactcccgcccgacgacggggtccctaggaccgtacttcctacccgcctaccgaacgtcccggactacctcacgtccctaccgtggcactcactcggcctcgagcctagagagngaggctgtattactaccngaacctggttcgtacgaagtacgttacgttcgggcggaacggaactaacgtcgtacccgtcgttacggtccgaacgtaacccg

SEQ ID NO: 427314 - DNA, 654 bp, Homo sapiens
  misc_feature: GZ8MTXP01DXN3O.45.49.E05.1.454.CMB.2.raw
  modified_base (332)..(332): a, c, t, g, unknown or other
  modified_base (399)..(399): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgaccttgggttttccttgttgctattttagaaggtgtccagtgtgaggtgcaacgtgggtggagtcgtggggggagtcgttggtccaggccggtggggggtccctggacgactcctcctggtcgcagtccctcgtggtactttccccgttagtgacttagttggatgaccgttcgggtcccnccgagggtcctccggagggggaacgggggcgtggggaggtgggggtcggacccgaaaggtggaaggngtggggagtggggaggttacgtgttctaaacgtagttgggtcggtactcgtacgtagggaacggggctattcaaccatcgtaccagacgaaccaacgacaaagactcaactgtaactcgagtacaaatcggaccagccgtagaacggtgtccggaaggaccgaccgggtcttgttaccttaccgttagtcggtcgaccggttaccttattaactctaactttaccgaccggttcgggtaacgtttcccgtttaag

SEQ ID NO: 427315 - DNA, 661 bp, Homo sapiens
  misc_feature: GZ8MTXP01EH48P.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtcagtgtgaggtgcaacgtggtggagtcgtggggggagcttggtccagccgtggggggtcctgagactctcctgtcgcagcctctggtacttccccttagtgacttagttggatcgaccgtgggtcccgccgagggcctccggagggggaagggcgtgggaggtggggtggaccgaaggtgaggagtggggagtggggaggtagtgttacgtaactagtggtaggtaccttcgtacgtagggaacggggtccgtatttacccaccgtattccgccaaggaacgaaccgaacgaccaaacgaactcactgtactcgtacgaacaaattacgaacccgagcccgttaggaacggtaggtaccgacgggaaccgcggtaacgttcggttaccttaacgttaccgtggttccggaccgttaaccttattaacctctaacgtacccgtaccggttgggttaacccgttcccggttttaacg

SEQ ID NO: 427316 - DNA, 606 bp, Homo sapiens
  misc_feature: GZ8MTXP01AUJUJ.45.49.E05.1.454.CMB.2.raw
  modified_base (315)..(315): a, c, t, g, unknown or other
  modified_base (495)..(495): a, c, t, g, unknown or other
  modified_base (583)..(584): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccagccgtggggggtccctgagactctcctgtgcagccctgtggactttccccttagtgacttagttggatgacccgtgggtcccnccgaggcctccgagggggaaggggctgggaggtgggtcggcctaacggtgaggagtggggagtgggaggtagtgtctaactagtggtcgggactcgtactgggaacggggcccgtaattccacctagtcctacccgaagacggaaaccaaacggtcccaaagtaacctcacgttagtacncgtagaccaaatccgaaccagcctaggaagtcggtcgaaagggccaggggtctaggttccaacttacgtgtacgccgaccagttcacnncaccggttgaacgtttccgtaa

SEQ ID NO: 427317 - DNA, 684 bp, Homo sapiens
  misc_feature: GZ8MTXP01ES3OH.45.49.E05.1.454.CMB.2.raw
  modified_base (540)..(540): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctatttagaaggtgtccagtgtgaggtgcaacgtggtggagtcggtggggggagtcttcgggtccaggccggtggggggtccctgacgactcctcctggtcgcacgtcctcgtggtactttccccgttagtcgtacttagtggatcggtaccgtcgggtcccgccgacggccgtaccggagggggaagggtcgtggggaggtcggggtcggaccgaaggtgaggtagtggggagtgggtaggtagtgtacgtaacgtagtggtacggtacttcgtacgtagggaacgggtcctattcccgacctatccacgaagaacgaaccaacgaccaacgtactactactagtactcgtagactaaagtccgaaccncggccgtaggaaggtacggtcggaacggtaccgtcgggtccttcgttaccgttaacgttaccgtaggtacggttacccgaacttaacttaacctctaacctacccggtaccggttacgggtaaccgttttccccggtttaacgg

SEQ ID NO: 427318 - DNA, 720 bp, Homo sapiens
  misc_feature: GZ8MTXP01AU1MK.45.49.E05.1.454.CMB.2.raw
  modified_base (241)..(241): a, c, t, g, unknown or other
  modified_base (246)..(246): a, c, t, g, unknown or other
  modified_base (257)..(257): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacgagggtcctgggcccagtctgtgctgacgcagccgcctcagtcgtcgtcggggcccagggcaggaggtcacntctcngcacgtgggancgtacgttaccaacgtagtccggactagggttatggactcggtacctacgtacggtaacccagtacctaacgttaccgaacggaaccacccgtaccccaaacttcctaacctaatttaacaaacgaaacctaaacgaaaccgtcccggcccgacggtaccggggttaccctacggtaacccggttacttcccgtaccctacccgttaccgaaccggttcccggacctaacccttcggaaccccgtccctttacccggtcgttaccaaccttccggaacgttcccgggtccggttaccggacggttaccgtaacggggaggttaaccggtcggtacgttacgttacgtaacctttacgtaccgtcgtaaccgtaacgttacggtaacgttacgtacgttagggccggttacgggaacgtaacgtacgtaacggtacccgtaggttaccgtcgaaccggtaaccg

SEQ ID NO: 427319 - DNA, 671 bp, Homo sapiens
  misc_feature: GZ8MTXP01DXSGN.45.49.E05.1.454.CMB.2.raw
  modified_base (294)..(294): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcacgccgccctcagtgtcgtcggggccccagggccaggagggtcacctatctcctgcacgtgggagctagttccaacgtagtccgggcctaggttangtactcgtcctacgtcggtaaccagactacccttaccgaaggaacctaccgaccccctaaatccctaactattaataaacgaaaaccaacaaacctcccgccccgacgtaccggggtacccagacccgtacttccgtcccacctaccgaacgtcccggactaccctcgtaaccgtccccttccgtcggttaccaacttcctaaccgttcccgggtaccctacccgaaggtccgttagggaacggtagtccggtaggtaacttggtaatttagtaccgtgtaacctacggttacgtaacgttaagtacgttcggttacggcggttaaacggtaacctaaaacgtcgacccggttcgacggtaaccgaacgtaaccccg

SEQ ID NO: 427320 - DNA, 575 bp, Homo sapiens
  misc_feature: GZ8MTXP01B19MS.45.49.E05.1.454.CMB.2.raw
  modified_base (452)..(452): a, c, t, g, unknown or other
  modified_base (541)..(541): a, c, t, g, unknown or other
  modified_base (545)..(545): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggtttccttgttgctattttagaaggtgtccagtgtgaggtgcaactggtggagtcgtgggggagcttggtccagccgtggggggtccctgagactctcctgtgcagcctctggacttccccttagtgactagttggatgacctgggtcccgccaggctccgaggggaaggggctgggagtgggtggccgaacggtgagagtggggatgggaggtagtgtctaaactgtggtggtactctcgtgggaaacggggccgatttccactagtctaccagagaacaaacgtccaaagacncgactgtactcgtgacaaatcggacccagcccgtgagtacgtcgggagacacgggctggttcctacgttagtcggtagcccggaacttntaancgaactcaccgttggtcgttaacccgtttg

SEQ ID NO: 427321 - DNA, 739 bp, Homo sapiens
  misc_feature: GZ8MTXP01A1FIF.45.49.E05.1.454.CMB.2.raw
  modified_base (703)..(703): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaagttggggctgaccgttgggttttccttgttgcttatttagaaggtgtccagtgtgaggtgcaacgtggtggaggtcggtgggggagtcgttggtccgaggtccggtggggggtccctggagtactctccgtggtcgcacgtccttcgtggtactttccccttagtcgacttagttgatcgaccgtcgggtcccgcggtacgggcccgtaccggaagggggtaacgggggtcgtagggggtagggtcggggttacgggcccgtaaacggtggaggaggtaggggaggtcggggtaaggttagttcggtaccttaaagttacgtggtcggtacgttcctacggtacgggaacgggtcctacttaccaccctacttccgtaacaacgtaacgaacccgaaaaccggtccaaacggtaaaccttccaacgttacgttaactccgttacggaaactaaacgtcgaacccgacgtaccgtacgggaaacgtcggtacgggaaaccggtcgtaacggggtccttgttacccgtacttacggtacgtcgaccgttaccgttactaactntaaccaccgttcgggaagggttccgttcgtttaacg

SEQ ID NO: 427322 - DNA, 548 bp, Homo sapiens
  misc_feature: GZ8MTXP01EK7YD.45.49.E05.1.454.CMB.2.raw
  modified_base (342)..(342): a, c, t, g, unknown or other
  modified_base (455)..(455): a, c, t, g, unknown or other
  modified_base (457)..(457): a, c, t, g, unknown or other
  modified_base (459)..(459): a, c, t, g, unknown or other
  modified_base (472)..(472): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgcctcagtgtctggggccccagggcagagggtcaccatctcctgcactgggagcagttccaaacagtcgggacaggttatgactgtccactggtaccagcaacttccgaaggaacacgacccccaaactcctacatttanacgaaaacacaaaactccgccccgcgacggggtccctgaccgtatcctacccgcctaccgaagtccggcacctcacgccctcctgcactcactcggacctcgaggcctgacgngngngtctgtattactncgctagttcgtagaaagtacgtagttcgggcggaacggtaactaacgtcgacccgtcgttacggtccgaacgcccg

SEQ ID NO: 427323 - DNA, 529 bp, Homo sapiens
  misc_feature: GZ8MTXP02GGLC7.45.49.E05.1.454.CMB.2.raw
  modified_base (281)..(281): a, c, t, g, unknown or other
  modified_base (332)..(332): a, c, t, g, unknown or other
  modified_base (353)..(353): a, c, t, g, unknown or other
tcagacgcgatcgacacgaccggtgctcgatttagagcgactagcaacacacaaagggggagaaatttggggaggctctgcttcagctgtggacacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagttccaacatcgggccaggttangatgtccatggtaccagcaacttccaggacacgccccaaatcctcatttanagaaacaacaactcgccccgnacggggtccctgacccgattcctcccgcctaccgaacgtcccgcacctcacgccctcctgtcatcactcgcctcagctgagatgagctgattatactgcctagtcgtacgaaagtattacgtcgggacggaagggaacctaaaacgtcgtaacccgtcgtacggtccacgaccccg

SEQ ID NO: 427324 - DNA, 523 bp, Homo sapiens
  misc_feature: GZ8MTXP02F6E6H.45.49.E05.1.454.CMB.2.raw
  modified_base (423)..(423): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggtttccttgttgctattttagaaggtgtccagtgtgaggtgcaactggtggagtcgtgggggaggcttggtccagccgtggggggtccctgagactctcctgtgcagcctctggattccccttagtgactatggatgacctgggtccgccaggctccgaggggaaggggctggagtgggtggccaacgtgagatgggatggaggtagtgtctactatgtggactctctgaagggccgattcaccatctcagagacaacgcaagacncactgtatctagacaaatgaccagcctagagagtcgaggacacggctggtactactacgtcgtcgacgaccataatcatccaccgtggacgttccgttag

SEQ ID NO: 427325 - DNA, 529 bp, Homo sapiens
  misc_feature: GZ8MTXP02GYFV1.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtctgggggaggcttggtccagccgtggggggtccctgagactctcctgtgcagcctctggattccccttagtgactattggatgacctgggtccgccaggctccgaggggaaggggctggagtgggtggccaacgtgagatggggatgggaggtagtgtctactatgtggactctctggaagggccgattcaccatctccagagacaacgccaagaactcactgtatctgcaaatgaccagcctgagagtcgaggacacgggctggtctactactcgtcgaccgaccataatcacttcacctggtacgtcccgtttag

SEQ ID NO: 427326 - DNA, 530 bp, Homo sapiens
  misc_feature: GZ8MTXP02J3LL8.45.49.E05.1.454.CMB.2.raw
  modified_base (301)..(301): a, c, t, g, unknown or other
  modified_base (346)..(346): a, c, t, g, unknown or other
  modified_base (382)..(382): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggtttccttgtgctatttagaaggtgtccagtgtgaggtgcaactggtggagtcgtgggggaggcttggtccagccgtgggggtccctgagctctcctgtgcagcctctggattccccttagtgactatggatgacctgggtccnccagggctccgaggggaaggggctggagtgggtggccaagtgagntggggatgggaggtagtgtctactatgtggactctntgaacgggccgattcaccatcctccagagacaacgaccaaagaactcactgtactctgacaaatcggaccagcctagagagtcgaggacacgctgtcctacgtactcgcgccgtaaccataactcactcaccgtcggacgttccgttg

SEQ ID NO: 427327 - DNA, 556 bp, Homo sapiens
  misc_feature: GZ8MTXP02JF4M5.45.49.E05.1.454.CMB.2.raw
  modified_base (257)..(257): a, c, t, g, unknown or other
  modified_base (283)..(283): a, c, t, g, unknown or other
  modified_base (337)..(337): a, c, t, g, unknown or other
  modified_base (473)..(473): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctcggggccccagggcaggaggtcaccatctcctgcactgggancagttccaacagtcgggacaggttangatgtccatggtaccagcaacttccaggacacgccccaaatcctacctatttanaagaaacacaatccgccccgagacggggtccctagaccgtattcctccgcctcgaacgtccgcacctcacgccctacctggtacacgtccaccgtcggccctcgaggtcctaggagatggaggctagacttatacncgacctagtccgtacgaaagtacttacgtccgggacggaagggtaactaaacgtcggacccgtacgtacggtccacgaccccg

SEQ ID NO: 427328 - DNA, 658 bp, Homo sapiens
  misc_feature: GZ8MTXP02J4W6G.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggagcttggtccaggccgtgggggtccctgagactctcctgtgcagcctctggtacttccccttagtgactatggatgacctgggtccaccgaggctccgagggaggggctggagtgggtgccaagtgagagtgggatgggagtagtgtctacgttagtggtgggaccttcgtcgtagggaaacggggtccctattacccaaccctatcccgtacccgaaggaacgaacccgaaaccgacccaaaagaaacccttcaaaccgttgttaacttccgagacctaaaagtccgggaacccaacgcccgttaggaacggtacggtaccggaacgggaacccgacgggtccttacggttacctaacgtaccgttgggacgaccgtaaccctaattaacgttaccaacttcccgtaacccgttgggtaaccgtttcccgtttacgg

SEQ ID NO: 427329 - DNA, 609 bp, Homo sapiens
  misc_feature: GZ8MTXP02GG6DF.45.49.E05.1.454.CMB.2.raw
  modified_base (259)..(259): a, c, t, g, unknown or other
  modified_base (269)..(269): a, c, t, g, unknown or other
  modified_base (285)..(285): a, c, t, g, unknown or other
  modified_base (345)..(345): a, c, t, g, unknown or other
  modified_base (503)..(503): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcaggaggtcaccatctcctgcacgtgggancagttccaanagtcgggccaggttangatgtccatggtaccagcaacttccaaggaaccacgacccccaaactcctactaatttanaacgaaaaccaacaactccgccccgacgacgggggtccctagacccgtatttccgcccgaccctaccgaacggtcccgacaccctcacgtccctccgtggtcacgtcacgtcggaccctcgaggctaggacgatcggaggtctagtattatttaccgngaccgaggttccggtacgaaagtacgttacggttccggggacgggtaacggggtaaacctaaacgttcggaacccgttaccgtaacggggtaccaacggtaccccg

SEQ ID NO: 427330 - DNA, 527 bp, Homo sapiens
  misc_feature: GZ8MTXP02JEPC4.45.49.E05.1.454.CMB.2.raw
  modified_base (281)..(281): a, c, t, g, unknown or other
  modified_base (337)..(337): a, c, t, g, unknown or other
  modified_base (378)..(378): a, c, t, g, unknown or other
  modified_base (460)..(460): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagttccaacatcgggccaggttangatgtccactggtaccagcaacttccaggaacacgcccccaaactcctccatttanagaaacaacaatcgcccgcacggggtccctgaccgattccncccgcctccaacgtccgcacctcacgccctcctggtcactcactcggcctccgaggctcgagactgacggctgacttatacngccagtcgtacgaagtactacgttcggacggaggaactaaacgtcgaccgtctacggtcacgacccg

SEQ ID NO: 427331 - DNA, 536 bp, Homo sapiens
  misc_feature: GZ8MTXP02I493G.45.49.E05.1.454.CMB.2.raw
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagttccaacatcgggccaggttatgatgtccactggtaccagcaacttcaggaacacgcccccaaatcctaccattatagaaacacaatcgcccgcacggggtccctgaccgattctccgcctccaacgtccggcaccctcacgccctccctggtcactcactcggccctccgaggctggagactgaggtctgattatactgcctagtcgtcgaaagtacttacgttccggcggtagggaaccttaaacgtcgaaccgtcctacggtcacgtaaccccg

SEQ ID NO: 427332 - DNA, 538 bp, Homo sapiens
  misc_feature: GZ8MTXP02GTLQV.45.49.E05.1.454.CMB.2.raw
  modified_base (354)..(354): a, c, t, g, unknown or other
  modified_base (386)..(386): a, c, t, g, unknown or other
  modified_base (467)..(467): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagttccaacatcgggacaggttatgatgtccactggtaccagcaacttccaggaaccacgacccccaaactcctacattataagaaacaacaactcnccccgacgacggggtccctgaccgtacttccncccgcctccaagtcccgcaccctcacgccctcccgtgtcacgtcactcggaccctcagctcgagatgaggctgattatacngcctagtcgtacgagactacgttacggcggaagggaactaaacgcgtaccggtacctaggtccacgacccg

SEQ ID NO: 427333 - DNA, 537 bp, Homo sapiens
  misc_feature: GZ8MTXP02JWSFL.45.49.E05.1.454.CMB.2.raw
  modified_base (471)..(471): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagttccaacatcgggccaggttatgatgtccactggtaccagcaacttccaggaacacgcccccaaatcctaccattatagaaacaacaatcgcccgcacggggtccctgaccgattcctcccgcctaccaaacgtcccggacaccctcagccctcccgtggtccatccactcggccctccgaggctggaggatcgaggctggacttattaccngccagtcgtcgaaagtctagtcggacggaaggtaactaaacgtcgacccgtctacggtcagacccg

SEQ ID NO: 427334 - DNA, 511 bp, Homo sapiens
  misc_feature: GZ8MTXP02I0AED.45.49.E05.1.454.CMB.2.raw
  modified_base (254)..(254): a, c, t, g, unknown or other
  modified_base (331)..(331): a, c, t, g, unknown or other
  modified_base (333)..(333): a, c, t, g, unknown or other
  modified_base (472)..(472): a, c, t, g, unknown or other
tcagacgcgatcgacacgaccggtgctcgatttagagcgactagcaacacacaaagggggagaaatttgggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcaccatctcctgcactgggancagttccaacatcgggccaggttatgatgtccactggtaccagcaacttccaggaacagcccccaaatcctcattananaaacacaatcgcccgcacggggtccctgaccgattctccgcctccaagtcccgcacctcacgccctcctgtcatcactcggcctccagctgagatgagctgattatactgaccagtcgtacgaaagtacttagtcgggngtaggaactaaacgtcgaaccgtctaggtccaacgcccg

SEQ ID NO: 427335 - DNA, 669 bp, Homo sapiens
  misc_feature: GZ8MTXP02H8HQ0.45.49.E05.1.454.CMB.2.raw
  modified_base (259)..(259): a, c, t, g, unknown or other
  modified_base (294)..(294): a, c, t, g, unknown or other
  modified_base (428)..(428): a, c, t, g, unknown or other
tcagacgcgatcgacacgaccggtgctcgatttagagcgactagcaacacacaaaggggagaaatttggggaggctctgcttcagctgtgggcacaagaggcagcactcaggacaatctccagcatggcctggtctcctctcctcctcactctcctcgctcactgcacgagggtcctgggcccagtctgtgctgacgcacgccgccctcagtcgtcgtcggggcccagggcaggaggtcaccatctctgcacgtggganctacgtaccaaacgcgtccgggacctagggtttangtacgtcgtaccacgtacggtaccacgtacctaacgtaccgaacgaaccaacccgacccctaaactcctaacctaattaacaacaaacaacaccgtcccgcccgacgtaccggtaccctacgaccctactcccncccgaccctaccgaaccggtcccgaccacccgtcccaccgtcccctccgtcgtacctacgtacctaccgtccgtcccgtaccggacggacgtacgggacggtagtacggtacgtacgttagttaacgttacgtacgtcgtaccgtacgttaccgaacgtaacggtacgttacggtacgggaacggtaacggtaaccgtaaacgtaccggtaccgtaccgtacggtaccgtaaccggacccg

SEQ ID NO: 427336 - DNA, 534 bp, Homo sapiens
  misc_feature: GZ8MTXP02J3B62.45.49.E05.1.454.CMB.2.raw
  modified_base (496)..(496): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtctgggggaggcttggtccagccgtggggggtccctgagactctcctgtgcagcctctggattcccctttagtgactattggatgacctggtccgccaggctccgagggaggggctggagtgggtggccaacgtgagagtgggatgggaggtagtgtctactatggtggactctctgaacgggccgattcaccatcctccagagacaacgccaagaacctcaactgtaatctgacaaatcgacagcctagagagtcggagacacggtctaggtctactactggcncgaaccataactccatccaactcggtaacgtcccgttg

SEQ ID NO: 427337 - DNA, 520 bp, Homo sapiens
  misc_feature: GZ8MTXP02GGEIM.45.49.E05.1.454.CMB.2.raw
  modified_base (304)..(304): a, c, t, g, unknown or other
  modified_base (491)..(491): a, c, t, g, unknown or other
  modified_base (520)..(520): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctatttagaaggtgtccagtgtgaggtgcaactggtggagtctgggggaggcttggtccagcctggggggtccctgagactctcctgtgcagcctctggattccccttagtgactattggatgacctgggtccnccaggctccgagggaaggggctgggagtgggtggccaaacgtgagatggggatggagtagtgtctatatgtggactcgtctgaaaggggccaattcacctatctccagaagacaacgccaaagaactacactgtaatctagacaaaatgaaccagctagagagtcgaaggacacggctgctactatncgacacataatcatcactggactccgttn

SEQ ID NO: 427338 - DNA, 551 bp, Homo sapiens
  misc_feature: GZ8MTXP02JQYZ5.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccagccgtggggggtccctgagactctcctgtgcagcctctggacttccccttagtgactattggatgaccgtgggtccgccgaggctccgaggggaaggggctgggaggtggggtggccgaacggtgagagtggggatgggaggtagtgtctacgtatgtggactctcgtggaacggggccagttccaccatcctaccagacgacaccgacaaagacctcactgtatctgacaatcgaacacgcctagagagtcgaggacacggctcgctacactggtcgaccgaccatctacactcaaccgtcggtacgttccgtttacg

SEQ ID NO: 427339 - DNA, 557 bp, Homo sapiens
  misc_feature: GZ8MTXP02GVIPP.45.49.E05.1.454.CMB.2.raw
  modified_base (283)..(283): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagcccgcctcagtgtctggggccccagggcagagggtcaccatctcctgcacgtgggagcagttccaacagtcgggccaggttangatgtccacgtggtaccagcaacttccgaggaacacgacccccaaactcctactattataagaaacaacaactccgcccccgacgaacggggtcccctagacccgtattcctcccgcctaccaacgtccgcacctcacgccctcctgtcatcactcggccctaccgtagctacggagacgtgaggctagtattagtactgaccgtagtcgtacgagacgttacgtcgggcggaacggaactaaacgtcgaccgtacgtacggtccacgaacccg

SEQ ID NO: 427340 - DNA, 695 bp, Homo sapiens
  misc_feature: GZ8MTXP02I1DFO.45.49.E05.1.454.CMB.2.raw
  modified_base (284)..(284): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcagaggtcaccatctcctgcacgtgggagcagttccaacagtcgggacaggttangatcgtccacgtggtaccagactaacttccgaaggaaccaccgacccccctaaactcctacctaatttaacaagaaaaccaacaaactcccgccccgtacgaccgggggttacccctaggaacccgttattcccgccccgtaccctaccgaaccggtcccgaccaccctaccgacgtcccctacccgtcggtaccactcctacgtccggtaccctaccgaggccgttagggaacgtacgtaggacgggtacttaggttaactttacgtttaacgcggtaacccgtacggttaccggttaacggaaaacgttacgtttaaccggttaccggggaccggtaaagggggtaaaaccttaaaacggtccgtaaaaccccggttccgtaaaccggttaccgaacggtaacccccgg

SEQ ID NO: 427341 - DNA, 667 bp, Homo sapiens
  misc_feature: GZ8MTXP02HAG4J.45.49.E05.1.454.CMB.2.raw
  modified_base (260)..(260): a, c, t, g, unknown or other
  modified_base (270)..(270): a, c, t, g, unknown or other
  modified_base (285)..(285): a, c, t, g, unknown or other
  modified_base (418)..(418): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcacgccgccctcagtgtcgtcggggccccagggcaggagggtcaccatctcctgcactgggancagtccaacngtcgggccaggttangatcgtccacgtggtaccagactaacttccgaaggaaccacgacccccaaaacttcctacctaatttacaacgaaaacctaacgaaactcccggcccccgacgacgggggtcccctacgacccgtactttccncccgaccctaccgaacgtcccggcctaccctcacgtcccctcccgtcggtaccactccaccgtcggacccttccgaggtcctaggacggtacgtcggacggtcttaggtaactttacgttaacgtcggtacccgtaggttaccggtaccggtaaaggtaacgttacggttaccggggacgggtaacgggtaaccgttaaaacggtccggtaacccggttaccgtaacgggtaccgaccggtaaccccgg

SEQ ID NO: 427342 - DNA, 589 bp, Homo sapiens
  misc_feature: GZ8MTXP02G5V1F.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggagcttggtccagccgtgggggtccctgagactctcctgtgcagcctctggacttcccctttagtgactatggatgacctgggtccgccaggctccgaggggaaggggctgggaggtgggtggccaacgtgagagtgggatgggagtagtgtctactagtggtggactctcgtggaacgggtccgtattccgaacctagtcctacccaagaacgaacaaaccgacctaaagaacctcaactagtaactcgtagacctaaaagtcgaaccaggaccctaggacgtaggtcgaagggaccacgggtacctggtacctacgtacgtggtcgaccgtaccataacgacactccaccgtggaccgttcgtttacg

SEQ ID NO: 427343 - DNA, 593 bp, Homo sapiens
  misc_feature: GZ8MTXP02G55JX.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgaccttgggttttccttgttgctattttagaaggtgtccagtgtgaggtgcaactggtggagtcgtgggggagcttggtccagccgtgggggtccctgagactctcctgtgcagcctctggacttcccctttagtgactattggatcgacctgggtccgccaggctccgaggggaaggggcgtgggagtggggtggccaacggtgagagtggggatgggaggtagtgtctactagtggtggactcgtgtggaacgggtccgattccgacctagtcctccaagacgaacaacgaccaaagaactcactagtatcctagacaaatcgaacctaagcctaggacggtaggtacggaacggacgtaacggtctagttactaccgtacgtcgtcgaccgaacctataacgtacactaccgaaccgttacggtaacgttccgtttacgg

SEQ ID NO: 427344 - DNA, 531 bp, Homo sapiens
  misc_feature: GZ8MTXP02JXQIL.45.49.E05.1.454.CMB.2.raw
  modified_base (304)..(304): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttcctgttgctattttagaaggtgtccagtgtgaggtgcaactggtggagtcgtgggggaggcttggtccagcctggggggtccctgagactctcctgtgcagcctctggattccccttagtgactatggatgacctgggtccnccaggctccgagggaaggggctggagtgggtggccaacgtgagatggggatgggaggtagtgtctactatgtgggactctctgaaggggccgattccgaaccctatcctaccagagacaacgccaaagactcactgatctgacaaatcgaccagcctgagagtcgaggacacggctgtctactactgtcgccgaccataactcactccacgtcggacgttccggttc

SEQ ID NO: 427345 - DNA, 667 bp, Homo sapiens
  misc_feature: GZ8MTXP02GNDRA.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccagccgtggggggtccctgagactctcctgtgcagcctctggacttcccctttagtgactatggatgaccgtgggtcccgccaggctccgaggggaggggctgggaggtgggtggccaaggtgagagtgggatgggaggtagtgtctacttagtggtggactcgtcgtaggacggggccgagtttccacctatcctaccgaggaacgaaccaaaccggcccaaaacgaacctaccgaaccttaggtaaacttccttaggaacctaaaagttccggaacccaacgtcccgtaggaacggtacggtaccggaacggggaacccgtaaccggggtcctttacgggttaccttaaccgttaccgtcgggttacggacccgtaaccctattaacgttaccacttaccccgaaccgttcggggtaaccggtttcccgtttacg

SEQ ID NO: 427346 - DNA, 535 bp, Homo sapiens
  misc_feature: GZ8MTXP02INEMM.45.49.E05.1.454.CMB.2.raw
  modified_base (304)..(304): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttcctgttgctatttagaaggtgtccagtgtgaggtgcaactggtggagtctgggggaggcttggtccaggccgtggggggtccttgagactctcctgtgcagcctctggacttcccttagtgactatggatgacctgggtccnccaggctccgaggggaggggctgggagtggggtggccaacgtgagagtgggatgggaggtagtgtctactatggtggacttcgtcgtggaaggggcccgtattaccgacctatctaccgagacgacaacgccaaagaactcactgtatctagacaaatcgaccagcctgagagtcgaggacacggctgtcctactactgtcgacacctataatcactcacctggactctcg

SEQ ID NO: 427347 - DNA, 563 bp, Homo sapiens
  misc_feature: GZ8MTXP02H1LZK.45.49.E05.1.454.CMB.2.raw
  modified_base (455)..(455): a, c, t, g, unknown or other
  modified_base (469)..(469): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctatttagaaggtgtccagtgtgaggtgcaactggtggagtcgtgggggagcttggtccagccgtgggggtccctgagctctcctgtgcagcctctggtacttcccctttagtgactattggatcgacctgggtccaccgaggctccgaggggaacggggcgtgggaggtgggtggccgaaggtgagagtggggatgggaggtagtgtctactatggtgactctcgtaggacgggcctattccaccatcctcagaacgaacaacgaccaaagactcactgtatcngacaaatcgaaccngcctaggagagtccggaaggacgacggtctcggttactaacgtcgtacgtcgaccgaaccagttaactcaatccacgtcggtacgtttccgttg

SEQ ID NO: 427348 - DNA, 567 bp, Homo sapiens
  misc_feature: GZ8MTXP02FWV8T.45.49.E05.1.454.CMB.2.raw
  modified_base (260)..(260): a, c, t, g, unknown or other
  modified_base (347)..(347): a, c, t, g, unknown or other
  modified_base (397)..(397): a, c, t, g, unknown or other
  modified_base (458)..(458): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcaggagggtcaccatctcctgcacgtgggancagtccaacatcgggccaggttatgatcgtccacgtcggtaccagccaacttccaggaaccacgacccccaaactcctaccatttanaagaaacaacaactccgccccgcgacgggggtccctacgaccgtattccncccgcctaccacgtcccgcacctcacgccctccgtgtcactcactcgcctcgagctggagntgaggctgattatactcgctaggtcgtacgaaatactacgttacggacggtaacggggtaaccttaaaccgtcggtaacccggttcgtaacggtaccacggtaccccgg

SEQ ID NO: 427349 - DNA, 678 bp, Homo sapiens
  misc_feature: GZ8MTXP02IIYKZ.45.49.E05.1.454.CMB.2.raw
  modified_base (369)..(369): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcacgtgggagcagttccaacatcgggccaggttatgatgtccactggtaccagctaacttccaaggaacacgacccccaaaatcctaccaatttacagaaaacaacaactaccgcccccganaacgggggtccccctagaaccccgtgttaccctcccgacccttaccgaaacggttcccggaccacccgttccaacggtccccctcccgttggtccaacttccaaccgttcggacccttcccgaaggcccttagggaacggtagttcggaaagggtccttaggaaatttacttacgtacggtacccgtaaggtttcccggtaacgtaaaaggtacgtttaacggttcccggggacgggtaaacggggtaaacccttaaaacgtccggtaaacccggttaccgtaacggggttaccaaccggtaaccccgg

SEQ ID NO: 427350 - DNA, 545 bp, Homo sapiens
  misc_feature: GZ8MTXP02IJ412.45.49.E05.1.454.CMB.2.raw
  modified_base (282)..(282): a, c, t, g, unknown or other
  modified_base (303)..(303): a, c, t, g, unknown or other
  modified_base (473)..(473): a, c, t, g, unknown or other
  modified_base (476)..(476): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggtttcctgttgctattttagaaggtgtccagtgtgaggtgcaactgggtggagtctgggggaggcttggtccagccgtggggggtccctggagactctcctgtgcagcctctggattcccttagngactatggatgactgggtccnccaggctccgaggggaaggggctgggagtggggtggccaacgtgagagtggggatgggagtagtgtctactatggtgactctctggaacgggccgaattcaccattcaccgaagagaacaaaccggccaaagaaacctcactgtaatctagacaaaatcgaaccagtccnganagtcgagacacggtctgctactagtcgtcgacgacactaactacactactacgtacggtacgtacgtcg

SEQ ID NO: 427351 - DNA, 553 bp, Homo sapiens
  misc_feature: GZ8MTXP02G5GBG.45.49.E05.1.454.CMB.2.raw
  modified_base (306)..(306): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtctgggggagcttggtccagccgtggggggtccctgagactctcctgtgcagcctctggattcccccttagtgactattggatgacctgggtccnccaggcctccgaggggaaggggctgggagtggggtggccaacggtgagagtgggatgggaggtagtgtctactatggtggactctcgtggaaggggccagttcacctatcctccagacgacaaccgacaagaactcactgtatctagacaaatcgaccagcctagagacgtcgaagacgacggtctcggtactacgtactggtcgaccgacctataacgtcaactcaccgtggacgttccgtttacg

SEQ ID NO: 427352 - DNA, 551 bp, Homo sapiens
  misc_feature: GZ8MTXP02H3WF5.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttgggtccagccgtggggggtccctggagactctcctgtgcagcctctggacttcccctttagtgactattggatgacctgggtccgccgaggctccgaggggaaggggctggaggtgggtggccaacgtgagagtggggatgggaggtagtgtctattatgtggacttctcgtaggacgggcctattccaccatctccgagagaacaaccgccaaagaacctcgactgtatctgtacaaatgaccacgcctagagagtcgaggacgacggctgtactactactgtcgacgaccataagtcaatccacgtcggtacgttcccgttag

SEQ ID NO: 427353 - DNA, 539 bp, Homo sapiens
  misc_feature: GZ8MTXP02G0MKV.45.49.E05.1.454.CMB.2.raw
  modified_base (406)..(406): a, c, t, g, unknown or other
  modified_base (414)..(414): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtggggggaggcttggtccagccgtggggggtcccttagactctcctgtgcagcctctggattccccttagtgactattggatgacctgggtccgcaggctccgagggaggggctggagtgggtggccgaacgtgagagtggggatggggaggtagtgtctactatggtggactctcgtgagggcgattcacntctcaganacacgccaagaactcactgtatctgacaaatcgaccagcctagagagtcggaaggacacggctcgtaccgactactgtcgacgaccatactctaatcccaacgtcgggacttcccgttacttagg

SEQ ID NO: 427354 - DNA, 725 bp, Homo sapiens
  misc_feature: GZ8MTXP02I7V1V.45.49.E05.1.454.CMB.2.raw
  modified_base (260)..(260): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcaggagggtcaccatctcctgcacgtgggancagttccaacagtccgggcctaaggttatgatcgtccacgtcggtaccagccaaaccttccgaaggaaccacgaccccccaaaactcctacctaatttaactaacgaaaaccaacaaactcccgcccccgacgtaacgggggtaccccctacggaccccgtaactttcccgtaccccggtacccctacccgtaaaccggttcccccgggacctaaccccgttacccgaaccggtcccccttccccgtacgggttacccacgttcccaacccgttccgggaccccttccccgaagggtcctacgggaacggtagtcgggaacggtccgtaggtaatttacgttacgtcggtacccgtagggttccgtacggtaaaacgtgttaacggttaccggggacggtaacggggtaaccttaaaaccgtcggtaaccccggttacgtaacgggtaccgaaccggaaccccgg

SEQ ID NO: 427355 - DNA, 547 bp, Homo sapiens
  misc_feature: GZ8MTXP02GQ4R2.45.49.E05.1.454.CMB.2.raw
  modified_base (391)..(391): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttcctgttgctattttagaaggtgtccagtgtgaggtgcaactggtggagtcgtgggggaggcttggtccagccgtggggggtccctgagactctcctgtgcagcctctggacttccccttagtgactattggatgacctggtccgcaggctccgaggggaaggggcgtgggagtggggtggccgaacgtgagagtggggagtgggaggtagtgtctatatggtgactctntagacgggcgattcacatctccagagacaacgcaaagaactcactgtatctagacaaatcgaaccagcctggagagtcgaggacgacggtctcgacttacgtactgtcgaccgaacctataacgtcactacctaccgtcggtacgttcccgtttag

SEQ ID NO: 427356 - DNA, 561 bp, Homo sapiens
  misc_feature: GZ8MTXP02GNT0K.45.49.E05.1.454.CMB.2.raw
  modified_base (255)..(255): a, c, t, g, unknown or other
  modified_base (336)..(336): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgcctcagtgtctggggccccagggcagagggtcaccatctcctgcactgggancagttccaacatcgggacaggttatgatgtccactggtaccagcaacttccaggaacacgacccccaaactcctctattanagaaacaacaactcgccccgacacgggggtccctgaccgtattcctcccgcctaccaacgtcccggcacctcacgtccctcctggtccatccactcggtccctccgaggcctggacggactggaggctagatttatacgtcgaccagttcgtacgaaagtcttacgttcgggacggaagggaaccttaaaacgtcgtacccggtacgtacggtacacggaccccg

SEQ ID NO: 427357 - DNA, 541 bp, Homo sapiens
  misc_feature: GZ8MTXP02HPSP3.45.49.E05.1.454.CMB.2.raw
  modified_base (308)..(308): a, c, t, g, unknown or other
  modified_base (500)..(500): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtctgggggaggcttggtccagccgtggggggtccctgagactctcctgtgcagcctctggacttcccctttagtgactattggatgacctgggtccnccaggctccgaggggaaggggctgggaggtgggtggccaacggtgagagtgggatgggagtagtgtctactatgtggactctcgtaggacgggcctagtccaccatctccagagacaacgcaagaactcaactgtatctagactaaatcggaaccacgcctagagagtcgaggacgacggctagtctactcncgtcgaccgaccataatcactcacgtcggacgttcgttacg

SEQ ID NO: 427358 - DNA, 528 bp, Homo sapiens
  misc_feature: GZ8MTXP02F0O6D.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccagccgtggggggtccctgagactctcctgtgcagcctctggacttccccttagtgactattggatgacctggtccgcaggctccgaggggagggctggaggtgggtgccgaacgtgagagtggggatggaggtagtgtctatatggtgactctctggaagggccgattcacatctcagagacacgacaaagactcactgtactcagacaaatcgaccagcctagagtagcgaggacacggctcgtctactactgtcgacgaccataacgtcactccgacgtcggacgtccgtttacg

SEQ ID NO: 427359 - DNA, 584 bp, Homo sapiens
  misc_feature: GZ8MTXP02H38WO.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtctgggggagcttggtccagccgtggggggtccctgagactctcctgtgcagcctctggattccccttagtgactattggatgacctgggtccgccaggctccgaggggaggggctggaggtgggtggccaacggtgagagtggggatgggaggtagtgtctacgtatgtgactctgtagacggggcctaattcccgacctatcctaccgagacgaacctaaccggcaaacgaacctcgaacttgtatccgtagtacaaagtcggaaccacgccgtaggaagtacgtacggaggaaccgacgggcttggtaccttactacgtcggtcgacgtaaccataactcaactccgaccgtacggtcgtttaccgttcg

SEQ ID NO: 427360 - DNA, 544 bp, Homo sapiens
  misc_feature: GZ8MTXP02IT02C.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccagccgtggggggtccctgagactctcctgtgcagcctctggacttcccctttagtgtactattggatgacctggtccgcaggctccgaggggagggctggagtgggtggccacggtgagagtgggatgggagtagtgtctacttatggtggactctcgtggaacgggccgtattcacctatctccgagacgacaacgacaaagaactcgaactgtaactctagacaatcgaccagcctagacgagtcgagacacggtctgtactactactcgtcgacgaccataactcactccacgtcggtacgttccgttag

SEQ ID NO: 427361 - DNA, 522 bp, Homo sapiens
  misc_feature: GZ8MTXP02GPIS5.45.49.E05.1.454.CMB.2.raw
  modified_base (305)..(305): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttcctgttgctattttagaaggtgtccagtgtgaggtgcaacgtggtggagtctgggggaggcttggtccagcctggggggtccctgagactctcctgtgcagcctctggattccccttagtgactattggatgacctgggtccncaggctccgagggaaggggctggagtgggtggccaacgtgagagtgggatgggagtagtgtctactatgtggactctctgaagggccgattccaccatctccagagacaacgcaagaactcactgtatctgcaaatgaccagcctagagagtcgaggacacggctggtactacgtactgtcgcgtaccataatcatccaacctggacgttcgttacg

SEQ ID NO: 427362 - DNA, 634 bp, Homo sapiens
  misc_feature: GZ8MTXP02JNCI0.45.49.E05.1.454.CMB.2.raw
  modified_base (333)..(333): a, c, t, g, unknown or other
  modified_base (340)..(340): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtcgtcgtcggggccccagggcaggacgggtcaccatctctgcacgtgggagcagttccaacagtcgggacaggttatgatcgtccactggtaccagcaacttcagacacgaccccaaactccnctattanagaaacaacaactccgccccgacgacggggtccctacgaccgtacttcctcccgcctaccgaaccgtcccggaccacccgtccacgtccctcccgtacggtcctactcctacgtcggtccctccgacggtccgtcggaaggacgttcggaacggtccgtaggtaactttacgttacgtacgtaccgtacggttaccgtaacgaaacgtacgttacgttccggggaacggtaacgggtaaccgttaaaaccgtaccggtaaccggtaccgtaacggtaccgacggtaaaccccgg

SEQ ID NO: 427363 - DNA, 551 bp, Homo sapiens
  misc_feature: GZ8MTXP02GPZL9.45.49.E05.1.454.CMB.2.raw
  modified_base (302)..(302): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctatttagaaggtgtccagtgtgaggtgcaactggtggagtcgtgggggagcttggtccagccgtggggggtccctgagactctcctgtgcagcctctgattccccttagtgactatggatgacctggtccnccaggcctccgaggggaaggggcgtgggagtggggtggccgaaacggtgagagtggggagtgggaggtagtgtctaacgttatggtgggacttctcgtggaaggggccgtattccaaccatctccagagacaacgaccaaagaactcactgtatcagacaaatgaccacgctagagagtcggaggacacggctcgtctactactggtcgacgaccaataactcaactccaccgtggacgttccgtttag

SEQ ID NO: 427364 - DNA, 609 bp, Homo sapiens
  misc_feature: GZ8MTXP02I97D7.45.49.E05.1.454.CMB.2.raw
  modified_base (256)..(256): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggancagttccaacatcgggacaggttatgatgtccactggtaccagctaaccttcaggaaccacgacccccaaactcctacctaatttactaacgaaacaacaacgttcccgacccccgcgaccgggggtccctacgacccgtatttcctcccgccctaccgtaaacgtcccggaccacccgtcacgtcccctcccgtggtccactccgactcggccctaccgaggcctggacggatggacggtctagtattagttacgtgacccgagttccgtacgaaagtacgtacgttaccggggacggtaacgggtaacctaaacggtcggtacccgtacgtacggtacgacgtaaccccgg

SEQ ID NO: 427365 - DNA, 514 bp, Homo sapiens
  misc_feature: GZ8MTXP02FKMBA.45.49.E05.1.454.CMB.2.raw
  modified_base (496)..(496): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttcctgttgctatttagaaggtgtccagtgtgaggtgcaactggtggagtctgggggaggcttggtccagcctggggggtccctgagactctcctgtgcagcctctggattccccttagtgactattggatgacctgggtccgccaggctccgaggggaaggggctggagtgggtggccaacgtgagatggggatgggaggtagtgtctactatgtggactctctgaagggccgattcaccatctcagagacaacgccaaagactcactgtatctgcaaaatgaccagccctgagagtcgaggacacgggctgtctactactgtcgcgaccataancatcacctggactcgttc

SEQ ID NO: 427366 - DNA, 527 bp, Homo sapiens
  misc_feature: GZ8MTXP02JFV60.45.49.E05.1.454.CMB.2.raw
  modified_base (371)..(371): a, c, t, g, unknown or other
  modified_base (437)..(437): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggtttccttgttgctattttagaaggtgtccagtgtgaggtgcaactggtggagtctgggggaggcttggtccagcctggggggtccctgagactctcctgtgcagcctctggattcccctttagtgactattggatgacctggtccgccaggctccagggaagggctggagtggggtggccaacgtgagatgggatgggaggtagtgtctactntggtggactctcgtgaagggccgattccgaccatctccagagacacgccaagactcactagtatcngacaaatgaacccagcctgagagtcgagacacgggctggtccaactctgtcgaccgacctataatcactcaccgtaggacgtccgtttag

SEQ ID NO: 427367 - DNA, 645 bp, Homo sapiens
  misc_feature: GZ8MTXP02IYJUH.45.49.E05.1.454.CMB.2.raw
  modified_base (258)..(258): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgaccttgggttttccttgttgctattttagaaggtgtccagtgtgaggtgcaactggtggagtcgtgggggagcttggtccaggccgtgggggtccctgagctctccngtgcagcctctggtacttccccttagtgactagttggatgaccgtgggtcccgccgaggtcctccggaggggaacggggtcgtgggaggtggggtcggaccgaacggtgagagtggggatgggaggtagtgtctactatggtgactcgtcgtaggaacggccgtattccgacctatcctacgagacgaacaaccgaccaaacgaactacacttgtacttacgtagactaaagtcgaacccacgccctaggaaggtacggtaccggaagggaccgtacggtcgttacggttaccttaacccgttagttacggaccgtacccgaaacctaacgttaactccctaacgttacccgaaccggtttcgggtacgtttaccccggttttaacg

SEQ ID NO: 427368 - DNA, 542 bp, Homo sapiens
  misc_feature: GZ8MTXP02IYU5M.45.49.E05.1.454.CMB.2.raw
  modified_base (306)..(306): a, c, t, g, unknown or other
  modified_base (412)..(412): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggtttcctgttgctattttagaaggtgtccagtgtgaggtgcaactggtggagtcgtgggggagcttggtccagccgtggggggtccctggagactctcctgtgcagcctctggacttccccttagtgactattggatgacctgggtccncaggctccgaggggagggctgggagtggggtggccaacgtgagagtgggatgggagtagtgtctactatggtgactctctggaagggccgattcacatctccaganacaacgaccaaagactcactgtactctgactaaaatcgaacccagacccttaagacgtacgaaggacacggctcggtactactactgtacgaccgactatactcactcaccgtggacgttccgttctagg

SEQ ID NO: 427369 - DNA, 636 bp, Homo sapiens
  misc_feature: GZ8MTXP02FWHEZ.45.49.E05.1.454.CMB.2.raw
  modified_base (510)..(510): a, c, t, g, unknown or other
  modified_base (518)..(518): a, c, t, g, unknown or other
  modified_base (528)..(528): a, c, t, g, unknown or other
  modified_base (543)..(543): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggtttcctgttgctatttagaaggtgtccagtgtgaggtgcaactggtggagtcgtggggggagcttggactcgacgcgggtcgggggtcctggactctcctcgtgtcgcgacgtcctcgtggtacccttcccgttagcgtaacttagtggatacgacggtcgggtccacgacgtcctacggaagggggacggtcgtagggagggtgggtccggaaccgtaaggtggaaggtaggtcgggtagtagggtagggtagttcgtaccttaagttgtggtacggtactcgtcgtagggacgggcttactcaactatcccgtacgaaggtaaacgacccaaacgaccgaaagtaccctntaacgttntacctacganaaacgaatccgaacncgtacgagaacggcgtaacggacgctcggtcttacgtactacgtcgtcggaccacgaactaagtactacacctaccgtacggtcggtacctcg

SEQ ID NO: 427370 - DNA, 721 bp, Homo sapiens
  misc_feature: GZ8MTXP02IKB3E.45.49.E05.1.454.CMB.2.raw
  modified_base (253)..(253): a, c, t, g, unknown or other
  modified_base (508)..(508): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgcctcagtgtctggggccccagggcagaggtcaccatctctgcactgggancagttccaacacgtcgggactaggttatgatcgtaccactggtaccagcctaaaacctttccgaaggaaaccctaccgacccccctaaaacttccgtacccctaattttaaacaacggaaaaccaacctaaactcccgacccccgggtaccgaacgggggttaccccctaggtacccgtactttccctaccccggacccttacccggaaaccggtcccgggacctaacccgttcccaacgtccccctttccccgngggttacccaacgttcccaccgttcccgggaccctttcccgaaggtccgtagggaaacggccgtaggacgggtcctaggttacttaacggtttaccgcgtaccgtagtaccggtaacggaacgtacggttacggtacggggaacgggaaacggtaaaccgttaaaaccggtacccggtaaccggttaccgtacggtaaccgaaccggtacccg

SEQ ID NO: 427371 - DNA, 619 bp, Homo sapiens
  misc_feature: GZ8MTXP02JY2HQ.45.49.E05.1.454.CMB.2.raw
  modified_base (308)..(308): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccagccgtggggggtccctgagactctcctgtgcagcctctggattcccctttagtgactattggatgacctgggtccnccaggctccgagggagggctggagtgggtggccaaggtgagagtgggagtgggaggtgtgtctactagtgtgggactctcgtggaacggggcccgtagttccaaccctagtccctccgaggagacaaccgaccaaagaaccttcgactgtatcgtagactaaaagtcgaacccacgtcccgtaggaggtacggtacggacgggaacgaccggggtcttacggtacctaaccgttaaccgtggttaccgaccggtaaccctaataacgtacctactacccgtaaccgtacgggtaccgtttcccggtttacg

SEQ ID NO: 427372 - DNA, 598 bp, Homo sapiens
  misc_feature: GZ8MTXP02I9JAP.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccagccgtgggggtccctgagactctcctgtgcagcctctggtacttcccctttagtgactattggatgaccgtgggtccgccaggcctccgaggggaagggcgtgggaggtgggtcggccgaacgtggagagtgggatgggagtagtgtactactatggtggactcgtcgtggaacgggccgtattaccaccgtatccctaccgagacgaacaaccggacccaaaagtaacctaccgtacttagtactactagactaaaatcgaccagcctagacggagtcgaggacacggctacgtactaacgtacgtggtacgacgaacctagtaacgtctaacctaccgtaccgtcggtaccgttccgtttacgg

SEQ ID NO: 427373 - DNA, 539 bp, Homo sapiens
  misc_feature: GZ8MTXP02GP7G1.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccagccgtggggggtccctgagactctcctgtgcagcctctggacttccccttagtgactattggatgacctgggtccgccaggctccgaggggaagggctggagtggggtggccgaacgtgagagtgggatgggaggtagtgtctactagtggtggactctctggaagggccgattccactatctccagagacaacgccaaagactcactgatctagacaaatcgaaccagtccagagacgtcggagacacggctgtctacgtactgtcgaccgtaccataactcactcacgtcggtacgtcccgttag

SEQ ID NO: 427374 - DNA, 719 bp, Homo sapiens
  misc_feature: GZ8MTXP02JI6BS.45.49.E05.1.454.CMB.2.raw
  modified_base (256)..(256): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgcctcagtgtcgtggggccccagggcagagggtcaccatctcctgcactgggancagttccaacagtcgggccaggttatgatcgtccacgtggtaccagacctaaccttccgaaggaaccacgacccccaaaacttcctaccgtatttaactaacgaaaacaactaaactcccgcccccgtacgtacgggggtcccctacgacccgtactttcctcccggacccttacccgtaaaccggttcccggacctaaccccttccgaccgtccccttccccgttacgggtaccaacgttcccaaccgttccgggaccccttacccgaacgggtcccgttagggaacggtacgttacggacgggtacctaggttaactttacgttaaccgtcggtaaccgtacggttacgtaaccgaaaagttacgttaacggtttaccggggacggtaaacggggttaaacctaaaacggttaccggtaacccggttaccgtaaacgggttaccgaccggtaaacccccgg

SEQ ID NO: 427375 - DNA, 575 bp, Homo sapiens
  misc_feature: GZ8MTXP02I7SEU.45.49.E05.1.454.CMB.2.raw
  modified_base (545)..(545): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgaccttgggttttccttgttgctattttagaaggtgtccagtgtgaggtgcaactggtggagtcgtggggggagcttggtccaggccgtggggggtccctggagactctctgtgcagcctctggacttccccttagtgactatggatgacctggtccgccaggctccgaggggaagggctgggagtggggtggaccaacggtgaggagtgggatgggaggtagtgtctatatgtggactctacgtagaacgggggcctagttaccacctaagttcctaccaggacgaacaaacgaccaaagaactcactgtatctagacaaatcgaacccagtcctagaggacgtcggaacggacacgggtctcgtactaccgtatcggtcacgaacccataacnctaactccaccgtggtaccgtcccgtttag

SEQ ID NO: 427376 - DNA, 526 bp, Homo sapiens
  misc_feature: GZ8MTXP02FGPLU.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtctgggggaggcttggtccagcctggggggtccctgagactctcctgtgcagcctctggacttccccttagtgactattggatgacctgggtccgccaggctccgaggggaaggggctgggagtgggtggccaaacgtgagagtgggatgggaggtagtgtctacttatgtgggactctcgtgaagggccgattcaccatctcagagacaacgcaaagactcactgtatctgacaaatcgaccagcctgagagtcgaggacacggctgctactactgtcgacgaccataactcactcacctggacgtccgttacg

SEQ ID NO: 427377 - DNA, 690 bp, Homo sapiens
  misc_feature: GZ8MTXP02JSNFY.45.49.E05.1.454.CMB.2.raw
  modified_base (255)..(255): a, c, t, g, unknown or other
  modified_base (281)..(281): a, c, t, g, unknown or other
  modified_base (343)..(343): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcaccatctctgcacgtgggancagttccaacagtcgggccaggttangatgtaccacgtgaccagctaacttccgaaggaacaccgacccccaaactcctactatttanaacgaaacacaactcgcccccgcgaacgggggtcccctagacccgtactttaccctcccgaccctaccgaaacggttccccgggaccctaaccccttccgaaccggtcccccttacccccggttagggttacccaactttcccgaaccgttccggggaccccttaccccggaacgggtcccgttagggaaacgggggtacttacgggggaacggtccgttaggtaacttttaacgttacgtcggtacccgtaaggttaccgtacggaaagttcgttaaacggttcggggacggtaaacgggaaccttaaaacgcggtaaacccgtcgtacgtccgaacgaaccccgg

SEQ ID NO: 427378 - DNA, 645 bp, Homo sapiens
  misc_feature: GZ8MTXP02GV42Y.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgaccttgggttttccttgttgcttattttagaaggtgtccagtgtgaggtgcaactggtggagtcgtgggggaggcttggtccagccgtgggggtccctgagctctcctgtgcagcctcgtggtactttcccctttagtgactagttggatcgacctcgggtccgccgagggcctaccggaggggaaggggcgtgggaggttggggcggaccaaacggtgagtaggtggggagtggggaggtagtgtactactagtggtggactcgtcgtaggaacggggccgtattcccaacctattcccgacccaaggaacgaaaccaaaccggaccaaaagaaaccctcaacgttagttaactcgtaggaacaaaagttcgaaacccagtaccctaggaacgtaggtaccggaaggaaccgcgggtactcggttactaacttacgtacggtcgaaccgacctataacgtacaactacctaccgtggtacgtttcccgtttag

SEQ ID NO: 427379 - DNA, 590 bp, Homo sapiens
  misc_feature: GZ8MTXP02ILZVV.45.49.E05.1.454.CMB.2.raw
  modified_base (258)..(258): a, c, t, g, unknown or other
  modified_base (352)..(352): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctcggggccccagggcagagggtcaccatctcctgcacgtgggancagttccaacgacgtcgggcctaggttatgattcgtccactcggtaccagccaacttccgaggaaccacgacccccaaactcctactactttanaacgaaacaacaactccgccccgcgacgggggtccctagacccgtattcctcccgcctaccaacgtccgccaccgtcacgtcccctccgtcggtccactcaccgttcggccctcgacggctagggagcgtgacggtctagtatttactactgcctagttcgacgtaaagtacgtacgttcggggacggaacggtaactaaacgtcggacccgttacgtacggtaccgacgtaacccgg

SEQ ID NO: 427380 - DNA, 518 bp, Homo sapiens
  misc_feature: GZ8MTXP02GPPS9.45.49.E05.1.454.CMB.2.raw
  modified_base (411)..(411): a, c, t, g, unknown or other
  modified_base (497)..(497): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtctgggggaggcttggtccagccgtgggggtccctgagactctcctgtgcagcctctggattccccttagtgactattggatgacctggtccgcaggctccgagggaagggctggagtggggtggccaacgtgagagtgggatgggagtagtgtctactagtgtggactcgtctgaagggccattccacatctaccaganacaacgacaaagaactcgactagtatctgacaaatcgaccagcctagagagtcgagacacggctgtcactactgtcacgacataancgatcacctggactcgttacg

SEQ ID NO: 427381 - DNA, 689 bp, Homo sapiens
  misc_feature: GZ8MTXP02H2JAD.45.49.E05.1.454.CMB.2.raw
  modified_base (315)..(315): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacgagggtcctgggcccagtctgtgctgacgcacgcccgcctgagtcgtccggtcggggccccgagggcgaggacgggtccaccgtactcctccgtggccacgtggggacgctacgttacccaacgtagtccgggaccgtaggtttangtagttcgtaccacgttacggtacccaagtacctaacttaccgaacggaaccaacccgtaacccccaaactcctacctaatttaacaacgaaaaccaactaacgccccgcccgacgtaccggggtccctagaacccgtactccctcccgacccgtaccgaacggtcccgacctacccgcgaccgtccctccgtacggtacctctaaccgccgtacgccctacgtacggctacgggacgtagtcgggacgtccttaggtacttacgttccacggtcaacggtttcgaaacgtaacgtacgttaccggtcggggacggtaaacggtaacccgttaacggaccggtacccgtacgtacggtaccgaacggaacccgg

SEQ ID NO: 427382 - DNA, 600 bp, Homo sapiens
  misc_feature: GZ8MTXP02IFCOR.45.49.E05.1.454.CMB.2.raw
  modified_base (219)..(219): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggtttcctgttgctattttagaggtgtcagtgtgaggtgcaactggtggagtcgtgggggagnttgggtccagccgtggggggtccctgagactctcctgtgcagcctctggtacttccccgtttagtgtactagttggatcggactgggtccgcaggcctcgaggggaggctgggagtgggtggcacgtgagagtgggagtggaggtagtgtactacgtatggtggactcgtacgtaggacgggcctagttcaccatctacgagacgtacaaccgacaaacgactacgactagtactctagaacaaagtacgaaccacggaccgtaggaacgtaggtacgacgggtaaccacgggtcttacggttacctaactacggtcgtacgaccggtaacctaagtaacgtactacgtacccgaacgttcggtaccgtttaccgtttacg

SEQ ID NO: 427383 - DNA, 583 bp, Homo sapiens
  misc_feature: GZ8MTXP02JW9B0.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttcctgttgctattttagaaggtgtccagtgtgaggtgcaactggtggagtcgtgggggaggcttggtccagccgtgggggtccctgagactctcctgtgcagcctctggacttcccctttagtgactattggatgaccgtgggtccgccaggctccgaggggaaggggctgggaggtggggtcggccaacggtgagagtgggatgggaggtagtgtctacgtatggtggtactctcgtggaacggggccagttccaccgtatcctccaagacgacaaccgacaagaactcactagtactcgtagacaaatcggaccaacgcctaggaacgtaggtacggaacggacgacggctaggtctaacgtactgtacgaccgaacctataacgtacacttccaaccgttcggtaccgttccgtttacg

SEQ ID NO: 427384 - DNA, 532 bp, Homo sapiens
  misc_feature: GZ8MTXP02GGM1B.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccagccgtggggggtccctgagactctcctgtgcagcctctggattccccttagtgactattggatgacctgggtccgcaggctccgaggggaaggggctgggagtggggtggccaacggtgagagtgggatgggaggtagtgtctactatgtggactcgtctgaagggccgattcacatctcagagacacgcaaagactcactagtatctgacaaatcggaaccagcctgagagtcgaggacacggctagtctactacgtgtcggaccaccataactcactcaccgtggtacgtcgtttacg

SEQ ID NO: 427385 - DNA, 642 bp, Homo sapiens
  misc_feature: GZ8MTXP02GJ4W2.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccagccgtggggggtccctgagactctcctgtgcagcctctggacttccccttagtgactatggatgaccgtggtccgccaggctccgaggggaaggggctgggaggtgggtcggccgaacggtgagagtggggagtgggaggtaggtgtctactagtggtgggtactcgtcgtggaacggggccgtaattcccgacctagtcccgtaccaaggaacgaaccgaaccgaccgaaacggtaaccctacgaccttaggtaactcgtacgactaaaatccggaaccacgtcccgtaggaacggtacggtcggaacgggacgaaccgggtcttcggtacctacgttaacgtcggtacgaccgtaaccctataacgtacctactacccgtaccgtacggttaccgtttcccgtttacg

SEQ ID NO: 427386 - DNA, 536 bp, Homo sapiens
  misc_feature: GZ8MTXP02ISBHR.45.49.E05.1.454.CMB.2.raw
  modified_base (266)..(266): a, c, t, g, unknown or other
  modified_base (441)..(441): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttcctgttgctatttagaaggtgtccagtgtgaggtgcaactggtggagtctgggggaggcttggtccagccgtggggggtccctgagactctcctgtgcagcctntggattccccttagtgactattggatgacctgggtccgccaggctccgaggggaaggggctgggaggtggggtggccaacggtgagatggggatgggagtagtgtctactatggtggactctctggaagggccgattcacctatctccaagacgacacgcaaagactcactgtanctagacaaatgaacccagcctagagagtcgaagacacggctgtctaccgtatgtcgaccgacctaatctacactacaccgtcggtacgtcgttcg

SEQ ID NO: 427387 - DNA, 552 bp, Homo sapiens
  misc_feature: GZ8MTXP02H0QZ4.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccagccgtggggggtccctgagctctcctgtgcagcctctggacttcccctttagtgacttatggatgacctgggtccgccaggctccgaggggagggctgggaggtgggtgcgaacgtgagatggggatggaggtgtgtctacttagtgtggactctcgtaggacgggccgtattccaccatctccagagacaaccgcaaagaactcgactagtatctagacaaatgaccagcctagacgagtcgaggacacgggtctcgttactactacgtcgtcggaccaccataactcaactccaaccggtcggtacgttcccgtttcg

SEQ ID NO: 427388 - DNA, 783 bp, Homo sapiens
  misc_feature: GZ8MTXP02H45UV.45.49.E05.1.454.CMB.2.raw
  modified_base (255)..(255): a, c, t, g, unknown or other
  modified_base (268)..(268): a, c, t, g, unknown or other
  modified_base (283)..(283): a, c, t, g, unknown or other
  modified_base (303)..(303): a, c, t, g, unknown or other
tcagacgcgatcgacacgaccggtgctcgatttagagcgactagcaacacacaaagggggagaaatttggggaggctctgcttcagctggtgggcacaagaggcagcactcaggacaatctccagcatggcctggtctcctctcctcctcactctcctcgctcactgcacgagggtcctgggcccagtctgtgctgacgcacgcccgcctcagtcgtcgtcggggccccagggcaggacggtccacgtatctccngcacgtggggacncacgttaccaaacgngtccgggacctagggtttanacgtacgtcgacctacgtacgaccacgtacctaacgtacgaacgaaccacccgtaacccctaactcctaacctaattaaacaaacgaaacactaccgcccgcccgtacggtaccggtccctacgtaccgtacctcctcccgaccctaccgacgtcccgacctacccgccgtaccgtcccgtaccgtacgtacctacgtacccgtaccggtcccgtaccgtaccggtacggtaccgtacgggacggtacgtacgggtaccggttacgttaacgtttaaccgtttaccgtaccggtaacccggttaccggttacggggtttaaaccgaaacgggttaaacggttaaccgggtttaaccgggggtaaaccgggggtaaaccggggtaaaaaccggttaaaacccggttaaacccggtaacccgggttaccccggttaaacccgggttaccggtaaaaccccggtaaacccgggtaacccccgg

SEQ ID NO: 427389 - DNA, 576 bp, Homo sapiens
  misc_feature: GZ8MTXP02ICEB2.45.49.E05.1.454.CMB.2.raw
  modified_base (305)..(305): a, c, t, g, unknown or other
  modified_base (366)..(366): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggtttccttgttgctattttagaaggtgtccagtgtgaggtgcaactggtggagtcgtgggggagcttggtccagccgtgggggtccctggagactctcctgtgcagcctctggattccccttagtgactattggatgacctgggtccnccaggctccgaggggaaggggctggagtggggtgccaacgtgagatgggatgggaggtagngtctacgtatgtggtacttcgtcgtggaacgggctaagttccaccatctccagagaacacgaccaagaacctcactgtatctgacaatcgaccgagaccgtagacgtacgtcggacggaccgaacgggcttacgggtacctaacttaccgagttcgaccggtaacccagtaactccacttaccgaacgttcggtaacgttccggtttacg

SEQ ID NO: 427390 - DNA, 547 bp, Homo sapiens
  misc_feature: GZ8MTXP02HY9FR.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccaggccgtggggggtccctggagctctctgtgcagcctctggattccccctttagtgactatggatgacctggtccgccaggctccgaggggaaggggctggagtgggtggcgaacgtgagagtgggatggaggtagtgtctactatgtgactctctggagggccgattcacatctcagagacaacgcaagaactacactagtatctagtacaaatgaaccagcctagacgagtcgagacgacgctgtactacgtactcgtcgccgtaaccaataactacctaacttaccgacccgttcgggtacgttccgtttacg

SEQ ID NO: 427391 - DNA, 557 bp, Homo sapiens
  misc_feature: GZ8MTXP02HTPWJ.45.49.E05.1.454.CMB.2.raw
  modified_base (458)..(458): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccagccgtggggggtccctgagactctcctgtgcagcctctggacttccccttagtgactattggatgacctgggtccgccaggctccgaggggaaggggctgggagtgggtggccaacgtgagatggggatggaggtagtgtctacgtatggtggactctcgtgaaacggggcctagttcaccatctaccagagacaacgccaaagactcactgtatctgactaaaancgaccagccgtagacggacgacggacggacgtacggtcgtacgtacctactacgtggtcgaccaacataactacactccaccgtcgtacgtttccgttg

SEQ ID NO: 427392 - DNA, 582 bp, Homo sapiens
  misc_feature: GZ8MTXP02JXZLX.45.49.E05.1.454.CMB.2.raw
  modified_base (289)..(289): a, c, t, g, unknown or other
  modified_base (311)..(311): a, c, t, g, unknown or other
  modified_base (550)..(550): a, c, t, g, unknown or other
  modified_base (557)..(557): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactgggtggagtcgtgggggaggtcttggtccaggccgtggggggtccctggagctctcctgtgcagcctctggacttcccctttagngactagtggatgacctggtccncaggctccgagggaggggctgggagtgggtggaccaacggtgagagtggggagtgggaggtagtgtactactagtgtgggacttctcgtaggacggggccattccactatcctacgagacgacaaaccgccaaagaacctcaacttgacttcagtacaaagtccgaaccacgaccgtaggacgacgtacgggaacgtaccgacggtcttcggtactaaacttcgtgacgaccaacctanaatcacncctaccgtacggacgttcccgttag

SEQ ID NO: 427393 - DNA, 539 bp, Homo sapiens
  misc_feature: GZ8MTXP02JUOCP.45.49.E05.1.454.CMB.2.raw
  modified_base (514)..(514): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccagccgtggggggtccctgagactctcctgtgcagcctctggattcccctttagtgactattggatgacctgggtccgccaggctccgagggaaggggctgggagtggggtggccaacgtgagagtggggatggggaggtagtgtctacgtatgtgggactcgtcgtgaaggggccattcacctatctccagagacaacgccaaagaacctcactgtatctgacaaatgaccagcctgagagtcgaggacacggctgtactactacgtcgtcgcgaccataacncactcaccgtggacgttccgtttcg

SEQ ID NO: 427394 - DNA, 528 bp, Homo sapiens
  misc_feature: GZ8MTXP02JAF6G.45.49.E05.1.454.CMB.2.raw
  modified_base (499)..(499): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccagccgtggggggtccctgagactctcctgtgcagcctctggattcccctttagtgactattggatgacctggtccgccaggctccgagggaaggggctggagtgggtggccaacgtgagatggggatgggaggtagtgtctactatggtgactctctggaagggccgattccgacatctacagagacaacgcaagactcactgtatctgacaaatcgaccagcctgagagtcgagacacggctgtctactactcgtcgcgacataacnctactccaaccgtggtacgtccgtttacg

SEQ ID NO: 427395 - DNA, 541 bp, Homo sapiens
  misc_feature: GZ8MTXP02HXD75.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccagccgtggggggtccctgagactctcctgtgcagcctctggacttcccctttagtgacttatggatgacctgggtccgccaggctccgaggggaggggctgggagtgggtggccaagtgagagtggggatgggagtagtgtctactagtgtggactctcgtaggaacgggctattccacctagtctcgagacgacaacgccaagactcactgtatctgacaatcgaccagcctgagagtcgagacgacggctgtactactacgtgtcgacgaccataactcacttccaacgttcggtactttccgtttag

SEQ ID NO: 427396 - DNA, 563 bp, Homo sapiens
  misc_feature: GZ8MTXP02I9VM2.45.49.E05.1.454.CMB.2.raw
  modified_base (268)..(268): a, c, t, g, unknown or other
  modified_base (426)..(426): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggagcttggtccagccgtggggggtccctgagactctcctgtgcagcctntggacttcccctttagtcgactatggatgacctgggtccgccaggctccgagggagggctggagtgggtggccaaacggtgagatggggatgggaggtagtcggtctactagtgtgggactctcgtggaaacggggccgtaattccaaccctattccnccaaggaacgacaacggccaaaagacctacactgtatctgacaaatcgaaccagcctgaagagtacgaagggacacgggtctacggtctacgtactggtacgcgaccataactcgactcaccgtggacgtccgttcg

SEQ ID NO: 427397 - DNA, 741 bp, Homo sapiens
  misc_feature: GZ8MTXP02FXU7U.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctatttagaaggtgtccagtgtgaggtgcaactggtggagtcgtgggggagcttggtccagccgtggggggtccctgagactctcctgtgcagcctctggacttccccttagtgactattggatgacctggtccgcaggctccgaggggagggctggagtgggtgccaggtgagagtgggatggggaggtagtgttactactagtggtggacttcgtcgttaggaacgggggcctaagtttacccaacccgtaacttcccgtacccgaaacggtaaacgaacccgaaacccgggaacccaaaaggtaaacccttaccaacccgttaaggttaaactccgttaacgggaaacctaaaaagttcccgggaaacccctaaacgggcccccgttaaggagggtaaacgggttaccccggaaaggggtaaccggaaaccggggtccttacgggttaaaccccttaacccgttaggtaccgttacggggaaccccgtaacccttaaacgttaacgtccctaaaacggttcccctaaaaccgggttcgggggtaaaccttttacccgggttttacccg

SEQ ID NO: 427398 - DNA, 849 bp, Homo sapiens
  misc_feature: GZ8MTXP02HS2P7.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgaccttgggttttccttgttgcttattttagaaggtgtccagtgtgaggtgcaacgtggtggagtcgtgggggaggcttggtccagccgtgggggtccctgagactctctgtgcagcctctggtacttccccgtttagtcgtacttagttggtatcgtacccgtggggtcccgcccgagggtccgttacccggaaggggggtaaacgggggtccgttgggggtaaggggttcggggggttaccggggacccggtaaacgggttggggaaagggtaaggttagggggtaagttagggggtaaggggtttaagggttcgggtttacgtttaaaccggttaagttgggggtttacgggtaacctttaccggttcccgtttagggggaaaaccgggggtaccccgttaaacgtttcccgaaacccgttacctttaccgtaacccccgaaaggaaaccggtaaaaccccaaaccgggaaccccaaaaacggtaaacccttaccgtaaccgttaggtttacttaccgttacggaaaccctaaaagtccgaaacccgaacggtcccgtaggtaaagggacgggttaacggaaaccggggtaaccgaaccgggttcgttacgggttacctacgttacgttcggtacggaccgtaaccctattaaaccgtacctacgtacccgtacgttacggtacgtttaccgttag

SEQ ID NO: 427399 - DNA, 676 bp, Homo sapiens
  misc_feature: GZ8MTXP02IM4YI.45.49.E05.1.454.CMB.2.raw
  modified_base (263)..(263): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgaccttgggtttccttgttgctatttagaaggtgtccagtgtgaggtgcagtggtggagtcgtgggggagcttggtccagccgtgggggtccctgagctctctgtgcagcctntggacttccccttagtgactagttggatgaccgtgggtcccgccaggctccgaggggaagggctggagtggggtgccgaacgtgagagtgggagtgggaggtagtgtactacgtagtggtggacttcgtcgtgggaaacggggccgtattaccacctaactcctaccgaagaacgaaaccgaaacccggaccaaaacgtaacctacaacgttacgtacttacctaggtaacctaaaagttacgaaacccgtagtacccgttaggaacggttaacggcggtaaacggggaaccgaccggggtaccgttacggttacccttaaaccgtttaccgttcggttacggaacccgtaacccgtataacgttacctacggttaccctaaccggttcgggtaccgtttcccggtttaacgg

SEQ ID NO: 427400 - DNA, 556 bp, Homo sapiens
  misc_feature: GZ8MTXP02JQGEK.45.49.E05.1.454.CMB.2.raw
  modified_base (556)..(556): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccagccgtgggggtccctgagctctcctgtgcagcctctggacttcccctttagtgactattggatgacctgggtccgccagggcctccgaggggaaggggctggggagtggggtggccaacggtgagagtgggatggggagtagtgtctactatgtggactctcgtggaacgggcctagttccaccattctccaagacgaacaaccgcctaaagaactcgaacttgtaactctgacaaagtcgaacccagcctaggagagtcggagacgcgggtctggtctacactgtcgcgaaccataatcgactcgacctggaccttccggttn

SEQ ID NO: 427401 - DNA, 754 bp, Homo sapiens
  misc_feature: GZ8MTXP02F40NT.45.49.E05.1.454.CMB.2.raw
  modified_base (265)..(265): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagcccgccctcagtcgtcgtcggggccccagggcaggacgggtcaccatctcctgccacgtgggacnctacgttaccaacgtacgtccggggacctaagggtttactggacgttcggtaccctacggttacgggtaacccctaggtaaccctaaaccctttacccggaaacggggtaaaccctaacccggaaccccccctaaaaacttcccctactaaacgttttaaacgaaacgaaaaaccaaaccgtaaacctcccggcccccggacgtaaccgggggtccctaccgaccgtactttcccgcccgtaccctaccgtaaacccggtcccgacctaccctaccgtacccggccccttcccgttacggtacctaccgtccgtaacccgttccgggccttacccgacggggtccttagggagacgttacggacggtactagtactttaagtaccgtcggtaccgtaggttcccgtaacgaaagttacgttaacggttccgggacggtaacgggtaacttaaaccgtcggtaccgtacgtacgggacctaacggacccg

SEQ ID NO: 427402 - DNA, 694 bp, Homo sapiens
  misc_feature: GZ8MTXP02IE0KG.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgaccttgggttttccttgttgcttattttagaggtgtccagtgtgaggtgcaactgggtggagtcgtgggggagcgttgggtccaggtccgtggggggtccctggagctctcctgtgcagcctctggtacttccccgtttagtgacttagttggattcggaccgtcggggtcccgccgacgggtcctaccggaggggggaaggggcgtagggggaggttcgggggtacgggaccgtaaacgggtggaaggacggtggggaacgttggggagggttaggtgttacgttacgttagttgggtacgggtacttccgttacgtagggtaaacggggtccgtaagttcccaacctacttcctacccgaaggaaccgaacgaaacccggcaaaacggaaccttacacgtagttactccgtagaactaaagtcgaacccagtacccgtaggagtcgggtacgagggaccacgggtctcgtcttaactcgacggtcgacctaaccattaactacaactacccgtacgttacgggtaccgtttcccgtttagg

SEQ ID NO: 427403 - DNA, 622 bp, Homo sapiens
  misc_feature: GZ8MTXP02GV54A.45.49.E05.1.454.CMB.2.raw
  modified_base (263)..(263): a, c, t, g, unknown or other
  modified_base (274)..(274): a, c, t, g, unknown or other
  modified_base (356)..(356): a, c, t, g, unknown or other
  modified_base (408)..(408): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtcgtcgtcggggccccagggcaggacgggtccaccatctcctgcacgtgggancagttccaacngtccgggacctaggttatgctcgccacgtcggtacagacaaccgtcgaagaaccaccgaccccctaaatcctacctattaanaacgaaacaacactcccgcccgcgtacgggtcccacgaccgtactccgcccnccctaccgaaccgtcccgacctaccctccgacgtcccctccgtcggtacctacgtccgacgtccggaccctacgaggcctaggacggagtcggacgggtctacgtagtttactacgtcgtaccgtacggttcgtaaccggaagtacgttacggtaccggggacggttaacggaacgtaaacgtcggtaccgtacgtacgaccgtaccgacccgg

SEQ ID NO: 427404 - DNA, 747 bp, Homo sapiens
  misc_feature: GZ8MTXP02INL17.45.49.E05.1.454.CMB.2.raw
  modified_base (275)..(275): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacgagggtcctgggcccagtctgtgctgacgcacgcccgcctcagtcgtcgtcggggccccagggcgaggacgggtccacccatcctccgtcgccgacgtcggggacnccgtacggttacccaacgtacggtccggggaccgtaagggtttagtcggtacgttcggtacccgtacgttaccggtaaccaacggtacctaaaacccgttaccgaaacggaaacccaacccgaaaccccctaaaaccttccctaactaaactttaaactaaacgaaaacctaaactaaccgtcccgcccgacgtaccggggtccctacggaccgtactccctcccgaccctacccgaaccggtcccgacctacccgtaccgacccgtcccttcccgtacggtaccactaccgtaccgtccggtcccgtacccgaggtcgtagggaacggtcgtacggtacggtctaacgttatttacgtacgtcgtacggtacggttaccggtaacgaaagttacgttacggttacgggaacgggtaacggtaaacgtaaccgtaccggtacccgtacgtacggtaccgtaccgtaacccgg

SEQ ID NO: 427405 - DNA, 617 bp, Homo sapiens
  misc_feature: GZ8MTXP02HQ3HJ.45.49.E05.1.454.CMB.2.raw
  modified_base (276)..(276): a, c, t, g, unknown or other
  modified_base (480)..(480): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaacgtggtggaggtcgtggggggaggtcttgggtccagccgtggggggtccctggagactctcctgtgcagccctntcggtacttccccctttagtcgacttagttggatcgaccgtggggtcccgcccgagggcctccgaagggggaacggggcgtggggaggtggggtcggaccaaacggtgaggagtggggagtgggaggtagtgtctactagtgtgactctcgtggaacgggccgtattccgacctactctacagaacgacaacgacaacgaaacncgtactgtatctagtacaaatcggaccagcccgtaggaacgcggtacgaagggtaccgacggtcgtacgttactactacgtcggtacggcctaaacctataacgtacaacgttccaacgtcggtacgttccgtttcg

SEQ ID NO: 427406 - DNA, 764 bp, Homo sapiens
  misc_feature: GZ8MTXP02HHMYI.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaacgggtggagtcggtgggggaggtcgttggtccgacggtccggttcggggggtccctggacgtaccttccttccgtgtcgcacgcctcgtcggtacctttccccgttagtcgtacttagttggatcgtaccgtcgggtcccgccgacggtccgtaccggaaggggaaggggcgtaggggaggttggggtcggaccgtaacggtaggaaggtaggtaggggagtaggggtaaggttaggttcgttacgttaacgttagttcgggttacggtaccttcgttacgtacgggaacggggtaccgtacttaccaccctacgtccctaccgaacgaacgaaaccgaaacccgaaccaaaacgaacctaccgtaacgttagttaactcctacgtaacgtaaagtaccggaacccgacgtccgtaggaacggtaacggtaccggaaacgggacccgaccgggtaccgttacggttaccttaaccgtacggttacggtaccggacccgtaacctaagttaacgtacctaaccgttacccgtaccggttcgggtacccgtttacccgtttacg

SEQ ID NO: 427407 - DNA, 839 bp, Homo sapiens
  misc_feature: GZ8MTXP02F41IY.45.49.E05.1.454.CMB.2.raw
  modified_base (277)..(277): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacgagggtcctcgggcccagtctgtgctgacgcacgcccgccctcgagtcggtcgtcggggccccgagggcgaggacggtccaccattccctccgtgccacggtgggacncctacgttacccaacgcggtccgggaccgtaaggtttatacggagttccgtaccgtacggtaccgtaaccgacgtaacctaaccgttaccgaacggtaaacccaaccccgtaacccctaaacctccgttaacctttaaactttaaacgaaaaccgtaaaacctaaccgtaaaccccgttccccgggacccgggtaccgggtaacccgggggttaccctaccgggtacccgttaccgttacccctccccggtacccgttacccggacccggtccccgtaccgtaccccgtccgtacccgtcccccgttccgtaccggtacctaccgtcccgtaaccggttcccgtacccgtaccggtacggtaccgtaagggtacggtaaccggtcgggtaacggtacgtttacgttaactttaaccgttccgtaccggtacccgttaagggtacccgttaaaggtaacgttaaacgtttcgggtaaccggggtaacgggtaaaacggttaaccgtaaaccgggtaccgttaccccgggtaacgtaaccgggtaaccgacccgggtaacccgg

SEQ ID NO: 427408 - DNA, 695 bp, Homo sapiens
  misc_feature: GZ8MTXP02GWS7K.45.49.E05.1.454.CMB.2.raw
  modified_base (608)..(608): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtgagtcgtgggggagtcttggtccaggcgtcgggggtccctgagactctcgtgtgcacgcctcgtcggtactttccccttagtgacttagttggatcgaccgtcgggtccgccgacgggtcctaccggaagggggaagggtcgtagggtaggtcggggtcggacccgaaggttggagtagtggggtaatggggaggtacgtggttacctaagttagttggtcgtacttcgttacgtagggtaacgggtccgtacctttcgaaaccctcgttccctaacgaaggaactaacccgaaacccggtaactaaaggaaccctcgaaccttagtaaacggtcctggaaaccttaaacgtcggaacccacgggccttaagggacgaacgggttacggacgggtaaaccnccgggtactacgttactaacgttacgcgtaccgaaccactataacctacgaacttcccggtaccgttagggaccctttcccggttta

SEQ ID NO: 427409 - DNA, 699 bp, Homo sapiens
  misc_feature: GZ8MTXP02FIGWM.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggagcttggtccagccgtggggggtccctgagactctcctgtgcagcctctggacttccccttagtgactattggatgacctggtccgccaggcctccgaggggaaggggctgggaggtggggtggccgtaaacggtgagagtggggatggggaggtagtgtctactatgtgggacttctgtaggaacggggcccgatttcccaaccgtacttcctcccgaaggaacgaaacccaaaccgggacccaaaacggaacctacccaaccttggtaactctaggaaccaaaagttccgaacccaacggccccttagggaaacggtacggtaccgggaaacggggtacccgaaaccgggggcctttacgggttacccttaaaccgttaaccgttcgggttaccggtacccggaaccccctaaagttaacgtaccctaacgttacccgtacccggttacggggtaaccggttccccgttttaaccgg

SEQ ID NO: 427410 - DNA, 770 bp, Homo sapiens
  misc_feature: GZ8MTXP02H69Q4.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgaccttgggttttccttgttgctattttagaaggtgtcagtgtgagtgcaactggtggagtcgtgggggagtcgttggtccagccgtgggggtccctggagactctcctgtgcacgcctcgtggtacttccccgtttagtgtacttagttggattcggaccgtcgggtccgccgaggcctaccggaaggggaaggggcgtgggaggtggggtacggaccgaaacggtggaagtaggtggggaagtggggtaacggttagtgttactacgttagttgtacgggtacttcgtacgttaggaaacggggtcctacgttacccacctagttcccgtaaccgaacggtaacgaaacccgtaaaaccgacccgaaaacgtaacccttaccgtaaacgttacggttacttaccgttaacgggtaacctaaaaacgttccggaaaacccgtacggtacccgttaagggaaggtaacgggtaccgggaacgggaacccgtaaccgggttccgttaacgggtttacccttaaaccgttaacggttcggtaccggtaccgtaaccgtaaacgttaaccgtacctaaacgttcccgtaaccggttcgggttaccggtttacccggtttacgg

SEQ ID NO: 427411 - DNA, 633 bp, Homo sapiens
  misc_feature: GZ8MTXP02HK7CF.45.49.E05.1.454.CMB.2.raw
  modified_base (249)..(249): a, c, t, g, unknown or other
  modified_base (265)..(265): a, c, t, g, unknown or other
  modified_base (292)..(292): a, c, t, g, unknown or other
  modified_base (533)..(533): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacgagggtcctgggcccagtctgtgctgacgcacgcccgccctcagtcgtcgtcggggaccccagggcaggcggtcaaccgntctcctgcagtgggancacgtccaagcgtcgggactaggttangtatcgtacacgtcggtacagacctaaccttacgaacgaaaccaccgaccccaaacttcctacctaactttaagaaacaaaacctaacgaacgtcccgaccccggacgtacggggtacccacggtaccttactcccgttacccgacccgttaccgaaccggtcccggactaccctcgaccgtccctccgtacgtcactctacgtccgctacgtgacgtgaacgtgtcggaacggtctagtnttaacgtcgcgtaacgtcgtaccgtaagaacgttcgtacggggttccggaacggggtaactaaaccggctaacccggtcgtaaccgcgaccgaccgacgg

SEQ ID NO: 427412 - DNA, 543 bp, Homo sapiens
  misc_feature: GZ8MTXP02FXFER.45.49.E05.1.454.CMB.2.raw
  modified_base (307)..(307): a, c, t, g, unknown or other
  modified_base (443)..(443): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttcctgttgctattttagaaggtgtccagtgtgaggtgcaactggtggagtcgtgggggaggcttggtccaggccgtggggggtccctgagactctcctgtgcagcctctggacttccccttagtgactatggatgacctgggtccncaggctccgaggggaggggctgggagtgggtggccaacgtgagagtggggatgggaggtagtgtctaacgtatggtggactctctgaagggccgattcaccatctccagacgacaacgcaaagaactacactgtanctgacaaatcgaccagcctagacgagtccgaggacacggctgtactactacgtgtacgaccacctataactcaactccaaccgtggacgttcccgtttag

SEQ ID NO: 427413 - DNA, 589 bp, Homo sapiens
  misc_feature: GZ8MTXP02FNQLI.45.49.E05.1.454.CMB.2.raw
  modified_base (354)..(354): a, c, t, g, unknown or other
  modified_base (473)..(473): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggaggcttggtccagccgtggggggtccctgagactctcctgtgcagcctctggacttccccttagtgactattggatgacctgggtccgccaggctccgaggggaggggctggaggtgggtggccaacggcgagntggggatgggaggtagtgtctaactatggtggactcgtctaggaaggggccgatttccacctatctaccagacgaacaaccgaccaaagactcgaactagtactctgacaaatgaaccngcctaggacgtaggtacgagggaaccaccggggcttcgttactaccgttaacgtcgttacggacccgaactaactaacgttacacgttacccacgttggtaaccgtttcgtttacg

SEQ ID NO: 427414 - DNA, 585 bp, Homo sapiens
  misc_feature: GZ8MTXP02FJEXH.45.49.E05.1.454.CMB.2.raw
  modified_base (208)..(208): a, c, t, g, unknown or other
  modified_base (231)..(231): a, c, t, g, unknown or other
  modified_base (256)..(256): a, c, t, g, unknown or other
  modified_base (266)..(266): a, c, t, g, unknown or other
  modified_base (281)..(281): a, c, t, g, unknown or other
  modified_base (333)..(333): a, c, t, g, unknown or other
  modified_base (336)..(336): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctnagtgtctggggccccagggcagnggtcaccgatctcctgcactgggancagttccaanatcgggacaggttangatgtccatggtaccagcactccaggaacacgccccaaatcctactatttanaanaaacaacaactccgccccgcgacgggggtccctcgacccgtatttccgcccgtaccctccgaaacgtcccggacacccgtaccacgcccttcccgtcggtcctactccacttcggcctccgacggcctaggagatggaggctgacttatacgtcgtaccgtagtccgtacgaaagtacgttagttaccgggacggaacgggtaacctaaacgtcggtacccgtaccgttacggtaccgaacgtaccccg

SEQ ID NO: 427415 - DNA, 615 bp, Homo sapiens
  misc_feature: GZ8MTXP02FXV58.45.49.E05.1.454.CMB.2.raw
  modified_base (324)..(324): a, c, t, g, unknown or other
  modified_base (447)..(447): a, c, t, g, unknown or other
  modified_base (501)..(501): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgaccttgggttttccttgttgcttattttagaaggtgtccagtgtgaggtgcaacgtggtggagtcgtgggggagcgttgggtccaggccgtggggggtccctgagctctctgtgcagcctcgtggtactttcccctttagtgacttagttggatcgaccgtcgggtcccgccnggcctccggaggggaacggggctggggaggtggggtcggaccgaaagtgagagtgggagtgggaggtagtgtactagttagtgtggtactctcgtaggggaacgggtccgtacttaccacctntcctaccgagaacgaaccaccgaccaaacgactcactgtatcgtacgataaacncgaaccacggccgtaggaacgtacggacggaacgacgacggtcttgtaccttaacgtctggtaccgaccgaactataacgttacactcccgtaacgtggtaccgtttccgttag

SEQ ID NO: 427416 - DNA, 696 bp, Homo sapiens
  misc_feature: GZ8MTXP02JTUEO.45.49.E05.1.454.CMB.2.raw
  modified_base (263)..(263): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcacgcccgccctcagtgtcgtcggggccccagggcaggaggtcacctatcctcctgcacgtgggancagttccgaacagtccggacctaggttatgatcgtccacgtggtaccagacctaacgttcccgaaggtaaccaccgaccccccaaactccctactaactttaacaacgaaaactaaacgaacgtcccgcccccggacgaaccgggggttcccctacgacccggtacttacccgtccccgacccttacccgaaaccggtcccggtacccaccccgtacgtacccggcccccttcccggtacggtccctacgtaccctaccgttcccggcccgttacccgaacgggtccgttacgggacggtaagtcgggacggtccgttagtaactttacgttacgtcgtcgtacgttggaccgtaaaggtacttacgtcgggaacgggtacggtaaccgtaacgtacgggtacccgtacgtaaccggtacgaccggtaacccg

SEQ ID NO: 427417 - DNA, 590 bp, Homo sapiens
  misc_feature: GZ8MTXP02F9JIC.45.49.E05.1.454.CMB.2.raw
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggagcgttggccagccgtggggggtccctgagactctcctgtgcagcctctggacttccccttagtgtactattggatcgacctggggtccgccagggcctccgaggggaaggggtcgtgggaggtggggtcggaccgtaaacggtgaggagtaggggagtggggaggtagtcgtactacgtatggtggtactcgtcgtaggaacgggtccgtattccgacctatcctcagagacaacgaccaaagactcacgtagtatctagactaaagtcgaacctacgcctaggacgtaagtcggaggaccgcggtactcgtactactcgtagtcggaccaacctataacgtcactccgaccgtggtacctccgtttag

SEQ ID NO: 427418 - DNA, 621 bp, Homo sapiens
  misc_feature: GZ8MTXP02G7TVL.45.49.E05.1.454.CMB.2.raw
  modified_base (345)..(345): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggttttccttgttgctattttagaaggtgtccagtgtgaggtgcaactggtggagtcgtgggggagcgttggtccagccgtggggggtccctgagctctcctgtgcagcctctggacttcccctttagtcgacttattggatgaccctggggtcccgccagggtcctccggaggggaaggggcgtgggnggtggggtggaccgaagtgagagtgggagtggaggtgtgtctactatggtgactctcgtggaacggggccgtattccaccgtatccgtacccgagacgaacaaccggaccaaagaacctcacgttgacttctaggacctaaaatcgaaccacgtaccgtggaacgacggtcggaacgggtaccaccggtacgtaccgttatacccgttagtcggtacgacccgtaccaagttaactctaactaccgaccggtacggtacgtttaccccgtttacgg

SEQ ID NO: 427419 - DNA, 566 bp, Homo sapiens
  misc_feature: GZ8MTXP02FK7W4.45.49.E05.1.454.CMB.2.raw
  modified_base (380)..(380): a, c, t, g, unknown or other
tcagacgcgatcgacacgaccggtgctcgatttagagcgactagcaacacacaaaggggggagaaatttggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcaccatctcctgcactgggagcagttccaacatcgggacaggttatgatgtccactggtacagcaacttccaggaacacgccccaaactcctcatttataagaaacaacaatcgcccgcgacggggtccctgaccgtatctcccncctccaacgtccgcacctcacgccctccctggtcactcactcggccctcccgaaggcctaggacgtagtcgaggctagattaattacgtagacctagtacgtacgaaaagtacgttacgttacgggcggaaaggggtaacctaaaacgtcgtaacccggtaccgtacggttaccacggaaccccgg

SEQ ID NO: 427420 - DNA, 641 bp, Homo sapiens
  misc_feature: GZ8MTXP02G4VGX.45.49.E05.1.454.CMB.2.raw
  modified_base (305)..(305): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctggttttcctgtgctatttagaggtgtccagtgtgaggtgcaactggtggagtcgtgggggagcttggtccagccgtgggggtccctgagctctcctgtcgcagcctgtggacttccccttagtgacttagttggatggaccgtgggtccnccaggcctccggaaggggaaggggcgtgggaggtggggtcggaccgtaacggtgagagtgggagtgggaggttagtgttcgtacgttagtggtacgtacttcgtcgtagggaacggggcctacgttccaccgtactaccctcgaagaacgtaacaaccggaactaaacggaactcacgttagtataccgagtacaaacgttcgaacccacgtccgtagagtcggtacggaacggtaccgacggtacgttacggtaccttaaccttacggtcgtaccgaccgtaaacttagtaacgtacctaacgtacctacggtcggtaaccgtttcgtttaacgg

SEQ ID NO: 427421 - DNA, 752 bp, Homo sapiens
  misc_feature: GZ8MTXP02HOK3A.45.49.E05.1.454.CMB.2.raw
  modified_base (250)..(250): a, c, t, g, unknown or other
  modified_base (321)..(321): a, c, t, g, unknown or other
  modified_base (350)..(350): a, c, t, g, unknown or other
  modified_base (376)..(376): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgaccttgggttttccttgttgtcttattttagaaggtgtccagtgtgaggtgcaactggtggagtcgtgggggagcgttggtccagccgtgggggtcccnggagtactctctgtgcacgcctctggacttcccctttagtgtacttagttggatcgtaccgtcgggtcccncgacggctccggaggggaggggcgtgggnggtggggtcgccgaaggtggagtagngggtagtcgggaggtgtgttcttaacgtagtggtaggtactcgtacgtagggaacgggtccgtatcctaacgcttaccgtacccgaaggaacaaacccgaaacccgaaccgtaaaacgtaacctaccgtaacgttacggttaacttaccgttacggaaaactaaaacgttcgaaacccccgttacgtacccgaagggtaaacggtcggttaaccgggaaaccgggtacggaaacccgggttcgttacgggtttacctaaacccggtttaacgttcgggtaaccaacccggttaaacctacgtttaaaaccgttccccgtaaacttacccccgtaacgggtttcccggggtaaacccgttttcccggttttaaccgg

SEQ ID NO: 427422 - DNA, 607 bp, Homo sapiens
  misc_feature: GZ8MTXP02I5JS5.45.49.E05.1.454.CMB.2.raw
  modified_base (485)..(485): a, c, t, g, unknown or other
  modified_base (495)..(495): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggtttccttgttgctatttagaaggtgtccagtgtgaggtgcaacgtggtggagtcgtgggggagtcttggtccagccgtgggggtccctgagactctcgtgtgcagcctcgtggtacttccccttagtcgtactagttggatggaccgttcgggcccgtcgagggcctaccggaaggggaaggggcgtggggtaggtggggtcggacccgtaaacggtggaacgtaggtggggatggggaggttacgtgttactacttagtggtcggacttcgccgtagggaacggtccgtacttcgacctatcaccgagacgacacgacagtaaccncgatgtactnacgataatcgacagcgagacgacggtcgagacgacggtcttacgtcctacgtacgtcggtaccgaccgtactaatccgtactacgtaccgtacgtcggtaccggtttccgta

SEQ ID NO: 427423 - DNA, 576 bp, Homo sapiens
  misc_feature: GZ8MTXP02JJPEJ.45.49.E05.1.454.CMB.2.raw
  modified_base (209)..(209): a, c, t, g, unknown or other
  modified_base (255)..(255): a, c, t, g, unknown or other
  modified_base (283)..(283): a, c, t, g, unknown or other
  modified_base (324)..(324): a, c, t, g, unknown or other
  modified_base (365)..(365): a, c, t, g, unknown or other
  modified_base (434)..(434): a, c, t, g, unknown or other
tcagacgcgatcgacacgaccggtgctcgatttagagcgactagcaacacacaaagggggagaaatttggggaggctctgcttcagctgtgggcacaagaggcagcactcaggacaatctccagcatggccctggtctcctctcctcctcactctcctcgctcactgcacagggtcctgggcccagtctgtgctgacgcagccgccctnagtgtctgggccccagggcagaggtcaccatctcctgcactgggancagttccaacagtcgggaactaggttangatcgtccacgtgtaccaggtccaacgtttccgaggaaccncgacccccaaactcctacctatttacacgaaacacacgtcncccgacgacggggtcccttgaccgtacgtcctccgcctacaacggtcccgcaccttcacgcccttccgngtaccacgttccactcggccttcgagtcctgggacgattgacggtctcgtattataaacgtgacctagtcacgaaagcttaaacgtccggaaggacggtaacaaaccgttcgggaacccgtccgtaggtaccaacggtcccg

SEQ ID NO: 427424 - DNA, 717 bp, Homo sapiens
  misc_feature: GZ8MTXP02GCZWV.45.49.E05.1.454.CMB.2.raw
  modified_base (213)..(213): a, c, t, g, unknown or other
  modified_base (269)..(269): a, c, t, g, unknown or other
  modified_base (281)..(281): a, c, t, g, unknown or other
  modified_base (296)..(296): a, c, t, g, unknown or other
  modified_base (315)..(315): a, c, t, g, unknown or other
tcagacgcgatcgacacgaccggtgctcgatttagagcgactagcaacacacaaaggggggagaaatttgggggaggctctgcttcagctgtgggcacaagaggcagcactcaggacaatctccagcatggcctggtctcctctcctcctcactctcctcgctcactgcacgagggtcctgggcccagtctgtgctgacgcacgcccgccctnagtcgtcgtcggggccccagggcaggagggtccacctatctccgtgcacgtggganctacgtacaacngtccggactaggtangatcgtaccacgtgtacanacctactaccgaggaccaccgaccccaatcctactattaacaacgaaaactacaacgtccgtccccggacgaccgggggttaccctaacgtaacccgttacgtttcccgtaccccgtacccgttaccgtaaacccggtacccggtaccctaccccgtacgtaccccgtcccccgttcccgttaacggttaccaccgttcccgaaaccgtttcccgggaccctttacccggaagggtccctaaaggggtacgtaaaccggtggtaacggttccgttaaggttacttaaccgtttacgaccgtaccggttaggtaccgtaacggtaaagtcgttaccgggtacgggaacgggtagtaaaccttaaacggcggttacccgtacgtacggtccgaacgtaccccgg

SEQ ID NO: 427425 - DNA, 626 bp, Homo sapiens
  misc_feature: GZ8MTXP02I4EGV.45.49.E05.1.454.CMB.2.raw
  modified_base (341)..(341): a, c, t, g, unknown or other
  modified_base (451)..(451): a, c, t, g, unknown or other
  modified_base (591)..(591): a, c, t, g, unknown or other
tcagacgcgatcgacacgaccggtgctcgatttagagcgactagcaacacacaaagggggtctcagagaggagccttagccctggactccaaggcctttccacttggtgatcagcactgagcacagaggactcaccatggaattggggctgacctgggtttccttgttgctatttagaaggtgtcagtgtgagtgcaactggtggagtcgtgggggacggtcttggtccagccgtggggggtccctgagactctcctgtgcagcctcgtggacttccccttagtcgtactagttggagtgaccgtcgggtccgccgagcctcggaggggaggggcgtgggnggtggggtggaccgtaaggtgagaggtcggggagtgggaggttaggtgtcgtacgtagtggtgggtactcgtacgtggtacggggcgtataccactactcctacgagaanaacgaccgaccaaacgactacctagtacgtctactagtaacaagtacgaacctacggaccgtaggaggtaacgggtacgaacggacgaccggtactcgttaccgtactacgtcggtacgaccgaccgtaataacccttanaccgtaccgtaccgttacggtacgttacgtttacg

SEQ ID NO: 427426 - DNA, 501 bp, Homo sapiens
  misc_feature: GZ8MTXP01DF2GA.39.20.B09.1.454.CMB.2.raw
  modified_base (252)..(252): a, c, t, g, unknown or other
  modified_base (332)..(332): a, c, t, g, unknown or other
  modified_base (378)..(378): a, c, t, g, unknown or other
  modified_base (386)..(386): a, c, t, g, unknown or other
  modified_base (392)..(392): a, c, t, g, unknown or other
  modified_base (414)..(414): a, c, t, g, unknown or other
  modified_base (417)..(417): a, c, t, g, unknown or other
  modified_base (455)..(455): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagcccacgctcagtgtccgtgtccccaggacagacagccagcatcacctgctctggaaatacattagganataaatatgcttgctggtatcagcagaagcaggccagtcccctgtgctgatcatctatcaaagataccaagcggcccctnagggatcccctgagcgattctctggctccaactctgggaaacacanccacttcnaccaancgacggccggaccgagactagnganagaagtctagtactattaattgttgtaggttgacgganagcgaggaaggtaagggtcggtcgggacgggacggaacgaacgtcg

SEQ ID NO: 427427 - DNA, 571 bp, Homo sapiens
  misc_feature: GZ8MTXP01EL8YO.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtcgctgatcatctatcaagatacccaagccggccctgagggtactcccgtgacgctattctctgctacactcgtaggaacacacgccactctacgacactcggacgccgggacccagggacctagtgagtagaacgtcgtacgtaacttagttaattcggttacggtaagggtttgggtacggggtaaccgacggcgaagggtaaccggggtaaaagggggtttcgggttacgggggaccgggttaacgggggaaccccgttaaaggttccccggg

SEQ ID NO: 427428 - DNA, 551 bp, Homo sapiens
  misc_feature: GZ8MTXP01CMNL9.39.20.B09.1.454.CMB.2.raw
  modified_base (251)..(251): a, c, t, g, unknown or other
  modified_base (443)..(443): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattagganataaatatgcttgctggtatcagcagaagccaggccagtcccctgtgctgatcatctatacaagactaccaaggcccgccctcgaggactcccgtgacgcgtattcctcgtcggcctaccaactcgtacgggaaaccacacgcccacttcacgacccatccgggaacgccggggaacccagggtcctaaggnggaagtagactcgtagtaacttagttaacgttggacgtagggttcggtacgggacacggcgaggaacgggtaaggggtcggtacgggacgggaacgtaacgaacgtcg

SEQ ID NO: 427429 - DNA, 706 bp, Homo sapiens
  misc_feature: GZ8MTXP01CAMPP.39.20.B09.1.454.CMB.2.raw
  modified_base (248)..(248): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtcccaggacagacagccagcatcactgctctggaaatacattagganaataaatatgctgctggtatcagcagaagcaggccagtcccctgtgctgatcatctagtacaagataccaagccggaccctcgagggactccccgtagacgtcttaattcctcgttcggaccttacccaaacgttccgtaacggggaaaccaaccaacggaccccaaaccttcctacggaacccaacgttacccgggaacggggtaccccgggggaaacccccgagggtacccgtttaagtacgggggaactttaacgggaaaagggtcccttaacgggtaaacgtttaaattttaaacggttttcgggttacggttaaagggggtttcgggtaagggggaaacccgttaagggttacccggttaaacggggaacggggtaaaaaggggggttcggtttaaccggggggaccgggggttaaaccgggggtaaaccccgttaaaagggtaaccccgggg

SEQ ID NO: 427430 - DNA, 544 bp, Homo sapiens
  misc_feature: GZ8MTXP01B7L8J.39.20.B09.1.454.CMB.2.raw
  modified_base (296)..(296): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccacgtccccngtgctgatcatctatcaagactaccaagccggaccctgacgggtactcccgtagacgcgacttcctcgtcggcctaccaactcgtacgggaacacgacgacccactcctgaccatccggacggccgggacccaggctaagtggataggaatcgtagtacttattaattcgttcgtaggttggtaggacaggcgaggaacgggtaaaggggtcggttaccggggacgggttacgggaaccgaaggtccg

SEQ ID NO: 427431 - DNA, 506 bp, Homo sapiens
  misc_feature: GZ8MTXP01ARW1C.39.20.B09.1.454.CMB.2.raw
  modified_base (358)..(358): a, c, t, g, unknown or other
  modified_base (455)..(455): a, c, t, g, unknown or other
  modified_base (468)..(468): a, c, t, g, unknown or other
  modified_base (491)..(491): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtcgctgatcatctactcaaagactaccaagccggccctgacgggatcccgtgacgcgattcnctggcctccaactcgtagggaacacacgccactctacgaccatcgacggccgggaacccagggcctagtcggatagaacgtctgactattaatgttnaggttgtgggacngcagaacgaaggggtcgtcgggngggaggaaccaagcg

SEQ ID NO: 427432 - DNA, 739 bp, Homo sapiens
  misc_feature: GZ8MTXP01EYA50.39.20.B09.1.454.CMB.2.raw
  modified_base (177)..(177): a, c, t, g, unknown or other
  modified_base (191)..(191): a, c, t, g, unknown or other
  modified_base (341)..(341): a, c, t, g, unknown or other
  modified_base (458)..(458): a, c, t, g, unknown or other
  modified_base (681)..(681): a, c, t, g, unknown or other
tcagtcgcactagtcacgaccggtgctcgatttagtgtagtgtgaagggttgagaacctatgaacattctgtagggcctcaggaagcagcatcggaggtgcctcagccatggcatggatcccctctcttcctcggcgtccttgcttactgcacaggatccgtggcctcctatgagcntgtctcacgaccgntaccgacgttcgtaccggttcggtcccccgtacggtaccccaaggaaccacgaccagcccagtccacctcgacctcgtacgtaaactacgaaataacggaagtaagtaaagtaataagtacttggtcgttggtactcgtagtacgaacgncaaaggacccgacggacccggaccgtacccgtccccgttggtcgtcgtacgtactactactactactaaaccgaaagtaacctaaacccgaccggcccggtcccgtaccggaacggngacgtacccgtacggtacgtaccgtacgttacgtccgaaccgtaccgttacccgtaaccgtaaccgtacggtaaccgacccgtcaaccgtacccctaccgtacccgtacgtacccgaaccgtaccgggtaacccgtacggggaccccggtaacggtcggtaaacgttcgggtaaacggttacgttaaacggtcaaacggttaaccgtttaacgttttaacggnttaaccggttacgggttacggggtttacggggttaaccggggttaaccggtaaccggg

SEQ ID NO: 427433 - DNA, 516 bp, Homo sapiens
  misc_feature: GZ8MTXP01EIKQV.39.20.B09.1.454.CMB.2.raw
  modified_base (422)..(422): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagccggccctgagggctccccgtgagcgtattctctggctccaactcgtacgggaacacgagcccactctgaccactacgacggccgggacccaggcctagnggactgaagtctagtacttgttaattgttcgaggttggtagggacaggcagggcgaaaggggtcggtacgggcgggacgggaaccgaaggtccg

SEQ ID NO: 427434 - DNA, 513 bp, Homo sapiens
  misc_feature: GZ8MTXP01A1AO2.39.20.B09.1.454.CMB.2.raw
  modified_base (426)..(426): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctactcaagactaccaacgccgccctgagggactcccgtgacgcgtattctcgtggcctaccaacttcgagggaacacacgccactctacgaccatccgacggccgggacccaggctagnggatagaagtctagtacttattaattgcgaggttgtaggacagcgaggaacggaaggggtcgtcgggacggacggaacgaaggtccg

SEQ ID NO: 427435 - DNA, 504 bp, Homo sapiens
  misc_feature: GZ8MTXP01DQ2XY.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagcccggccctcgagggactccctgagctattctctgctccaactcgtagggaacacacgccactctcgaaccatcgacggccggggacccaggcctaagtggatgaagtctagacttagttaattgcgaggttggtggacagcaggcgaaaggggtcgttcgggcggagggaaccgaagtccg

SEQ ID NO: 427436 - DNA, 496 bp, Homo sapiens
  misc_feature: GZ8MTXP01BG8M6.39.20.B09.1.454.CMB.2.raw
  modified_base (432)..(432): a, c, t, g, unknown or other
  modified_base (455)..(455): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagagccaggccagtcccctgtgctgatcatctatcaagataccaagccggccctgacgggactccctgacgcgattctctgctcaacgtctagggaacacacgccactctgaccatcggacgcgggacccaggctagtcggatgaagtctagtacttnttaatgttcgaggttgtaggacngcaggcgtaaggggtgttcgggcgggttacggcgaagtccg

SEQ ID NO: 427437 - DNA, 479 bp, Homo sapiens
  misc_feature: GZ8MTXP01EKGMQ.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagcgccctgagggactccctgagctattctctgctcactctgggaacacagccactctgaccatcgagcggaccaggctatggatgaagctagactattaattgttcaggttgtgggacagcagcgaaaggggtcgttcgggcggagggaaccgaagccg

SEQ ID NO: 427438 - DNA, 521 bp, Homo sapiens
  misc_feature: GZ8MTXP01EDAZF.39.20.B09.1.454.CMB.2.raw
  modified_base (341)..(341): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagccgccctcgagggactcccngagcgattctctggctaccactcgtagggaaacacacgccactctcgaccagtcgacggcgggacccagggcctagtcggatagaagtctagtacttattaattgttcgtagggttgtagggacgagcgaaggtcgaaagggggtcggttacgggcgggaacgggtaaccgaaggtcccg

SEQ ID NO: 427439 - DNA, 560 bp, Homo sapiens
  misc_feature: GZ8MTXP01C9OBS.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattaggagataaatatgcttgctggtatcagcagaagccagccacgtcccctgtgctgatcatctaactacaagactaccaagcccggaccctcgagggactcccgtagacgcgtattctctgcctaccaactcgtagggaacacgacgacccacttccacgaaccactccggaacgggacccggggaacccgaggacctaagtggatagaacgtctagtaacttagtttaagttgttcgtagggttggtacgggaacacggcgaaggtaacgggaaaggggtcggtacggggacgggacgggtaaccgaagtccgg

SEQ ID NO: 427440 - DNA, 541 bp, Homo sapiens
  misc_feature: GZ8MTXP01DA05F.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcacctgctctaggaaatacattaggagaataaatatgcttgctggtatcagcagagccaggccagtcccctgtgctgactcatctaactcaaagctaaccaagcccggccctgacgggtactccccgtagacgtcgtacttctcgtgcctaccaactcgtacgggaaacacacgcccactctacgaaccacgtcggaacggccgggacccaggctagtgatagaagtctagtacttattaatgttacgtggttgtagggacaggcgaggtaacggaaaggggtcggtacgggcgggacggtaaccgaaggtccg

SEQ ID NO: 427441 - DNA, 578 bp, Homo sapiens
  misc_feature: GZ8MTXP01AXQVH.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattaggagataaatatgcttgctggtatcagcagaagccaggccagtcccctgtgctgatcatctatcaagataccaagccgccctgagggactccctgagcgattctctggctccaactctagggaaaccacgagcccaactctacgacctacgtacgacggccggggaccccagggcctaagtcggaagtagaaagtccgtagtaaccttaagttaatttcggttaccgtaagggttggtacggggtaacacgggccgaagggtaaccgggtaaaaggggggttcggtttaccgggggacggggttaacgggggtaacccgaaagggttcccgg

SEQ ID NO: 427442 - DNA, 629 bp, Homo sapiens
  misc_feature: GZ8MTXP01BBZRK.39.20.B09.1.454.CMB.2.raw
  modified_base (250)..(250): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcactgctctggaaatacattagganataaatatgacttgctggtatcagcagaacgccaggccacgtcccctgtcgctgatcatcgtactcaaagactacccaaagcccggaccctgagggtaactcccgtggacgcgtacttctctcggccttaccgaacttccgtagggaaaccacgacgcctaactctacgaacctagtccggacggaccgggaaccccagggtaccttaagtggtaacgttacggaaacgtccgttaggtaacctttattttaagttcggttaccggtaaagggtttcggtacggggtaaccagggccgttaaagggtaacccggggtaaaagggggtttccggtttaccgggggaccggggttacgggaaccccgttaaagggtcccgg

SEQ ID NO: 427443 - DNA, 532 bp, Homo sapiens
  misc_feature: GZ8MTXP01EG7Q6.39.20.B09.1.454.CMB.2.raw
  modified_base (260)..(260): a, c, t, g, unknown or other
  modified_base (297)..(297): a, c, t, g, unknown or other
  modified_base (347)..(347): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgnttgctggtatcagcagaagccaggccagtcccctgtnctgatcatctactcaagatacccaagcccggccctcgagggactccccgngacgcgtattctctcggcctccaactcgtagggaaacacacgccactctacgaaccatcggacggccggggaacccacgggacctagtggataggaaatctagtacttattaattgttcgtaggttgtagggacaggcgaggaacgaaaggggtcgttcgggacggacgggaaccgttaagccgg

SEQ ID NO: 427444 - DNA, 521 bp, Homo sapiens
  misc_feature: GZ8MTXP01AMI9B.39.20.B09.1.454.CMB.2.raw
  modified_base (476)..(476): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattaggagaataaatatgcttgctggtatcagcagaagccaggccagtcccctgtgctgatcatctatcaagataccaagccggccctcgagggactcccgtgagcgattctctggcctaccaactcgtagggaaaccacgacgcccactctacgaccatcgacggccgggacccaggcctagtggataggaacgtctagacttattaagttgttcgtaggttggtagggacnggcaggcgaaagggggtgtacgggcgggacgggaaccgaagtccg

SEQ ID NO: 427445 - DNA, 537 bp, Homo sapiens
  misc_feature: GZ8MTXP01EUH08.39.20.B09.1.454.CMB.2.raw
  modified_base (251)..(251): a, c, t, g, unknown or other
  modified_base (482)..(482): a, c, t, g, unknown or other
  modified_base (488)..(488): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatcattagganataaatatgcttgctggtatcagcagaagccaggccacgtcccctgtcgctgatcatctactcaagataccaagccgccctgagggactcccgtgacgtcgtattctcgtggcctaccgaactcgtacgggaaccacgacgccctactctacgaccagtcggacggccgggacccagggcctaagtggaactaggaacgtctagtacttaattaagttcgttgagggttgngggacnggcgaggcggtaaggggtcgtcggggacgggacgggaaccgaaggtccg

SEQ ID NO: 427446 - DNA, 573 bp, Homo sapiens
  misc_feature: GZ8MTXP01BPMSI.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagagccaggccagtcccctgtgctgatcatctatcaagataccaagcgccctcgagggactccctgacgtctattctctgcctccaacgtcgtagggaaccacgacgccacgtctacgaccatcgacggccgggacccaggctacgtgggatacggaaagtccgtagtaaccttagtttaagttcggttacgtaggggttacgttagggggaacacggacggttacgggaaccgggttaaaaggggggtcgggttaccgggggaccgggggaacggggaacccgttaaagggtcccggg

SEQ ID NO: 427447 - DNA, 525 bp, Homo sapiens
  misc_feature: GZ8MTXP01A1MKO.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagagccaggccagtcccctgtgctgatcatctatcaagatacccaagccgccctgagggactcccgtgagcgtattcctctggcctccaactcgtagggaacacacgcccaactctacgaccatcggacggccggggacccagggcctagtggatagaagtctaggtacttattaatgttcgaggttcggtagggacaggcgaggaacggtaaagggggtcgtacgggacggggacgggaaccgaaggccg

SEQ ID NO: 427448 - DNA, 637 bp, Homo sapiens
  misc_feature: GZ8MTXP01EFETQ.39.20.B09.1.454.CMB.2.raw
  modified_base (233)..(233): a, c, t, g, unknown or other
  modified_base (248)..(248): a, c, t, g, unknown or other
  modified_base (560)..(560): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcactgctcnggaaatcattagganataaatatgcttgctggtatcgagcaagaacgcccgaggaccctacggtcccctgtcgctgactcatctactacaaagactaaccaaggcccgccctgacgggtactcccgtggacgtcgtactttccgtcgtcggtacctacccgaacgttccggtacgggaaacccacgaaccgccctaacctccgtaacgaccctacgtaccgggaacgggcccggggaaaccccagggtaccgttaagtagggaatacggaaacggtcctagtaactttaagtttaagttgttacggtaagggtttcggacgggaacngggacgttaacgggaaccggggtaaagggggttcgggtaccgggggacggggacgggaacccgaacggttccccggg

SEQ ID NO: 427449 - DNA, 593 bp, Homo sapiens
  misc_feature: GZ8MTXP01AIRER.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcagataccaagcggccctgagggactcccgtgacgcgtattctcttggcctaccgaaactcgtagggaaaccacagcccaactctacgaccataccgacggccggggacccagggacctaagtgggaataggaaagtcctaggtaaccttaagtttaagttggttaccgtaaggggttcgggttagggggaacccagggccaaggggaaccgggtaaaacggggggtttgggttacccgggggacgggggaaccgggggtaacccgaaagggttaaccccggg

SEQ ID NO: 427450 - DNA, 527 bp, Homo sapiens
  misc_feature: GZ8MTXP01DY9KG.39.20.B09.1.454.CMB.2.raw
  modified_base (463)..(463): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagactaccaagcccggccctcgagggtactcccgtagacgcgtattctctggcctccaacgtctagggaaacacacgccactctgaccatcgacggcggacccaggctagtgatagaagtctagtacttattaatcgttgtaggttgtgganacgcgaacggtaacggtaaaagggggtggttaccggggacgggaacgggaaccgaacggtccgg

SEQ ID NO: 427451 - DNA, 531 bp, Homo sapiens
  misc_feature: GZ8MTXP01EC52G.39.20.B09.1.454.CMB.2.raw
  modified_base (235)..(235): a, c, t, g, unknown or other
  modified_base (250)..(250): a, c, t, g, unknown or other
  modified_base (431)..(431): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctcnggaaatcattagganataaatatgcttgctggtatcagcagaagccaggccagtcccctgtcgctgactcatctatcaaagactaccaagccgccctgagggactcccgtagacgcgtattcctcgtcggctaccgaactcgtagggaaacacacgccactcacgaccatcgacggccgggacccagggcctaagnggatagaagtctagtacttattaattcgttcgtaggttggtaggacaggcagggaacgtaaagggggtcgtacgggacgggacggtaacccgaaggtccg

SEQ ID NO: 427452 - DNA, 545 bp, Homo sapiens
  misc_feature: GZ8MTXP01D5TM2.39.20.B09.1.454.CMB.2.raw
  modified_base (235)..(235): a, c, t, g, unknown or other
  modified_base (247)..(247): a, c, t, g, unknown or other
  modified_base (252)..(252): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctcngaatacataganataanatgcttgctggtatcagcagagccaggcacgtccctgtgctgatcatctatacaagactaaccgaagccgaccctcgagggtactcccgtagacgtcgactttctctcggcctaccaacgtcgtaacgggaaccacgacgacccactcctacgaacctacgtacggacggacccggggaaccccaggtcctaagtggaatagaaagtcctagtacttagtaattgttcgtaggttgagggacaggcgaaggtaacggtaaggggtcgtcgggacggacggtaaccgaagtccg

SEQ ID NO: 427453 - DNA, 493 bp, Homo sapiens
  misc_feature: GZ8MTXP01CHVZE.39.20.B09.1.454.CMB.2.raw
  modified_base (454)..(454): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagcgccctgagggactccctgacgcgattctctggctccaactctagggaacacacgccactctgaccatcgacgcgggaccccaggcctagtggatcgaagtctagactattaattgttctaggttgtgggcngcgagcgaaaggggtcggtacggcggagggccaagtccg

SEQ ID NO: 427454 - DNA, 542 bp, Homo sapiens
  misc_feature: GZ8MTXP01DCFZA.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctggaatacattaggagataaatatgcttgctggtatcagcagaagccaggccacgtcccctgtgctgatcatctactacaagatacccaagccggaccctcgagggactcccgtgacgcgtacttctctggcctaccaactcgtacgggaacacacgccactctacgaccacgtcggacggccggggacccagggctagtggatagaagtctagtacttattaagttgttcgtgggttcggtagggacaggttcgaaggcggtaaagggggtcggttcggggacgggacgggtaaccgaaggtaaccg

SEQ ID NO: 427455 - DNA, 501 bp, Homo sapiens
  misc_feature: GZ8MTXP01EWLN2.39.20.B09.1.454.CMB.2.raw
  modified_base (331)..(331): a, c, t, g, unknown or other
  modified_base (463)..(463): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagtcacgctcagtgtccgtgtccccaggacagacagccagcatcacctgctctggaaatacattaggagataaatatgcttgctggtatcagcagaagccaggccagtcccctgtgctgatcatctatcaagataccaagccggccctnagggactccctgagcgattctctggctccaactctgggaaacacaacgccaactcctgaaccatccgaggccggggaaccccagggcctagtggatgaagtctagactattaattgttcaggttgtgggaanagcgagaaggaagggtgtcgggcggacggaacgaagcg

SEQ ID NO: 427456 - DNA, 514 bp, Homo sapiens
  misc_feature: GZ8MTXP01D27U0.39.20.B09.1.454.CMB.2.raw
  modified_base (250)..(250): a, c, t, g, unknown or other
  modified_base (470)..(470): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaatacattagganataaatatgacttgctggtatcagcagagccaggccacgtcccctgtgctgatcatctactcaagataccaagccgccctgacgggactcccgtgacgcgtattctctggcctccaactcgtagggaacacagcccactctacgaccagtcgacggccgggacccagggcctaagtgatagactctagtactattaattgttcgaggttgtggacagttnacggaacgaaaggggtggtcgggacggagggaaccgaaggtccg

SEQ ID NO: 427457 - DNA, 526 bp, Homo sapiens
  misc_feature: GZ8MTXP01BKH8F.39.20.B09.1.454.CMB.2.raw
  modified_base (235)..(235): a, c, t, g, unknown or other
  modified_base (250)..(250): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctcnggaaatcattagganataaatatgcttgctggtatcagcagagccagccagtcccctgtgctgatcatctatcaagataccaagccgccctgagggactccctgacgcgtattctcgtggcctaccaactcgtagggaaaccacgacgcccactctagaccagtccgacggccgggacccaggctacgtggatagaacgtctagacttattaagttgttacgtaggttgtacgggacacgcgaggtaacgaaagggggtcgtacggggcggacgggtaaccgaagggtccg

SEQ ID NO: 427458 - DNA, 586 bp, Homo sapiens
  misc_feature: GZ8MTXP01DAFPB.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatacattaggagaataaatatgcttgctggtatcgagcaagaacgccaaggccagtcccctgtcgctgatcatctactacaaagatacccaagcccgggccctcgagggactcccgagacgtcttattcctcgtcggtcctacctaactcgtacgggaacacgacgcccactctcgaaccactcggacggccggggaacccagggtacctagtcggagttacgaacgtcgttagtaaccttagttaagttgttacgtagggttggttacggggacaggttcgaagggaacgggtaaaagggggtcggttacggggaccggggaacgggtaaccgaaggtaacccgg

SEQ ID NO: 427459 - DNA, 513 bp, Homo sapiens
  misc_feature: GZ8MTXP01DOVSG.39.20.B09.1.454.CMB.2.raw
tcagtcgcactagtcacgaccggtgctcgatttagtgtagtgtgagggttgagaacctatgaacattctgtagggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattaggagataaatatgcttgctggtatcagcagaagccagccagtcccctgtgctgatcatctatcaagactacaagccgcctcgagggactcccgtgacgcgtattctctggctcaactcgtagggaaacacagccactctacgaccatacgacggaccgggacccagggctaagtggatagaagtctagtacttattaattgttcgaggttggtaggacaggcgaggaacggaaaggggtcggtacgggcggacgggaaccgaaggtccg

SEQ ID NO: 427460 - DNA, 517 bp, Homo sapiens
  misc_feature: GZ8MTXP01DUVKC.39.20.B09.1.454.CMB.2.raw
  modified_base (249)..(249): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccagctcagtgtccgtgtccccaggacagacagccagcatcacctgctctggaaatacattagganataaatatgcttgctggtatcagcagaagccaggccagtcccctgtgctgatcatctatcaagctaccaagccgaccctgagggtactcccgtgagcgatttctctggctaccactcgtagggaacacagccactctcgaaccactacggacgaccggggacccacgggtcctagtggataggaagtcgtagtacttattaattgttacgtaggttgtggacagcgaaggcgaaaggggtcggttcgggcgggaggaaccgaagtccg

SEQ ID NO: 427461 - DNA, 523 bp, Homo sapiens
  misc_feature: GZ8MTXP01CJ9ZC.39.20.B09.1.454.CMB.2.raw
  modified_base (251)..(251): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattagganataaatatgcttgctggtatcagcagagccaggcccagtcccctgtgctgatcatctatcaagataccaagccggccctcgagggactcccgtgacgcgtattctctgcctcaactcgtagggaaccacgacgccacgtctacgaccatcgacggccgggaccagggcctagtgggatggaacgtcgtagtacttattaattgttcgtagggttgtagggacaggcgttaggcgtaagggggtcgtcggggacgggagggaaccaaggtccg

SEQ ID NO: 427462 - DNA, 521 bp, Homo sapiens
  misc_feature: GZ8MTXP01CZJFP.39.20.B09.1.454.CMB.2.raw
  modified_base (327)..(327): a, c, t, g, unknown or other
  modified_base (423)..(423): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaatacattaggagataaatatgcttgctggtatcagcagaagccaggccagtcccctatgctgatcatcatcaagataccaagcgccctnagggatccctgagcgtatctctggctcaactcgtggaacacagccactctgaccatcgacgcgggacccagggctagtggatagaagctagacttnttaagttgttcgtagggttggtagggaccgaggccgaggtaaccggaaaagggggttcggttaccggggacgggttacggggtaaccgaacggtccgg

SEQ ID NO: 427463 - DNA, 521 bp, Homo sapiens
  misc_feature: GZ8MTXP01EWW2J.39.20.B09.1.454.CMB.2.raw
  modified_base (479)..(479): a, c, t, g, unknown or other
  modified_base (505)..(505): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctcaggaaatacattaggagaataaatatgcttgctggtatcagcagaagccaggccagtcccctgtcgctgactcatctatacaagataccaagccgccctgacgggactccctgagcgattcctctcgctaccaactcgtacgggaaacacacgcccaactctacgaccaactccggacggacccggggaacccagggcctaagtgatagaagtctagacttataattgttcgtaggttgtgggacnggcacggaacgaaggggtgtacgggnggacggaaccgaagcg

SEQ ID NO: 427464 - DNA, 535 bp, Homo sapiens
  misc_feature: GZ8MTXP01E0MFK.39.20.B09.1.454.CMB.2.raw
  modified_base (396)..(396): a, c, t, g, unknown or other
  modified_base (514)..(514): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtccccctgtgctgatcatctatcaaagataccaagccgccctcgagggactcccgtgacgcattcctctggcctaccgaactcgtagggaaccacgacgcccaactcncgaccactcgacggccggggaacccacgggctagtcgggattaggaatccgtagtacttattaagttgttcgtaggttcggtggggaacaggcgagggaacgaaaggggtgtcggggnggacgggtaaccgaagtccgg

SEQ ID NO: 427465 - DNA, 562 bp, Homo sapiens
  misc_feature: GZ8MTXP01AGW7A.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccacgtcccctgtgctgatcatctactacaagactaccaagccgccctcgagggactcccgtgacgcgtattcctcgtcggcctccgaaacgtctaggggaaaccacacgcccacttcacgaccctagtaccggacggacccggggaccccagggtacctagtggatacgaaaggtcctagtaacttatttaattcggttacgtagggttcggtagggaacacggcgaggaacggtaaagggggtcgttacggggacgggacggaaccgaagtcccg

SEQ ID NO: 427466 - DNA, 641 bp, Homo sapiens
  misc_feature: GZ8MTXP01DZYHE.39.20.B09.1.454.CMB.2.raw
  modified_base (234)..(234): a, c, t, g, unknown or other
  modified_base (245)..(245): a, c, t, g, unknown or other
  modified_base (250)..(250): a, c, t, g, unknown or other
  modified_base (253)..(253): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcactgctngaatcataganataantgntgctgtatcagcagagccaggccagtcccctgtgctgatcatctaactacaaagactaacccgaacggcccgggacccccgaaggggtacctccccgtagacgtccgtatttcctcgtcggacctacccaaacgtcgtacgggaaacctaccgacgacccaactcacgaacccacgtaccgaacgggggaccccggggtaaccccgaagggtccgttaagtagggaacgttagggaaaacgtccgttagtaaacctttatttaaacgttggttacgttaaggggttggttacggggaaccgaaggttacgaacgggttacgggtaaaagggggttcgggttaacggggaccgggggaacgggaaccgtaacgggttccgtaaccgggg

SEQ ID NO: 427467 - DNA, 568 bp, Homo sapiens
  misc_feature: GZ8MTXP01ETFVL.39.20.B09.1.454.CMB.2.raw
  modified_base (250)..(250): a, c, t, g, unknown or other
  modified_base (464)..(464): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcactgctcagaaatcattagganataaatatgcttgctggtatcagcagaacgccaggcccacgtcccctgtcgctgatcattctaactacaaagactacccaaggcccgaccctgacgggtactcccgtggacgtcgtattcctcgtcgcctacccaacgtcgtacgggaaaccacgacgcccacttcacgaccatccggacggccgggaaccaggctagtcgggataggaacgtntacgtacttattaagttcgttaggtagggttggtaggggacaggcgaagggtaacgggtaagggggtcggtaccgggacggggacgggtaaccgaacggtccgg

SEQ ID NO: 427468 - DNA, 612 bp, Homo sapiens
  misc_feature: GZ8MTXP01A97NA.39.20.B09.1.454.CMB.2.raw
  modified_base (282)..(282): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatacattaggagataaatatgcttgctggtatcagcaaganccagccacgtcccctgtgctgactcatctactcaagataccaagtccgccctgagggactccgtgacgtcgattctcgtcggactacaacgtccgtagggaaaccaccgacgcctacttacacggaaccctacgacggacgggacccggggaaccccgaggtacctaggtacggaattacggaagtccgtaggttaactttagtttaacgttcggttacgtaaacggggttggtaacgggggaccagggaccgaaggggtaacccgggtaaaaggggggttcgttacccgggggagggttaaaccgggtaaccggttaaacggtcccggg

SEQ ID NO: 427469 - DNA, 591 bp, Homo sapiens
  misc_feature: GZ8MTXP01C98IM.39.20.B09.1.454.CMB.2.raw
  modified_base (255)..(255): a, c, t, g, unknown or other
  modified_base (306)..(306): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcacctgctctaggaaatacattaagganaataaatatgcttgctggtatcagcaagaacgccaggccacgtcccctgtnctgactcatctatacaaagactaacccgaagcccggccctcgagggactcccgtagacgcgtattctctgcctacactcgtacggaacacacgccactctacgaaccactacggacggcccgggaacccacgggtacctaagtggaagttaggaacgtccgtagtaaccttaagtttaagttcggttacgtaagggttgggttacgggtaacgaagccggaaggaaccgggtaaaagggggttcggttaccggggacggggaacgggtaaccgaaggtaacccgg

SEQ ID NO: 427470 - DNA, 616 bp, Homo sapiens
  misc_feature: GZ8MTXP01CNEUU.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagaataaatatgcttgctggtatcagcagaagccaggccagtcccctgtcgctgatcattctaactcaaagactaaccaacgcccggccctcgagggactcccgtgacgcgtattctctggcctaccaactcgtacgggaacacgacgacccactctacggaaccctacgttaccggaacggggacccggggaaccccaacggggtaccttaacgttacggggaattaacgggaaacgtcgttaacggtaaccttaagtttaacgtttcggttacggtaagggttggtaggggacaaggccgaaggaacgggtaaaagggggttcggttaccgggggacggggaacgggtaaccccgaaggtccccgg

SEQ ID NO: 427471 - DNA, 585 bp, Homo sapiens
  misc_feature: GZ8MTXP01C8XA4.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatacattaggagaataaatatgcttgctggtatcagcagaagccaggccacgtcccctgtcgctgactcatctaactcaaagctaacccgaagcccggccctgacgggactcccgtgacgcgtattctcgtgcctacactcgtagggaacacgacgaccactctcgaaccacgtacggaacggcccgggaacccgaggacctagtagggattacgaacgtccgttagtaactttagtttaagttcggttacgtagggttaggtacgggggtacaaggccgaaggtaacgggtaaaagggggttcggttaccggggacgggacgggtaacccgaaggtaacccgg

SEQ ID NO: 427472 - DNA, 605 bp, Homo sapiens
  misc_feature: GZ8MTXP01ELD5Q.39.20.B09.1.454.CMB.2.raw
  modified_base (311)..(311): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatacattaggagataaatatgcttgctggtatcagcagacgcaggccacgtccctgtgctgatcatctanacaagactaccacgcccgccctgacgggtactcccgtagacgtcgtactttccgtcgtcggtacctaccaaacgttcggaacgggaaaccacgacaccacgtcctacgaccacgtacgggacgggacccggggaaccacggtactaaggtcgggtaataaggaacgtcgtacgtaactttaagtttaagttcggttagggtagggttagggacgggaaccgaggaccgagggtaaccggggtaaagggggttcggttacgggggacggggaacgggtaacccgaagggtcccgg

SEQ ID NO: 427473 - DNA, 686 bp, Homo sapiens
  misc_feature: GZ8MTXP01BUXWP.39.20.B09.1.454.CMB.2.raw
  modified_base (253)..(253): a, c, t, g, unknown or other
  modified_base (260)..(260): a, c, t, g, unknown or other
  modified_base (296)..(296): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatacattagganataaatntgctgctggtatcagcagagcagccagtcccctgtnctgatcatctatacaaagactaccaagcccgccctgacgggactcccgtagacgtcgtacttccgtcgtcggcccttaccgaacgttaccgtaagggaaacccaccgacgacccctactaccgtacgaaccctacgtacccgggaacggggtaccccggggaacccctaacgggtacccgttaaggtacgggaaagtttaacgggaaaccgtcgttaacggttaacctttaagtttaaggttttaccggttacgggttaacgggggttgggttaacgggggaacccttagggaccgggaaaggggttaacgggggtaaacgggggtttaacgggggttaccgggggaccgggggttaaacggggaacccgttaacgggttaaccccgggg

SEQ ID NO: 427474 - DNA, 488 bp, Homo sapiens
  misc_feature: GZ8MTXP01EF1MT.39.20.B09.1.454.CMB.2.raw
  modified_base (400)..(400): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattaggagataaatatgcttgctggtatcagcagagccaggccagtcccctgtgctgatcatctatcaagataccagccgccctgagggactccctgagcgattctctgctcactcgtggaacacagccactctgaccatcgacgcggaccaggctagnggatagaagtctagacttataattgttcgaggttggtgggacaggcaggcgtaaaggggtcgttcgggcggacgggtaaccgaagtcg

SEQ ID NO: 427475 - DNA, 533 bp, Homo sapiens
  misc_feature: GZ8MTXP01D56JB.39.20.B09.1.454.CMB.2.raw
  modified_base (250)..(250): a, c, t, g, unknown or other
  modified_base (308)..(308): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcactgctctggaaatacattagganataaatatgcttgctggtatcagcagagcaggccagtcccctgtgctgatcatctacncaagataccaagccgacctgagggtactcccgtagacgcgtattctcgtggacctccaacgtcgtacgggaacacgacgcccaactcgtacaacctacgtacggacggaccggggacccagggtacctaagtggattacgaacgtctacgtacttattaagtgacgtaggttgtagggacttgcaggaaggaaagggtgtcgggaggacggtaaccgaaggtccg

SEQ ID NO: 427476 - DNA, 621 bp, Homo sapiens
  misc_feature: GZ8MTXP01CFH4U.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaacgccaggccacgtcccctgtcgctgatcatctactacaagactaccgaacgccgccctgacgggactcccgtgacgtcgtacttctcgtcggcctaccaacgtcgtacgggaaacacgacgacccactctacgaacctacgtaccgggaacggacccggggacccaacggggccttaaggtcggaagttaggaaacgtccgttacggtaactttaagtttaagtttcggttacggtaggggttcgggttacggggtaagaacgggccgagggaaccgggtaaaaggggggttcgggttaccgggggacggggttaacggggaacccgttaaagggtcccggg

SEQ ID NO: 427477 - DNA, 581 bp, Homo sapiens
  misc_feature: GZ8MTXP01EA9U9.39.20.B09.1.454.CMB.2.raw
  modified_base (251)..(251): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcactgctctaggaaatacattagganaataaatatgcttgctggtatcagcagagccaggccacgtccctgtcgctgatcatctacacaagactaccaagcccgccctcgagggtactcccgtgacgtcgtattcctcgtcggtacctaccgtaacgtccgtacgggaaaccacgaccgccctactcctacggaaccctacgtaccggacggacccggggaacccacgggtacctaagtggtaacgtaggaacgtccgtagtacttattaagttgttgtagggttgtagggacaggcgaggtaacgggtaaaggggtcggttaccggggacgggaacgggaaccgaacggtaaccg

SEQ ID NO: 427478 - DNA, 546 bp, Homo sapiens
  misc_feature: GZ8MTXP01A60KT.39.20.B09.1.454.CMB.2.raw
  modified_base (256)..(256): a, c, t, g, unknown or other
  modified_base (496)..(496): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacataggagataaatntgcttgctggtatcagcagaagccaggccacgtcccctgtcgctgactcatctactacaagactacccgaagcccggccctcgacgggactccccgtgacgtcgtacttctctcggcctaccgaactcgtacgggaacacacgcctactctacgaccatccggacggccgggaacccagggtctagtcggagtagacgtcgtagactttaattaacgttgttcgtagggttggtgggacnggcgaggaacggaaggggtcggtacgggcgggacgggaaccgaaggtccg

SEQ ID NO: 427479 - DNA, 547 bp, Homo sapiens
  misc_feature: GZ8MTXP01CJM7L.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaatacattaggagataaatatgcttgctggtatcagcagaagccaggccacgtcccctgtgctgatcatctaactacaagactaccgaagcccggccctgacgggactcccgtgacgcgtatctctcgctaccactcgtaggaacacacgccacttccacgacctacgtccggacggacccggggaccccagggcctagtggattggaaagtcttaggtacttaagttaagttgttcgtaagggttgtacgggacaggcttacgggaagtaaacggggttgtcgggcgggaacgggaaccttaaggtccg

SEQ ID NO: 427480 - DNA, 556 bp, Homo sapiens
  misc_feature: GZ8MTXP01EMN14.39.20.B09.1.454.CMB.2.raw
  modified_base (250)..(250): a, c, t, g, unknown or other
  modified_base (301)..(301): a, c, t, g, unknown or other
  modified_base (379)..(379): a, c, t, g, unknown or other
  modified_base (470)..(470): a, c, t, g, unknown or other
  modified_base (484)..(484): a, c, t, g, unknown or other
  modified_base (504)..(504): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtcccaggacagacagccagcatcactgctacagaaatacagttagganataaatatgcttgctggtatcgagcaagacgccaggccacgtcccctgtcncgtgactcaatctaactacaaagtactacccgaagcccggaccctcggacgggtactcccgtagacgtcgtactttcnctcggacctaccaacgttcgaggaaaccacacgcaactctacgacacgtcgggacgccggaccaggctagcggatacgagtcgtatacttntaagttgttacggngggttcggagggaacacggngagggtaacgggtaaaggggtcggtacgggagggttacgaaccgaaggtccg

SEQ ID NO: 427481 - DNA, 501 bp, Homo sapiens
  misc_feature: GZ8MTXP01EQT5G.39.20.B09.1.454.CMB.2.raw
  modified_base (250)..(250): a, c, t, g, unknown or other
  modified_base (368)..(368): a, c, t, g, unknown or other
  modified_base (375)..(375): a, c, t, g, unknown or other
  modified_base (413)..(413): a, c, t, g, unknown or other
  modified_base (415)..(415): a, c, t, g, unknown or other
  modified_base (420)..(420): a, c, t, g, unknown or other
  modified_base (428)..(428): a, c, t, g, unknown or other
  modified_base (439)..(439): a, c, t, g, unknown or other
tcagtcgcactagtcacgaccggtgctcgatttagtgtagtgtgaagggttgagaacctatgaacattctgtagggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattagganataaatatgcttgctggtatcagcagaagccaggccagtcccctgtgctgatcatctactcaagataccaagccggccctcagggactccctgacgtcgattctctggctccaactcngggaacncagccactctcgaccatcgacgcgggacccaggctagngnagagntagtactnttaattgttgnggttgtagggacagcgaggaaggtaaggggtggtacggggacggacgggtaaccgaaggtcg

SEQ ID NO: 427482 - DNA, 583 bp, Homo sapiens
  misc_feature: GZ8MTXP01AOGGY.39.20.B09.1.454.CMB.2.raw
  modified_base (254)..(254): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcacctgctctaggaaatacattagganataaatatgcttgctggtatcagcagaacgccgaggccacgtcccctgtcgctgatcatctaatcaaagactaccgaagcccggccctgacgggactcccgtagacgtcgtatttcctcgtcggtcctacctaaacgtccgtagggaaaccacgacgacccactcctacgaccactacgggacggccggggaacccaggtactagtgggatagaacgtcgtagtaacttgttaacgtcggttgtaagggttggtagggacttacggcgaacgggtaacggtaaagggggttcggtacgggggacgggacggggaacccttaaggtccgg

SEQ ID NO: 427483 - DNA, 530 bp, Homo sapiens
  misc_feature: GZ8MTXP01CCKNM.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcactgctcaggaaatacattaggagaataaatatgcttgctggtatcagcagagcagccagtcccctgtcgctgatcatctaactcaaagactaccaagccggccctcgacgggactcccgtgacgcgtattcctctcggctaccaactcgtacggaaacacagcccactctagacctatccggacggccgggacccaggctaagtgatagaagtctagtacttattaattgttctagggttggtagggacaggcgaggaacggtaaaggggttgtacggggacgggagggtaaccaaggtccg

SEQ ID NO: 427484 - DNA, 654 bp, Homo sapiens
  misc_feature: GZ8MTXP01D5OUP.39.20.B09.1.454.CMB.2.raw
  modified_base (236)..(236): a, c, t, g, unknown or other
  modified_base (242)..(242): a, c, t, g, unknown or other
  modified_base (248)..(248): a, c, t, g, unknown or other
  modified_base (255)..(255): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatcccctctcttcctcggcgtccttgcttactgcacaggatccgtggcctcctatgagctgtctcagccacgctcagtcgtccgtgtccccaggacagacagccagcatcactgctcngaatanataganataaatntgcttgctggtatcagcagacgccagccacgtccctgtgctgatcatctaatcaaagactaccacggcccgccctgagggacctcccgtaggacgtcgtactttcctcgtcggtcctaccaacgtcgttacgggaaaccacgacgaccctactacctacggaacccagtaccgggacgggtacccggggaaccccgacgggtactaacggtacggtaagttaacggaacgtccgttaggtaacctttaagtttaacgttttaagggttccggtaagggggtttagggttacggggtaaccgttaagggacggttaaacggggaacccgggttaaaagggggttcggggtttaccgggggacggggttaacggggtaacccgttaaacggggttccccgg

SEQ ID NO: 427485 - DNA, 646 bp, Homo sapiens
  misc_feature: GZ8MTXP01AVJLI.39.20.B09.1.454.CMB.2.raw
  modified_base (248)..(248): a, c, t, g, unknown or other
  modified_base (255)..(255): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctctatgagctgtctcagccacgctcagtgtccgtgtccccaggacagacagccagcatcactgctcaggaatacattagganataaatntgcttgctggtatcagcagagccaggccacgtcccctgtcgctgatctatactactacaaagtactaccgaagcccggacctcgagggtacctcccgtagacgtcgtaacttcctcgtcggtacctacccgaacgttccgacgggaaaccacgacgaccctaacgtccgtacgaacctacgtaccggaacggacccgggaacccacggtaccgtaagtggtaactaacggtaagtaccgttaacggtaacctttaagtttaagttcgggttcgtaaagggttccgggttaaggggtaacccgttaaggccgttaaaggggtaacggttaaaacggggggttccggttacgggggaccggggaaacggggaacccgttaacgggttcccggg

SEQ ID NO: 427486 - DNA, 661 bp, Homo sapiens
  misc_feature: GZ8MTXP01A966Y.39.20.B09.1.454.CMB.2.raw
  modified_base (253)..(253): a, c, t, g, unknown or other
  modified_base (261)..(261): a, c, t, g, unknown or other
  modified_base (284)..(284): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccagctcagtgtccgtgtccccaggacagacagccagcatcacctgctcgtaggaaatacagttagganaataaatntgcttgctggtatcagcagaacncgaggccacgtccctgtagctagactcattctaatacgaaaagactaacccgaacgcccgggtaccctcggaacgggtacctccccgtagaaccgtcgtaactttccgaccgtcggtaccctaccctaacgttccgtaacggggaaaccctacgaccggtaccctaccggttctaaccggtacctaacgttccggggaacggtaccccgggggaaccccagggttacctaacgtggggtaaacttacgggtaaagtcccgtagttaaaccttagtttaagtcggttaggtacggttgggtacggacgaaggttcggacggtaacggggtaaggggttccgttacgggacggggttaacggaaccgaacggttcccgg

SEQ ID NO: 427487 - DNA, 617 bp, Homo sapiens
  misc_feature: GZ8MTXP01BEGHP.39.20.B09.1.454.CMB.2.raw
  modified_base (251)..(251): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcactgctctaggaaatacattagganataaatatgacttgctggtatcgagcagaacgccaggccacgtcccctgtgctgactcatctactacaaagactaccgaacgcccgtaccctgacgggtacctcccgtaggacgtcgtactttccgtcgtcggcctaccaacgtcggtacgggaaaccaccgacgtacccactcgtacgaacctactaccgggaacgggccgggaaccccgagggtacctaggtggaacgtaggaaacgtcgtacgtaacttagtttaacgttggttacggtagggttggtacgggacgacggcgttaacgggtaacgggtaaagggggttcgggtacgggggacgggaacgggggaaccgaacgggtaacccggg

SEQ ID NO: 427488 - DNA, 651 bp, Homo sapiens
  misc_feature: GZ8MTXP01A7EGJ.39.20.B09.1.454.CMB.2.raw
  modified_base (310)..(310): a, c, t, g, unknown or other
  modified_base (323)..(323): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtcggcctcctatgagctgtctcagccacgctcagtgtccgtcgtccccaggacagacacgccagcactcacctgctctaggaaatactataggaagaataaatatgcttagctaggtatcagacgagaacgccaggccacgtcccctgngctgatcatctancaagatacaacgccgcctcgaggactcctgacgtcgacttctcgtcggtacctaccgacttacggtcgggaaaccctacaccggaccctaccgaccttacggaaccctacgtacccgggaacggggaccccgggggtaacccaacgggtaccgtagtaacgggagtaacgacgtaccttaggtaacctttaagggtttaatttcgggttaccgggaaggtttcgggggtaacgggtaacgaacggttcgaaacggggaaccgggttaaagggggggttcgtttaccgggggaacggggacggggtaaccccgaagggttaaccccggg

SEQ ID NO: 427489 - DNA, 571 bp, Homo sapiens
  misc_feature: GZ8MTXP01ELGWA.39.20.B09.1.454.CMB.2.raw
  modified_base (250)..(250): a, c, t, g, unknown or other
  modified_base (295)..(295): a, c, t, g, unknown or other
  modified_base (440)..(440): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctcaggaatacatagganaataaatatgcttgctggtatcagcagaacgccagccagtccccngtgctgatcatctatacaagataccaacgccggccctcgagggactcccgtgagcgtatttctctggcctcaacgtcgtagggaaacacgacgccctaactctacgaaccagtaccgacgggaccgggaccccagggacctaagnggtaataggaaggtcctaggtaaacttaagttaagttcgttagtaggggttggtaggggaacagggcgaacgggtaacggtaaaagggggttcgggttacgggggacggggaacgggaaccgaaggtccgg

SEQ ID NO: 427490 - DNA, 587 bp, Homo sapiens
  misc_feature: GZ8MTXP01AF7BU.39.20.B09.1.454.CMB.2.raw
  modified_base (252)..(252): a, c, t, g, unknown or other
  modified_base (526)..(526): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtcgtccccaggacagacagccagcatcacctgctctaggaaatacattagganaataaatatgcttgctggtatcagcagaagccaggccacgtcccctgtgctgatcatctactacaagactaaccaagccgccctcgagggtactcccgtgacgcgtacttcgtcgtcgcctaccaacgtcgtagggaaaccacgacgccctaactctacgaccctagtccggaacgggcccgggaacccgacgggtaccttaagtagggattaacgggaaggtcctaggtaacctttagtttaagttggttacgtagggttggtacggggaacnggttacgagggaacggtaagggggttcgtacggggaccgggagggtaaccgaaggtcccgg

SEQ ID NO: 427491 - DNA, 573 bp, Homo sapiens
  misc_feature: GZ8MTXP01DM78U.39.20.B09.1.454.CMB.2.raw
  modified_base (249)..(249): a, c, t, g, unknown or other
  modified_base (506)..(506): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtgcctcctatgagctgtctcagccacgctcagtgtccgtgtccccaggacagacagccagcatcactgctctaggaatacattagganataaatatgcttgctggtatcagcagacgccaggcccagtcccctgtcgctgatcatctactcaagactaaccaggaccgccctgagggtacctcccgtagacgcgtacttctactcggacctaccaactcgtagggaaaccactacgaccctactctacgacctactaccgggacgacccgggaacccagtacctagttggactacggaagtcctagtaaccttagttaattggttacctaggggttgtaacgggngaacggccgagggaacggtaaaagggggttcggttacgggacggggaggaaccgaaggtaacccggg

SEQ ID NO: 427492 - DNA, 655 bp, Homo sapiens
  misc_feature: GZ8MTXP01CWDHL.39.20.B09.1.454.CMB.2.raw
  modified_base (251)..(251): a, c, t, g, unknown or other
  modified_base (320)..(320): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcactgctctaggaatacattagganataaatatgcttgctggtatcagcaagaagccaggcccagtcccctgtcgctgatcatctatacaaagntaaccagcccgccctgacgggactcccgtgcgtctatctctcggcctaccaactcgtacgggaacaccgacgacccacgttctacggaacctacgtaccggaacgggacccggggaacccctaacggggtaccttaacggtacgggtaattaaccggggaagtacccggttaagttaaaccgttttaagtttaagtttcggttaccggttaaggggttgggtttaacggggaacgttaaaccggttcgggttaacgggaaacggggttaaaacggggggtttcgggtttaccgggggacgggggaaccggggtaacccggaaacgggttccccgg

SEQ ID NO: 427493 - DNA, 608 bp, Homo sapiens
  misc_feature: GZ8MTXP01EAY7L.39.20.B09.1.454.CMB.2.raw
  modified_base (251)..(251): a, c, t, g, unknown or other
  modified_base (259)..(259): a, c, t, g, unknown or other
  modified_base (375)..(375): a, c, t, g, unknown or other
  modified_base (462)..(462): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtgcctctatgagctgtctcagccacgctcagtcgtccgtcgtccccaggacagacagccagcatcactgctacaggaatacagttagganaataaatntagcttgctgtatcagcagacgccaggccacgtcccctgtcgctagactcatctaactacaaagactaaccgaacgcccggaccctgacgggtacctcccgtagacgcgtattccncgtcgacctacaactcgtaaggaaaccacgacgcccacttacacgacctacgtaccggacgggaccgggaacccctaggaccttagngggtaatacggacgtcctagtaactttaagttaacgttggttacggtagggtttagggacggtaaccgacggcgaaaggggtaaccgggttaaaggggggtcgttccgggggaacggggaaccggttaaccgaacgggtaacccgg

SEQ ID NO: 427494 - DNA, 600 bp, Homo sapiens
  misc_feature: GZ8MTXP01AFDAJ.39.20.B09.1.454.CMB.2.raw
  modified_base (255)..(255): a, c, t, g, unknown or other
  modified_base (526)..(526): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccagacagacagccagcatcacctgctctagaaatcattaggagataaatntgctgctggtatcagcagacgccaggcctacgtcccctgtcgctgatcatactactacaaagactaacccgaacggcccgtaccctcgacgggtactcccgtggactcttacttctcgtcggacctaccaacgtcgtacgggaacacgacgacctaactctacgaacccacgtacggacggaccggggaaccccagggtacctagttgaacgttagaaacgtcctaggtaactttagttaacgttggttacgtagggttcggtgggaacgnggacgttacggtaaccggggtaaagggggttttcggaaccggggacggggaaccggtaaccgaagggtccccgg

SEQ ID NO: 427495 - DNA, 560 bp, Homo sapiens
  misc_feature: GZ8MTXP01ECVP8.39.20.B09.1.454.CMB.2.raw
  modified_base (313)..(313): a, c, t, g, unknown or other
  modified_base (403)..(403): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctcaggaaatacagttaggagataaatatgcttgctggtatcagcagaagccaggccacgtcccctgtgctgactcatctancaaagactaccgaacgcccggccctgagggacctcccgtgacgtcgtattcctcgtcgtcctaccaacgtcgtaacgggaaaccacgacncccactactacgaacctacgtcgggaacgggcccgggaacccgagggtacgtacgtggattaggacgtctagtacttagtaatttcggagtagggttgacgggacaggcgaaggtcggaaagggggttcgtggggacgggacggaaccgaaggtccg

SEQ ID NO: 427496 - DNA, 700 bp, Homo sapiens
  misc_feature: GZ8MTXP01ES2XO.39.20.B09.1.454.CMB.2.raw
  modified_base (308)..(308): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctctatgagctgtctcagcccacgctcagtcgtccgtgtccccaggacagacagccagcatcacctgctacaggaaatacagttaggaagaataaatagtgacttgctaggtatcagcaagacgccaggccacgtcccctgtnctgatcatctaactacgaaagtactaacccgaacggcccggaccctggacgggtacctcccgtagacggtcgtacttccgtcgtcggacctaccgaacgttccgaagggaaacccacggtacgaccctactaccgtacgaacctacgccggggaacgggtacccgggaacccgagggtaacctacggttacgggaacgtaggaaacgtccggttaaacgttaacgtttaattttaacggttacgggttaacggttaaagggggtttcgggtaaacggggtaaccgttaacgggttggaaaacccggggttaacgggggtaaaaggggggtttccgggttaaccgggggacgggggttaaaccggggtaaccgaaaccgggttaaccccgggg

SEQ ID NO: 427497 - DNA, 616 bp, Homo sapiens
  misc_feature: GZ8MTXP01D0NSS.39.20.B09.1.454.CMB.2.raw
  modified_base (251)..(251): a, c, t, g, unknown or other
  modified_base (302)..(302): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcactgctcaggaaatacattagganaataaatatgcttgctggtatcagcaagaagccaggccacgtcccctgtcnctgatcatctactacaaagtactaccaacggcccgaccctcgacgggtacctcccgtagacgtcgtactttcctcgtcggtcctaccgaacgttccgtaacgggaaaccaccgacgccctacgtacgtacgaacctacgtcggaacggaccgggaaccccgagggtacctaaggtaggaagtacggaacgtccgttagtaactttagttaagttcgttaggtagggttggtacgggaccgaggttcgaaagggtaaccggggtaaaaggggttcgggtaccggggacggggaacgggaaccgaaggtaacccgg

SEQ ID NO: 427498 - DNA, 540 bp, Homo sapiens
  misc_feature: GZ8MTXP01B8G3B.39.20.B09.1.454.CMB.2.raw
  modified_base (235)..(235): a, c, t, g, unknown or other
  modified_base (250)..(250): a, c, t, g, unknown or other
  modified_base (519)..(519): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctcngaaatacattagganataaatatgcttgctggtatcagcagaagccaggccagtcccctgtgctgatcatctaatcaagactaccaagccggcccctgacgggtctcccgtgacgcgtattcctctcggcctaccaacttcgtacgggaaacacacgcccaactctacgaccatccggacggcccgggacccagggcctaagtggataggaactcgtagtacttattaacgttgttcgtagggttgtagggacaggcgaggcggtaaagggggtcggtacgggngggacggtaaccgaaggtccg

SEQ ID NO: 427499 - DNA, 497 bp, Homo sapiens
  misc_feature: GZ8MTXP01E3LXI.39.20.B09.1.454.CMB.2.raw
  modified_base (250)..(250): a, c, t, g, unknown or other
  modified_base (361)..(361): a, c, t, g, unknown or other
  modified_base (391)..(391): a, c, t, g, unknown or other
  modified_base (398)..(398): a, c, t, g, unknown or other
  modified_base (420)..(420): a, c, t, g, unknown or other
  modified_base (424)..(424): a, c, t, g, unknown or other
  modified_base (427)..(427): a, c, t, g, unknown or other
  modified_base (432)..(432): a, c, t, g, unknown or other
  modified_base (441)..(441): a, c, t, g, unknown or other
  modified_base (447)..(447): a, c, t, g, unknown or other
  modified_base (457)..(457): a, c, t, g, unknown or other
tcagtcgcactagtcacgaccggtgctcgattttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctagaaatcatagganataaatatgcttgctggtatcagcagaagccaggccacgtcccctgtgctgatcatctaatacaagataaccaagccggccctcgagggactcccgtagacgcgtattccnctcggctaccaactcgacgggaacacgacncctaacncacacagcggacgcggaccagntagnganagatntatactatntgttgnggttgaggangcgaggaaggagggtcgtcgggacggaggtaacgaagtcg

SEQ ID NO: 427500 - DNA, 601 bp, Homo sapiens
  misc_feature: GZ8MTXP01BTNT0.39.20.B09.1.454.CMB.2.raw
  modified_base (298)..(298): a, c, t, g, unknown or other
  modified_base (500)..(500): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattaggagaataaatatgcttgctggtatcagcagaagccaggccacgtccccngtgctgactcatctatacaagactaccaacggccgaccctgagggactcccgtagacgcgtattcctcgtcggaccttaccaacgtcgttacggggaaaccaccgacgaccctacgtccgtacgacccaagtccgggaacgggacccggggaacccacgggtacctaaggtggacgtaacggaaagtccgtaagtaaccttntttaaacgttcggttagtaagggttggacggggacttacgggcgaagggaacgggtaaaggggttcggtacggggcgggaaccgggtaacgaaggtcccgg

SEQ ID NO: 427501 - DNA, 592 bp, Homo sapiens
  misc_feature: GZ8MTXP01BPK1S.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatacattaggagaataaatatgcttgctggtatcagcagaacgccacggccacgtcccctgtcgctgatcatcactacaagactaccagcccgccctgacggtactcccgtagacgtcgtacttctacgtcgctaccacgtacgtacgggaaccacgtacgccactctacgaccacgtacggacggaccgggtacccaggtactaacgtggagtacggaacgtcgtacgtaacttagtttaagttcgttacgggtagggttcggtacgggaacttacggcgttaacgggtaacgggtaaagggggttcggttaaccgggggacgggttaacgggtaaccgaacggtcccgg

SEQ ID NO: 427502 - DNA, 522 bp, Homo sapiens
  misc_feature: GZ8MTXP01EIF51.39.20.B09.1.454.CMB.2.raw
  modified_base (249)..(249): a, c, t, g, unknown or other
  modified_base (256)..(256): a, c, t, g, unknown or other
  modified_base (291)..(291): a, c, t, g, unknown or other
  modified_base (351)..(351): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctctatgagctgtctcagccacgctcagtgtccgtgtccccaggacagacagccagcatcacctgctcaggaatacattagganataaatntgctgctggtatcagcagaagccagccagtccccngtgctgactcatctatcaaagataccaagccgaccctgagggactccctgacgcgattcnctggcctaccaactcgtacgggaaacacacgcccacttccagaaccagtaccggaggccgggaacccagggacctagtggataggaatccgtagtaacttataattgagtaggttgtcgggacagcaggtaacggaaaggggtcgtcgggacggacgggtaacaaggtccg

SEQ ID NO: 427503 - DNA, 632 bp, Homo sapiens
  misc_feature: GZ8MTXP01D6CTZ.39.20.B09.1.454.CMB.2.raw
  modified_base (248)..(248): a, c, t, g, unknown or other
  modified_base (255)..(255): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccagctcagtgtccgtgtccccaggacagacagccagcatcacctgctctagaaatacatagganataaatntgcttgctggtatcagcagaacgccaggccacgtcccctgtgctgactcatctaactacaaagactaaccgaacggcccggaccctcgacgggtactccccgtgacgcgtattctctcggcctaccaacgtcgtacgggaaacaccacgcccaactccgtacgaacctacgtaccggaacggacccgggggaaccccaggggtaccttaagcgggtaacgtaggtaaacgtccgttaaggtaacctttaagttttaagtttcggttacggttaaacggggtttcggtaggggtaaccagggacgaaacgggtaacgggtaaaagggggttcgggttaccgggggacggggttaacgggtaaccgaaagggttcccgg

SEQ ID NO: 427504 - DNA, 559 bp, Homo sapiens
  misc_feature: GZ8MTXP01DYHJP.39.20.B09.1.454.CMB.2.raw
  modified_base (250)..(250): a, c, t, g, unknown or other
  modified_base (260)..(260): a, c, t, g, unknown or other
  modified_base (488)..(488): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctcaggaaatacataganataaatatgnttgctggtatcagcaagaagccaggccacgtcccctgtcgctgactcatctactacaagactaccaagcccgcctgacgggtactcccgtagacgcgtacttctcgtgcctacactcgtagggaactacacgccacctactacgaaccacgtcgggaacgggccgggaacccagggtcctagtaggtagtaagggtactcgtgtaacgtttattaacgttggttacgngggttgacgggaacagcgaacggcggtaaaggggtcgtacggggacgggacggtaaccgttaaacgtccgg

SEQ ID NO: 427505 - DNA, 531 bp, Homo sapiens
  misc_feature: GZ8MTXP01EGJKV.39.20.B09.1.454.CMB.2.raw
  modified_base (256)..(256): a, c, t, g, unknown or other
  modified_base (295)..(295): a, c, t, g, unknown or other
  modified_base (462)..(462): a, c, t, g, unknown or other
tcagtcgcactagtcacgaccggtgctcgatttagtgtagtgtgagggttgagaacctatgaacattctgtagggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctggaatacattaggagataaatntgcttgctggtatcagcagagccaggccagtcccctgtnctgatcactctactacaaagactaaccaaggtcccgacccgtcgagggtactccccgtgacgcgtattctcgtggccttaccaacttccgagggaaccacacgccactcacgaaccacgtcggacggccgggaacccaggcgtagtgagtagaagtctagtaacttnttaatgttagaggttgaggtacgagcgagaacggaaggggttcgtcgggacggagggaaccaaggtccg

SEQ ID NO: 427506 - DNA, 568 bp, Homo sapiens
  misc_feature: GZ8MTXP01B6DF0.39.20.B09.1.454.CMB.2.raw
  modified_base (256)..(256): a, c, t, g, unknown or other
  modified_base (338)..(338): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagcccacgctcagtcgtccgtgtccccaggacagacagccagcatccacctgctctaggaaatacagttagganaataaatatgcttgctggtatcagcagagccaggccagtcccctgtgctgatcatctatacaagtactaccaagccgtaccncgagggacgtcctcgagcgattctctgcctcactcgtacggaacgacacgaccgactactcgaccactacggacggacgggacccgacggtactacggtggagtagacgtacgtacgtacgttaatttaagttgttcggtagggttagggttagggcgacggcgttacgggtaagggtaacgggggttaaggggttacggggcgggacggggtaacccggaacggtccgg

SEQ ID NO: 427507 - DNA, 603 bp, Homo sapiens
  misc_feature: GZ8MTXP01CJ8QP.39.20.B09.1.454.CMB.2.raw
  modified_base (249)..(249): a, c, t, g, unknown or other
  modified_base (257)..(257): a, c, t, g, unknown or other
  modified_base (320)..(320): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctctatgagctgtctcagccacgctcagtcgtccgtcgtccccaggacagacagccagcatccactgctcagaatacattagganaataaatntgctgctggtatcagcaagaacgccacggcctacgttcccctgtcgctagactcacttctaanacaaagactaaccgaacggcccggccctgacgggtacctcccgtggacgtcgtacttcctacgtcgtacctaccgaacgtccgtacgggaaccaccgtacgacctacgtcacgacctacgtaccggacgggacccggtaacccgaggtactacggagtagtacggtaactcgtagtaactttagttaagttcggttacggtagggttcggtagggacacgggttcgaacggtaacgggtaaaggggtcgggtacggggcgggaacgggaaccgaaggtcccgg

SEQ ID NO: 427508 - DNA, 571 bp, Homo sapiens
  misc_feature: GZ8MTXP01AP0HU.39.20.B09.1.454.CMB.2.raw
  modified_base (249)..(249): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaatacatagganataaatatgcttgctggtatcagcagagccaggccagtcccctgcgctgatcatctatcaagataccgagcccgccctcgagggactcccgtagacgcgtattcctctcggcctacccgaacttccgtagggaaaccacgacgcccctacgtcctacgaaccctactccgggaacgggacccggggaccccaagggtccgttaaagcgggtaagttacggaaacgtccgttagtaaccttattaagttcggttgtagggttgtacgggacaggcgaggaacggaaggggtcggtacgggcgggaacgggaaccgaaggtccg

SEQ ID NO: 427509 - DNA, 565 bp, Homo sapiens
  misc_feature: GZ8MTXP01CCE7Y.39.20.B09.1.454.CMB.2.raw
  modified_base (252)..(252): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcacctgctctggaaatacattagganataaatatgcttgctggtatcagcagaagccaaggccacgtcccctgtcgctgactcatctactacaaagactacccaacgccggaccctgacgggtactcccgtagacgtcgtattctcgtcggacctaccaacgtcgtacgggaaacaccgacgcccaactctacgaaccacgtccggaacggaccgggaccccagggtactacgtaggataggaagtctagtacttattgttacgttgtaggttggtagggacacggcgaaggcgtaaagggggtgttacggggcggacgggtaacccgaagtaacccgg

SEQ ID NO: 427510 - DNA, 606 bp, Homo sapiens
  misc_feature: GZ8MTXP01B96EU.39.20.B09.1.454.CMB.2.raw
  modified_base (254)..(254): a, c, t, g, unknown or other
  modified_base (262)..(262): a, c, t, g, unknown or other
  modified_base (306)..(306): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagcccacgctcagtgtccgtgtcccccaggacagacagccagcatccactgctctaggaaatacagttagganaataaatntgcttgctggtatcgagcagaagccaggcctacgtcccctgtcnctgactcatctaactacaagactaaccacggcccgaccctgacgggtacctcccgtgacgtcgtacttcgtcgtcgtacctaccgaactccgtaacgggaaccacgacgtacccactccgtacaaccacgtaccgggacgggaccccgggtaccgacgggtacctagtacggaacgtaggaacgtcgttagtactttaagttaacgttcggttcggtagggttcggtagggacgaggttcgaacggtaacgggtaaggggtcggttaccggggacgggttacggaaccgaacggtcccgg

SEQ ID NO: 427511 - DNA, 493 bp, Homo sapiens
  misc_feature: GZ8MTXP01BA2B9.39.20.B09.1.454.CMB.2.raw
  modified_base (436)..(436): a, c, t, g, unknown or other
  modified_base (452)..(452): a, c, t, g, unknown or other
  modified_base (457)..(457): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagccggccctcgagggactcccgtgacgtcgattctctggcctccaactcgtagggaacacgacgccaactctgaccatcgagccggacccaggctagtggactgaagtctagactntaatgttcaggttcgnggacngcaggcgaaggggtcgtcgggcggacggcgaagccg

SEQ ID NO: 427512 - DNA, 547 bp, Homo sapiens
  misc_feature: GZ8MTXP01E1TCT.39.20.B09.1.454.CMB.2.raw
  modified_base (297)..(297): a, c, t, g, unknown or other
  modified_base (328)..(328): a, c, t, g, unknown or other
  modified_base (373)..(373): a, c, t, g, unknown or other
  modified_base (390)..(390): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccagctcagtgtccgtgtccccaggacagacagccagcatcacctgctctggaaatacattaggagataaatatgcttgctggtatcagcagaagccaggccagtcccctgtnctgatcatctatcagataccaagcggccctnacgggactccctgagcgatttcctcttcggcctcccaaacttccnggggaaaccacaacccncccactctacgaccactacggacggaccggacccgaggtctacgtggaacgtacgaacgtcgtagtacttaagttaacgttgttacgtagggttggtacgggacacggcgacggtaacggaagggttcggtcgggacggacggtaaccgaacgtccg

SEQ ID NO: 427513 - DNA, 664 bp, Homo sapiens
  misc_feature: GZ8MTXP01AETR0.39.20.B09.1.454.CMB.2.raw
  modified_base (252)..(252): a, c, t, g, unknown or other
  modified_base (259)..(259): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctagaaatacagttagganataaatntgcttgctggtatcagcagaacgccaggccacgtccctgtcgctgatcatctactacaagactaccgaacgccgaccctgacgggctcccgtgacgtcgtacttcgtcgtcgcctacaacgttcgacgggaaacctacgacgaccctaccgttctaccggaaccctacgtacccggggacgggaccccggggaaccccgtaagggtaccgttaaggtgggaattaacgggaaacgttccgttaaggtaacctttaagtttaagttcggttaacggtacggggttgggtaccgggggtaaagaccgggttacggaaccggggtaaacgggggttaaaaggggggttccgggttaaccggggggaaccgggggttacgggtaaaccccgttaacgggtaaccccggg

SEQ ID NO: 427514 - DNA, 606 bp, Homo sapiens
  misc_feature: GZ8MTXP01DB9P1.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcacctgctactaggaaatcagttagagaataaatatgcttgcttggtatcagcaagacgcccaggcccacgtcccctgtcgctgactcatctacacaaagctaaccgacgcccggccctcgacgggtactcccgtaggacgcgttactctacgtcggtcctacctaacgtccgtaacgggaaccaaccgacgacccactcgtacgacctacgtaccgggacggacccgggacccgacggtcctaagcggtagtaacgacgtacgttacgtacttagtttaagttgttcggtagggttggtacgggacgaacggcgaaggtaacgggtaaaaggggttcggttaccgggacggggttaccgggtaaccgaacggttccgg

SEQ ID NO: 427515 - DNA, 589 bp, Homo sapiens
  misc_feature: GZ8MTXP01CU10J.39.20.B09.1.454.CMB.2.raw
  modified_base (251)..(251): a, c, t, g, unknown or other
  modified_base (259)..(259): a, c, t, g, unknown or other
  modified_base (498)..(498): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctctatgagctgtctcagcccacgctcagtcgtccgtcgtccccaggacagacagccagcatccactgctctagaatacagtagganaataaatntgtcttgcgtaggtactcagacaacgaacgcccgacggaccctaccggttccccctaggttcgccgtagactactagttactaactaacgaaacgtactaaacccgaacggccccgggaccctcggacggtacctccgtagacgctacttctcgtcgtacctactactcggtaacggaacctacgacgcccaacgtctacgaccagtaccgacggaccgggaccaggtactagaggtanacgaactcgtagtacttattaagtgcgtaggttggtacggacagcgaggaacggtaaggggtcgtacgggacggttacgtaaccgaagtcg

SEQ ID NO: 427516 - DNA, 756 bp, Homo sapiens
  misc_feature: GZ8MTXP01AHQNL.39.20.B09.1.454.CMB.2.raw
  modified_base (253)..(253): a, c, t, g, unknown or other
  modified_base (263)..(263): a, c, t, g, unknown or other
  modified_base (470)..(470): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcactgctctaggaaatacagttagganaataaatgtntacttgtcgtaggtactcgagacgagaacgccgacggaccctaccgtccccgtgtcgcgtagtactactactactaactaccgaaagtacctaaacccgaacgccccggtacccgtaacggaccgggtacctcccgtaggtaccgtcgttactttccgttccgtacggtacccttaacccgtaaccgtccgggtaacggaaaccccnccgtaaccgaccctaccgtaccgtacgaacccttacgaccgggggaaccgggaccccggggaccgtaacgggtacttaaacggtcgggaagttaaccgaacggttacgttaaccgttaaacgttttagttttaacgttccggggttaagggttaacggggttaggttacggggaaaccgttacgggttagggaaaccggggtaaaccgggggttaaaggggtttcccgggggttaacgggggaacccgggggttaaacggggaacccgttaacggtaaccccgggg

SEQ ID NO: 427517 - DNA, 571 bp, Homo sapiens
  misc_feature: GZ8MTXP01EKGSI.39.20.B09.1.454.CMB.2.raw
  modified_base (259)..(259): a, c, t, g, unknown or other
  modified_base (433)..(433): a, c, t, g, unknown or other
  modified_base (524)..(524): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctacgtaggaaatacaagttaaggaanaataaaatatgacttgcgtaggtactcaagacgaagaaacgcccgaaggcccctagtccccctagtcgctagatcattctaactacaaagactaacccgaagcccggaccctgagggacttcccgagacgacgatttctccgtggacctaccaacgttcacgggaaacacgacnccactcacgaaccgacacggacggacgggaacccaggaccttagagagtaagacgtatatattattaagttcgttgtaggttgacgggaanagacgaaggaagggtagggtcggtacgggacggacggaacgaacgcg

SEQ ID NO: 427518 - DNA, 562 bp, Homo sapiens
  misc_feature: GZ8MTXP01DJ3W5.39.20.B09.1.454.CMB.2.raw
  modified_base (252)..(252): a, c, t, g, unknown or other
  modified_base (302)..(302): a, c, t, g, unknown or other
  modified_base (486)..(486): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatacattagganaataaatatgcttgctggtatcagcagaagccaggccacgtcccctgtcnctgatcatctaatacaaagactaacccgaaggcccggaccctcgacgggtactccccgtaggacgcgtactttcctcgtcggtcctaccaacgttcgtacgggaaaccaccacgaccctacttacacgaaccacgtcggaacggccggggaacccagggcctagtgatagaagtcctagtactnttaatgttcgtaggttgtagggacaggcgttaggaacggtaaggggtcgtcggggacggacggaaccgaaggtccg

SEQ ID NO: 427519 - DNA, 628 bp, Homo sapiens
  misc_feature: GZ8MTXP01AY8HF.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattaggaagataaatatgcttgctggtatcagcagagcaggccagtcccctgcgctgatcatctactacaaagactaccgagaccgcccgtcgacgggtactcccgtagacgtcgtattcctcgtcggtcctaccgaaacgtccgtacgggaaaccaaccgaccgaccctacctccgtaacggaccttaacgaccggaacggacccgggaacccgtaacggtcctaaggtacggacgttaaggaacgtacgttacgtaactttaagtttaagtttacggttacggttagggttaggttacgggtaacgacggttccggaggaaccgggtaaagggggtcggttacggggaccggggttaagggaacccgttaacggtaacccgg

SEQ ID NO: 427520 - DNA, 587 bp, Homo sapiens
  misc_feature: GZ8MTXP01BLR1H.39.20.B09.1.454.CMB.2.raw
  modified_base (273)..(273): a, c, t, g, unknown or other
  modified_base (298)..(298): a, c, t, g, unknown or other
  modified_base (343)..(343): a, c, t, g, unknown or other
  modified_base (529)..(529): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctggaaatacattaggagaataaatatgcttgctggtatnagcagaacgccaggccacgtccccngtcgctgactcatctaactacaagtacaccgaacgcccgtacccncgacgggacctcccgtagtacgcgtacttcgtcgtcgacctacctaacgtcgtacgggaaaccaccgacgaccccacgtccgtacgaaccctaacgccgggacggacccggggaccctagggaccttaagcggtagtagaagtcctagtaccttaagttcgtcgttcgtaggttggagggaaccgngccggagggaacggtaagggggttcggacggggcgggaacgggtaaccgaaggtcccg

SEQ ID NO: 427521 - DNA, 619 bp, Homo sapiens
  misc_feature: GZ8MTXP01BUSD4.39.20.B09.1.454.CMB.2.raw
  modified_base (235)..(235): a, c, t, g, unknown or other
  modified_base (306)..(306): a, c, t, g, unknown or other
  modified_base (340)..(340): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctcngaaatcattaggagataaatatgcttgctggatcagcagagccaggccagtcccctgtgctgatcatctanacaagactaccaagccgccctgagggactcccgngacgcgtattctcgtcggtcctaccgaacgtaccgtaggggaaaccacgacgccccaacgttcctacggtaacctacgttaccgggaacggcccggggaaaccccgaggggtaccctaagtcgggtaacgtaggaaacgtcccttaaggtaacctttaagttaagtttcggttaccgtagggttcggtacggggaacttagggccgaagggtaacgggaaacgggggttcgggttaacgggggaccgggttaacggggtaacccgaacggtaacccggg

SEQ ID NO: 427522 - DNA, 654 bp, Homo sapiens
  misc_feature: GZ8MTXP01C9Z1O.39.20.B09.1.454.CMB.2.raw
  modified_base (249)..(249): a, c, t, g, unknown or other
  modified_base (256)..(256): a, c, t, g, unknown or other
  modified_base (315)..(315): a, c, t, g, unknown or other
  modified_base (320)..(320): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcactgctcaggaatacattagganataaatntgcttgctggtatcagcagacgcccgaggcctacgtcccctgtcgctgactcatctacncaaanatacccaagccgccctgagggtactcccgtgacgcgtattctcgtcgtcctaccaacgttcgtaacgggaaccacgacgccctaactccgtacggaaccctacgttaccggaaccggggacccggggtaaacccccgtaggggtcccttaaaggtcggggtaattaaacgggaacgtaccgttaaggtaaaccttttaagtttaagttttcggttacgggtaaggggtttcgggtagggggtaacccaaggggttccgaaaggggtaaccgggtaaagggggtttcggttaccgggggacggggttaaacggggtaacccgaaagggttcccgg

SEQ ID NO: 427523 - DNA, 505 bp, Homo sapiens
  misc_feature: GZ8MTXP01DOHSH.39.20.B09.1.454.CMB.2.raw
  modified_base (330)..(330): a, c, t, g, unknown or other
  modified_base (387)..(387): a, c, t, g, unknown or other
  modified_base (451)..(451): a, c, t, g, unknown or other
tcagtcgcactagtcacgaccggtgctcgatttagtgtagtgtgagggttgagaacctatgaacattctgtagggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatcattaggagaataaatatgcttgctggtatcagcagaagccaggccagtcccctgtgctgatcatctatcaaagataccaagccgccctnagggatcccgtgagcgattctctgcctaccaactcgtagggaacacacgcccactcngaccatcggacgccgggacccaggactagtggatagaagctagactattaattgcgtaggttgngggaacagggcaggaacggtaaggggtcgtcgggacgggacggaaccgaagtcg

SEQ ID NO: 427524 - DNA, 609 bp, Homo sapiens
  misc_feature: GZ8MTXP01CI2EP.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcacctgctcgtaggaatacagttaggagaataaatatgtcttgctggtactcagacagaacgcacggccacgtcccctgtcgctagactcatctaactacgaaagtactaaccgaacggcccgtaccctcggaacgggtacctcccgtagacgtacgtacttccgtcgtcgacctacccgactccgtacgggaacctaccgacgaccctactctacgacctacgtccgggaacggacccgggaaccagggtactagacggataacggaactcctagtaacttagttaacgttggttacggtaggttcggtaaggaccaggcgaacgggtaacgggaaaggggttcgtaccggggacgggaacggaaccgttaacggtcccgg

SEQ ID NO: 427525 - DNA, 526 bp, Homo sapiens
  misc_feature: GZ8MTXP01BC8H1.39.20.B09.1.454.CMB.2.raw
  modified_base (235)..(235): a, c, t, g, unknown or other
  modified_base (248)..(248): a, c, t, g, unknown or other
  modified_base (359)..(359): a, c, t, g, unknown or other
  modified_base (469)..(469): a, c, t, g, unknown or other
  modified_base (476)..(476): a, c, t, g, unknown or other
  modified_base (509)..(509): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctcngaaatcattaganataaatatgcttgctggtatcagcagagccaggccacgtcccctgtgctgatcatctatcaaagactaaccgaagcccggcccctgagggtactcccgtgacgcgtattcncgttggaccttaccgaactccgtagggaaaccacacgcccacttcagaaccagtcggaacggccggggaacccaggtctaagtggatagaagtctagaacttagtgttgngtaaggngtaggacagcaggaacgaaggggttgaccgggngacggaacgttaagccg

SEQ ID NO: 427526 - DNA, 569 bp, Homo sapiens
  misc_feature: GZ8MTXP01ATWNK.39.20.B09.1.454.CMB.2.raw
  modified_base (306)..(306): a, c, t, g, unknown or other
  modified_base (378)..(378): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacacgccagcatccacctgctcgtaggaaatacattaggagaataaatatgcttgctggtatcagcagacgccaggccacgtcccctgtcnctgatcatcactacaaagactaacccgaagcccggaccctcgacgggtactccccgtagacgcgtactttcncgtacggtcctaccgaactcgtaacgggaaccacgtacgcccacttcacgacctacgcgaacggccgggacccaggcctaagcggaatagaacgtctagtacttattaagttcgagtaggttggaggtacaggccgttaggaacggtaagggggttggtccggggacgggttacggaaccgaaggtcccgg

SEQ ID NO: 427527 - DNA, 488 bp, Homo sapiens
  misc_feature: GZ8MTXP01BPI2O.39.20.B09.1.454.CMB.2.raw
  modified_base (251)..(251): a, c, t, g, unknown or other
  modified_base (407)..(407): a, c, t, g, unknown or other
  modified_base (415)..(415): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattagganataaatatgcttgctggtatcagcagaagccaggccagtcccctgtgctgatcatctatcaagataccaagccgccctgagggatccctgagcgattctctggctccaactcgtagggaaacacagccactctgaccatcgagccggaccaggcanggatgaanctgactattaattgttcgaggttgtagggacagcaggaacgaaaggggtgtcgggcggaggaaccgaagtccg

SEQ ID NO: 427528 - DNA, 608 bp, Homo sapiens
  misc_feature: GZ8MTXP01CEBVL.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatacagttaggagaataaatatgcttgctggtatcagcagaacgcgacgccacgtcccctgtcgctagactcactctaactacaaagactaacccgaaggcccgaccctcgacgggtacctcccgtagacgtacgtatttcctcgtcggtcctaccgaaccgttaccgtacggggaaaccaccgacgacccctactccgtacgacctaacgtccggaacggcccgggaacccagggtactagtacggagttacgaagtctacggtaactttagttaattgttacggtaggttggtacgggacaaggttcgacggtaacgggtaaaggggtcggttacggggcgggaacgggtaacccgaaggtcccgg

SEQ ID NO: 427529 - DNA, 731 bp, Homo sapiens
  misc_feature: GZ8MTXP01B6A2Z.39.20.B09.1.454.CMB.2.raw
  modified_base (248)..(248): a, c, t, g, unknown or other
  modified_base (254)..(254): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtcgtccccaggacagacagccagcatcacctgctcagaatcatagganataatntgacttgctggtatcagcagacgccaggcctacgtccctgtcgctgactcatctactacagactaccgacgccgaccctggacggtactcccgtagacgtcgtacttccgtcgtcgtaccctcgaaccgttccgaacgggtaaaccacccgtaacggtacccctaccgttaccgtaccggaaccccaaccggtttaccggaaccggggtacccccggggaaccccgtacggggtacccgtttaacggtagggtacggtttaacggaaccggttaccgttaacgggtttaaaccttttaaccgtttaagggttttcccggttacgggttaacgggggttagggtaaccgggggttaacgttaaaacccggggcggttaaaaccgggggttaacgggggttaaaaccggggggttcgggtttacccgggggggacgggttaaaccggggggtaacccgttaagggggttaacccccggg

SEQ ID NO: 427530 - DNA, 646 bp, Homo sapiens
  misc_feature: GZ8MTXP01A48ZG.39.20.B09.1.454.CMB.2.raw
  modified_base (125)..(125): a, c, t, g, unknown or other
  modified_base (253)..(253): a, c, t, g, unknown or other
  modified_base (261)..(261): a, c, t, g, unknown or other
  modified_base (435)..(435): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctntcttcctcggcgtccttgcttactgcacaggatccgtggcctcctatgagctgtctcagccacgctcagtcgtccgtgtccccaggacagacagccagcatcactgctcgtaggaaatacattagganaataaatntgtcttgctggtatcagcagacgccaggccacgtcccctgtcgcgtagactcatctacgtacaaagactaaccgaacggcccggtaccctggaacgggtactcccgtaggaccgtcgtattccgtaccgtcgcctaccacgtacggtacggaaaccacgaccgtacccttaccncgtaacgaccgtacgaccggggaacgggacccggtaccgtacggtacgtagtaggtagtacggtaacgtcgttaacgttactttaaggttaacgttcggttacgggtagggttacggtaacgggtaacgacgggttacggttaacggggtaacggggtaacgggggttcgggtaccggggacgggttaaccgggtaaccgttaacggtccg

SEQ ID NO: 427531 - DNA, 597 bp, Homo sapiens
  misc_feature: GZ8MTXP01EVYU9.39.20.B09.1.454.CMB.2.raw
  modified_base (259)..(259): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctctatgagctgtctcagccacgctcagtcgtccgtgtccccaggacagacagccagcatcacctgctctaggaaatcattaggagaataaatntgcttgctggtatcagcagaagccaggccagtcccctgtcgctgatcatctactcaaagactaccgaagcccggaccctgacgggtactccccgagacgtcgattcctcgtcggtacctccgaaacgtcgtacgggaaaccacgacgccactcgtacgacctacgtaccgacggaccggggaacccctagggaccgtagtggagtaggaaacgtcgtacgtaacttagtttaacgttggttaccgtaaggggttcggtaggggaaccaggcgacgggtaaccgggtaaagggggttcggttaccggggaggggttaacgggaaccgttaaggtcccgg

SEQ ID NO: 427532 - DNA, 609 bp, Homo sapiens
  misc_feature: GZ8MTXP01AOI5G.39.20.B09.1.454.CMB.2.raw
  modified_base (230)..(230): a, c, t, g, unknown or other
  modified_base (256)..(256): a, c, t, g, unknown or other
  modified_base (269)..(269): a, c, t, g, unknown or other
  modified_base (296)..(296): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctnctctaggaatacagttagagataatntgctgctggtatnagcagacgccaggccacgtccctgtcnccgtgactcagttctaactacgaagtacgtaaccgaacggacccgtcccgtaacgacgggtacctcccgtaggacggtccgtatttccgtcgtcggtacctaccgaaccgtcgtaacgggtaaccaccgtacgaccctacgtctacgaaccctagtccgaacgggaccgggaccacggtccttagtcggaagtacggacgtcctagtaaaccttgttaagttcggagtagggttcggtaggaccttaggcgttaagggtaaccgtaaagggggttcgtaggggaccgggacggtaacccgttaaggtccccgg

SEQ ID NO: 427533 - DNA, 617 bp, Homo sapiens
  misc_feature: GZ8MTXP01EM92C.39.20.B09.1.454.CMB.2.raw
  modified_base (253)..(253): a, c, t, g, unknown or other
  modified_base (261)..(261): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggactccgtggcctctatgagctgtctcagccacgctcagtgtccgtgtccccaggacagacagccagcatcacctgctactaggaaatacagttagganaataaatntgcttgctaggtatcagacagaagccaggcccacgtcccctgtgctgactcatactaactacgaaagtactaaccgaaacggcccggacccctggacgggtacctacccgtaggacgtcgtattcctacgtcgcctacaaacgtcgtaacgggaaaccacgacgtccaactctacgaaccctaagtccggggaacggcccggggaaccctagggtaccttaggaggataacgaagtccgtagtaactttaagttgtttcggttcggtagggttggaacgggtaacagggacgttaagggtaacggtaaaggggggttcgtacgggggaccggggaacggtaacccgaagggtcccg

SEQ ID NO: 427534 - DNA, 597 bp, Homo sapiens
  misc_feature: GZ8MTXP01CCHL8.39.20.B09.1.454.CMB.2.raw
  modified_base (259)..(259): a, c, t, g, unknown or other
  modified_base (456)..(456): a, c, t, g, unknown or other
  modified_base (488)..(488): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccagctcagtcgtccgtcgtcccgaggacagacacgccagcactcacctgctactaggaaatactagttaagganaaataaatagtgtacttgcgtaggtatcgagacgaacgaacgcccgaacggcctacgtcccctgtcgctagactcattactaactacgaaagacgtaacccgaacggcccgccctggacgggtaacctcccgtagacgcgttacttcctcgtcgacctacgaacgtcgtaggaaccacgacaccactcgacacctanccggacgggaccggaccgagacgtagaggtanaagagtcgtagtacttagttaagttgcgtagggttcgtacggacgttacggcgacggtaacgggtaagggggtcgtacggggacgggacggtaaccgttggtaacccgg

SEQ ID NO: 427535 - DNA, 594 bp, Homo sapiens
  misc_feature: GZ8MTXP01EWGJW.39.20.B09.1.454.CMB.2.raw
  modified_base (236)..(236): a, c, t, g, unknown or other
  modified_base (251)..(251): a, c, t, g, unknown or other
  modified_base (271)..(271): a, c, t, g, unknown or other
  modified_base (471)..(471): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtcccgtgtccccaggacagacagccagcatcacctgctcnggaaatcattagganataaatatgcttgctggtancagcaagacgccaggccctacgtcccctgtcgctagatcatcctaatacaaagactaccaacggcccggccctgacgggtactccccgtagacgtcgtactttcctacgtcggtacctaccgaacgtccgtaacgggaaaccaccgacgacccactccgtacgacccagtccggacggacccggggacccagggcctagngggtatacggaactcgttacgtaactttaagttaagttcggttacgtggggtttggacgggaacaggcgacgggtaagggtaagggggttcggtacggggacgggacggaaccgaagtcccgg

SEQ ID NO: 427536 - DNA, 724 bp, Homo sapiens
  misc_feature: GZ8MTXP01BEP1T.39.20.B09.1.454.CMB.2.raw
  modified_base (258)..(258): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggactccgtggcctcctatgagctgtctcagccacgctcagtcgtccgtcgtccccaggacagacacgccagcatccacctgctcgaggaaatacagttaggaanaataaatatgcttgctggtatcagcaagaacgccgacggcctacgtcccctgtcgctagactcaacttctaactacaaacgtaactaacccgaacggccccggtaccctggacgggtacctccccgtaggaacgtccgtactttccgtccgtacggtacccttaccgaacgtttcggacgggaaacccacgtaccgccctaacgttcgtaccgaacccacgtacggggaacggggtccccggggaaacccctgggtacgtaacgtagggtaacgttacgggaaacgtccgttaaggtaacttttaggtttaaagtttcgggttaccgggttaaagggggttggggtaaacggaaccgttacggggaaccggttaacggggtaaacgggggttaaaacggggggttccggggttacccgggggaacggggttaaaccgggggaaccccgtttaaggggtaaccccgg

SEQ ID NO: 427537 - DNA, 562 bp, Homo sapiens
  misc_feature: GZ8MTXP01C5VL3.39.20.B09.1.454.CMB.2.raw
  modified_base (251)..(251): a, c, t, g, unknown or other
  modified_base (258)..(258): a, c, t, g, unknown or other
  modified_base (461)..(461): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatcccctctcttcctcggcgtccttgcttactgcacaggatccgtggcctcctatgagctgtctcagccacgctcagtcgtccgtcgtccccaggacagacagccagcatcactgctcagaatacattagganataaatntgcttgctggtatcagcaagacgccaggccctacgtccccgtagtcgcctgactcagtcctatacaaagactacccgaacgcccgaccctgacgggtactccccgtgacgtcgtattcctcgtcggtcctacctaacgtcgtaacggaaccacgacgcccacgtctacgacctacgacggacggaccggacccgagtcctagnggatacgaagtctagtacttagttaacgttgacgtagggttgagggacaggcgaggtaacggtaaggggtcggtacgggacggacgggaacgaacggtccg

SEQ ID NO: 427538 - DNA, 582 bp, Homo sapiens
  misc_feature: GZ8MTXP01CUVXX.39.20.B09.1.454.CMB.2.raw
  modified_base (235)..(235): a, c, t, g, unknown or other
  modified_base (252)..(252): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagcccacgctcagtcgtccgtgtccccaggacagacagccagcatcactgctntaggaatacattagganataaatatgcttgctggtatcagcaagaacgccaacggcctacgtcccctgtcgctgactcattctaatacaaagctaaccgaacggtcccgaccctgacgggtactcccgtagacgactattcctgtcgacctacaactcgtagggaacacgacgtaccaacttcgacgaaccagtaccggacggcccgggaacccagggtacctaagtggtaatacggaaacgtcctaagtacttagttaagttgttacggaggttacggtacgggacaggttacgacggtaacgggtaaggggtcggtacgggagggaacggaacgttaaggtccgg

SEQ ID NO: 427539 - DNA, 617 bp, Homo sapiens
  misc_feature: GZ8MTXP01AD50D.39.20.B09.1.454.CMB.2.raw
  modified_base (124)..(124): a, c, t, g, unknown or other
  modified_base (258)..(258): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctntcttcctcggcgtccttgcttactgcacaggatccgtggcctctatgagctgtctcacgccacgctcagtcgtccgtcgtccccagacagacagccagcatcacctgctcgtaggaaatacatagagataaatntgcttgctggtatcagacgagacgccacggcctacgtccccgtgtcgctgatactactactaactacaaagtactaaccgaacgcccgaccctcgacgggtacctcccgagacgtcgtacttccgctcgacctaccaacgttcgtaaggaaccctacgacgtccctacgttacgaccgaccctagtaccgggaacggggaccccgggtaaccaggtaccgtagacggtagttacgaaacgtgttaacgttaactttagttaacggttcgttcgggtaggcgggtacgggaacacggttcggaacgggtaacggtaagggggtcggtacggggacgggttacggaaccgaacgtaaccgg

SEQ ID NO: 427540 - DNA, 557 bp, Homo sapiens
  misc_feature: GZ8MTXP01BGSKL.39.20.B09.1.454.CMB.2.raw
  modified_base (256)..(256): a, c, t, g, unknown or other
  modified_base (408)..(408): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagcccacgctcagtcgtccgtcgtccccgaggacagacacgccagcactcacctgctcgagaatacagttagganaataaatgtgtcttgctggtactcgaagacgaagaacgccgacggcctacgttcccctgtcgcttagactcatcctaaacacaagactaccgacgccgacctgacgtactcgagtctctcttctcgtcgtactactacgtacgaacgaaccncgactccacgcacgactaccgacggacggaccggacaggagtacgagactagtactcgtagttacttgttaacgtggttacggtaggttcggaagacgacgacggaacggtaacgggtagggtcggacgggacggacgtaacgcggtcg

SEQ ID NO: 427541 - DNA, 613 bp, Homo sapiens
  misc_feature: GZ8MTXP01CNFAD.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggactccctctcttcctcggcgtccttgcttactgcacaggactccgtggcctcctatgagctgtctcagccacgctcagtcgtccgtcgtcccaggacagacagccagcatcactgctctaggaaatacattaggagaataaatatgcttgctggtatcagcagaacgccaggccacgtcccctgtcgctgactcattctaactacaaagactaaccgaacgcccggtccctgagggtacctcccgtgacgtccgtattccctcgtcggaccctaccgtaacgtcgtaacgggaacctacgacgcccactctaacgacctacgtccggacgggtacccgggacccagggtacctaggtggaattacggaaacgtcttacggtaactttaagttaacgttcgttacgggtaggggttggtacggggacaggacggacgggtaacgggtaaagggggttcggtacgggggacgggttacgggaaccgaaggtaacccgg

SEQ ID NO: 427542 - DNA, 708 bp, Homo sapiens
  misc_feature: GZ8MTXP01B7VG4.39.20.B09.1.454.CMB.2.raw
  modified_base (254)..(254): a, c, t, g, unknown or other
  modified_base (262)..(262): a, c, t, g, unknown or other
  modified_base (659)..(659): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcacctgctacaggaaatcagttagganaataaatntgtacttgctggtactcgagacgaagacgcccgacggcccctacggttcccccgtggtacgtcttacgtactacctaacttacctaaacgtaaccgtaaaacgtaaccgttaaaccccgaaacgggtcccccgggtacccccgttcgggaaccgggggttaacccttcccccggtaggaccggtaccggtttaacgtttcccgtcgttacggtaccctaccccgtaaacgtccggtaaacggggaaacccaccgaccgtacccctaccttaccgtaaccgaacccgtacgtaaccgggggaaccgggaccccggggtaaccccgaagggttacctaaggtcggtaagtacgaagtccgtaagtacttagttaacgtgttacggagggttgagggacngcggaggaacgggtaaggggtcggtcggacgggacgtaaccgaagtccg

SEQ ID NO: 427543 - DNA, 564 bp, Homo sapiens
  misc_feature: GZ8MTXP01DSA25.39.20.B09.1.454.CMB.2.raw
  modified_base (255)..(255): a, c, t, g, unknown or other
  modified_base (263)..(263): a, c, t, g, unknown or other
  modified_base (467)..(467): a, c, t, g, unknown or other
  modified_base (478)..(478): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctctatgagctgtctcagccacgctcagtcgtccgtcgtccccaggacagacagccagcatccactgctacgtagaaatacagttaagganaataaatntgacttgctggtatacagcaacgaacgcccgaaggcccacgttcccctgtgctagactcatactacacgaaagtactaaccgaacggcccgtaccctcggacgggtacctcccgtagacgtcttacttcctcgtcgacctactaactcgtaacggaacacgacaccacttcacgacctagacggacggaccggaccaggctagngagtagacgtntagtactattgtgttacgtagggttggacgacgagcgaaggtaagggtaaggggttcgacggggacggacggtaacgaacgtccgg

SEQ ID NO: 427544 - DNA, 604 bp, Homo sapiens
  misc_feature: GZ8MTXP01DL7CX.39.20.B09.1.454.CMB.2.raw
  modified_base (293)..(293): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatcccctctcttcctcggcgtccttgcttactgcacaggatccgtggcctcctatgagctgtctcagccactctcagtcgtccgtgtccccaggacagacagccagcatcactgctctggaaatacattaggagataaatatgcttgctggtatcagcagagccagccagtccccngtgctgatcatctactacaagtactacccaacgcccggaccctgacgggtactccccgtgacgtcgtattctctggcctaccgaacttcgtagggaaaccacgacgcccacgttcctacggaacccacgtaccggaacgggcccggggaaccccgagggtaccttaagtggtataggtaacgtcttacggtaacctttagttaagtttcggttacgtgggtttaggacgggtaaccaggttcgaacgggtaacgggtaaagggggttcggttaccgggggacggggaacgggtaacccgaacgggtcccgg

SEQ ID NO: 427545 - DNA, 574 bp, Homo sapiens
  misc_feature: GZ8MTXP01AWZCX.39.20.B09.1.454.CMB.2.raw
  modified_base (125)..(125): a, c, t, g, unknown or other
  modified_base (251)..(251): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctntcttcctcggcgtccttgcttactgcacaggatccgtggcctcctatgagctgtctcagccacgctcagtgtccgtgtccccaggacagacagccagcatcacctgctctaggaaatcattagganaataaatatgcttgctggtatcagacagacgccaggccctagtcccctgtgctgactcatctacacaaagtactaaccgaacggcccggtccctaacggacgggaaccttcccgtgaacgtcgtacttctctcgtactacctactacgtacgaacacgacgccactctacgactacgacgacgaccggaccgacgtactagagttttttagagtacgtagtagtacttagttaagttgttagtaggttggtaggaacgacgcgaggtaaccggtaaggggttaacgggttacgggacgggacgggaaccgttaacggtcccgg

SEQ ID NO: 427546 - DNA, 533 bp, Homo sapiens
  misc_feature: GZ8MTXP01DK3MA.39.20.B09.1.454.CMB.2.raw
  modified_base (300)..(300): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctggaaatacattaggagaataaatatgcttgctggtatcagcagaagccaggccacgtcccctgtnctgatcatctatcaagataccaagccggccctcgagggactcccgtagacgcgtattcctctcggcctaccaactcgtagggaaccacacgcccactctacgaccatcgacgccgggacccagggtcctaagtggatagaagtctagtacttattaagttgttcgtaggttggtcgggacaggcttaggaacggaaagggggtcgttcgggcgggagggtaaccgaagtccgg

SEQ ID NO: 427547 - DNA, 652 bp, Homo sapiens
  misc_feature: GZ8MTXP01DIGY4.39.20.B09.1.454.CMB.2.raw
  modified_base (248)..(248): a, c, t, g, unknown or other
  modified_base (254)..(254): a, c, t, g, unknown or other
  modified_base (297)..(297): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagcccacgctcagtcgtccgtgtccccaggacagacagccagcatcacctgctcagaatcataganataatntgctgctgtatcagcagaacgccaggccctacgtcccctgtcnctagatcatctaactaccaaagactaacccgaacggcccgtaccctggacgggtaccttccccgtaggaccgtcgtactttccgtcgtcggtacctacctaacgtcgttaacgggaaaccaccgacgaccctactctacggaaccctagtaccggaaccggggaccccgggaaaccgtacgggtaccgttaaggcgggaaagttaacgggaaaccgtcgttaacggtaacctttaagtttaaggtttacggttaccgggtagggttacggtacggggaacacggcggaacgggtaaccggggtaaagggggtcggttacgggggacgggacgggtaacccgttaaggtaacccgg

SEQ ID NO: 427548 - DNA, 635 bp, Homo sapiens
  misc_feature: GZ8MTXP01ASH6K.39.20.B09.1.454.CMB.2.raw
  modified_base (251)..(251): a, c, t, g, unknown or other
  modified_base (364)..(364): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcactgctctaggaaatcattagganataaatatgcttgctggtatcagcaagagccaggcctacgtcccctgtgctgactcatctactacaagtactaccaagcccgccctgacgggtactccctgagtcgtattccncgtcgcctaccaacgtcgtacgggaaccacacgtcccaacttcgacgacctagtccggaacggggccgggaaccccaggggtacctaaggtacggtaagtaacgaacggttcgtacggtaaacctttagtttaaccggtttacgttagggtaaagggttccggttaagggggaaacccttaggggttccaaggggtaacccgggttaaaaggggggtcggtttacgggggaaccgggggttacgggaaccccggttaaggttaaccccggg

SEQ ID NO: 427549 - DNA, 550 bp, Homo sapiens
  misc_feature: GZ8MTXP01EPE8B.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccacgtcccctgtgctgatcatctactcaaagactaccaagccggccctcgacgggactccccgtgacgcgacttctctggcctaccaactcgtagggaaaccacacgcccactctcgaacccataccggacggccggggaccccagggcctagtggatggaagtcctagtacttatttaattggttcgtagggttggtaggggacaggcagggaacggtaaagggggtcggttacggggcgggacggggaacccgaaggtccgg

SEQ ID NO: 427550 - DNA, 574 bp, Homo sapiens
  misc_feature: GZ8MTXP01BJ6EO.39.20.B09.1.454.CMB.2.raw
  modified_base (521)..(521): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagaataaatatgcttgctggtatcagcagaagccaggccaggtcccctgtgctgatcatctatacaagataccaagccggacccctgaacgggactccctggacgcgtactttcgtctcggcctaccgaactcgtacgggaaaccacgacgaccccactcgtacgaacctacgtccggacggtcccggggaaccccgagggtccttaagcgggataggaaacgtccgtagtactttaagttaagttggttcgtagggttgtagggacacggngttaggaacggtaaaggggtcggtacggggacgggagggaaccgaaggtccgg

SEQ ID NO: 427551 - DNA, 681 bp, Homo sapiens
  misc_feature: GZ8MTXP01AGIC9.39.20.B09.1.454.CMB.2.raw
  modified_base (255)..(255): a, c, t, g, unknown or other
  modified_base (299)..(299): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacacgccagcatcacctgctcagaatacatagagataantgctgctgtatcagcagaacgccaggaccctacgtcccctgtcnctgatcatctaactcgaaagactaacccgaacggcccggtacccgtcggacgggtaccctacccgtagaacgtcgttacttccgtccgtacggtacccttacccgtaaaccgttcggtaccgggaaaccacgaccgacccctaacttccaacggaacctagtacccggggacggggtaccccggggaccctaaacggggtcttaaccgacgggtaagttacgaaaccggtccttaaaggtaacctttaagttaagttcgggttaccgtagggggtttacgtacgggggtaaccagggttaccgaggggtaaaccgggttaaggggggtttccggtaaccgggggccggggttaacggaaccccggttaagggttcccccggg

SEQ ID NO: 427552 - DNA, 631 bp, Homo sapiens
  misc_feature: GZ8MTXP01BM8J2.39.20.B09.1.454.CMB.2.raw
  modified_base (234)..(234): a, c, t, g, unknown or other
  modified_base (251)..(251): a, c, t, g, unknown or other
  modified_base (272)..(272): a, c, t, g, unknown or other
  modified_base (523)..(523): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctctatgagctgtctcagccacgctcagtgtccgtgtccccaggacagacagccagcatcactgctacnggaaatacagttagganaataaatatgcttgctggtancagcagacgccgaggaccacgtcccctgtcgctagatcatcctatacaaagactaacccgaacggcccggtacccctcggacggggtaccttccccgtggaacgtcgtacttcctcgtcggcccttaccgaacttccgacgggaaaccacgacgccccacttacctacgaacctacgacggggaacggacccggggaacccacggggtaccttaagtacggggattaggaaacgtccgtacggtaactttntttaacgtttcggttacggtagggttgggtaacgggacagggcgacggtaaccggggtaaggggttcggtaccgggggacgggaacgggtaaccgaacggttaaccgg

SEQ ID NO: 427553 - DNA, 580 bp, Homo sapiens
  misc_feature: GZ8MTXP01AB777.39.20.B09.1.454.CMB.2.raw
  modified_base (252)..(252): a, c, t, g, unknown or other
  modified_base (373)..(373): a, c, t, g, unknown or other
  modified_base (491)..(491): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatcattagganataaatatgcttgctggtatcagcaagaacgcccaggccacgtcccctgtacgctagactcatctactacaagactaccgagcccgggaccctgacgggactcccgtagacgtctattccnctcggcctaccaacgttcgacgggaacctcgacgcccacgttcacgaaccctagaccggacgggacccggggaaccccaggaccgttaagcggataggaactcgttagtacttagttntgttcgtacgggttgtacgggtacagcgacggtcgggtaaagggggttcggtaccgggacggggaacgggtaacccgttaagggtcccg

SEQ ID NO: 427554 - DNA, 587 bp, Homo sapiens
  misc_feature: GZ8MTXP01EUO33.39.20.B09.1.454.CMB.2.raw
  modified_base (247)..(247): a, c, t, g, unknown or other
  modified_base (257)..(257): a, c, t, g, unknown or other
  modified_base (412)..(412): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctctatgagctgtctcagccacgctcagtcgtccgtgtccccaggacagacagccagcatcactgctctggaaatcatagganataaatatgnttgctggtatcagacagaacgccaggcctacgtcccctgtcgctagatcatctactacaacgatacccgaaggcccggtaccctcgacgggacttcccggagtaacgtcttacttctcgtcgcctaccacgtcgtacggaacacgacgccagtcncgaccacgtacgggacggaccgggacctacggtctaagtcgggaatacggaacgtcgttaacgtactttaattaacgttgttacgtggggttacgacggggacaggccgaagggtaacgggtaaacgggggttcgttacggggccgggaaagggtaacccgttaacggtaaccgg

SEQ ID NO: 427555 - DNA, 666 bp, Homo sapiens
  misc_feature: GZ8MTXP01AQ2TJ.39.20.B09.1.454.CMB.2.raw
  modified_base (255)..(255): a, c, t, g, unknown or other
  modified_base (263)..(263): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagcccacgctcagtcgtccgtcgtccccaggacagacagccagcatcacctgctactaggaaatacattagganaataaatntgcttgctggtatcagacagaacgccaggcccacgtcccctgtgctgactcatctaactacaaagtactaacccgaaggcccggtaccctcgacgggtacctcccgtaggacgtcgtactttccgtacgtcggacctaccgaacgttccgtacgggtaaaccacgtaccgaccctaacgtccgtaacgtaccccacgttaccgggacggggaccccggggtaaccccgagggtaccctaaggtcgggtaattacggaacgtccgttagtaacctttaggtttaagttacgggttggtaggggttcggtaacgggaacgttacgggacgaacggggtaacggggtaacggggggttcgggttaccggggggacggggaacgggtaaccgttaacgggtcccggg

SEQ ID NO: 427556 - DNA, 659 bp, Homo sapiens
  misc_feature: GZ8MTXP01AXRL3.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagaccacgctcagtcgtccgtcgtccccaggacagacagccagcatcacctgctcaggaatacattagagaataaatatgcttgctaggtatcagcagaacgccgaggccacgtcccctgtcgctgactcatctaacgtacaaggaactaacccgaacgccccggtaccctcggaacgggtaacctccccgtaggtacgtcgtacttccgtacgtcggtacctaccgtaaccgtcgtacgggaaccacgacgacctactctacgactacgacgggacggacccgggaaccacggtacgtacgtggtaacgttacggaacgtaccgttaggtaactttaaggtttaacgttacggttacggtaggggttcgggttaacgggaccgaagggccgttaacgggggtaaccggggttaaagggggttaacggggttccggggaacgggggttaacgggtaacccggaacggttaacccggg

SEQ ID NO: 427557 - DNA, 633 bp, Homo sapiens
  misc_feature: GZ8MTXP01CEZ0C.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcacgccacgctcagtcgtccgtcgtccccgaggacagacagccagcatccactgctacgtaggaaatacagttaggagaataaatatgtcttgctggtatcgagcaagaacgccaggcccctagtcccctgtgcctgatcatactactaccaaagactaaccgacggcccgtccctggacgggtactcccgtagacgcgtattccgtcgtcgacctacgactcgtacggaaactacgacgacctactctacgaccacgtacggacggtacccgggaccgacggtacctagtacggtaacgtacggtaacgtaccgtagtaaaccgtttagtttaagtttcgggttaccggtagggtttccgggaagggtaccgaaggttccgttaagggtaaccgggttaaaagggggttcggttaccgggggacgggaacggaaccgttaacggtcccggg

SEQ ID NO: 427558 - DNA, 585 bp, Homo sapiens
  misc_feature: GZ8MTXP01D9O65.39.20.B09.1.454.CMB.2.raw
  modified_base (252)..(252): a, c, t, g, unknown or other
  modified_base (273)..(273): a, c, t, g, unknown or other
  modified_base (452)..(452): a, c, t, g, unknown or other
  modified_base (496)..(496): a, c, t, g, unknown or other
  modified_base (539)..(539): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcacctgctactgaaatacatagganaataaatatgcttgcgtgtancgaagcagagcccaaggcccacgtcccctgtcgctagactctaatcctaagtacaaacgaacttaaacccgaaacggccccggccccttaaggaaacggggtaccttaccccgtaggacggtaccggtactttcgtaccgtacggtacctacctaaacgtccgtaaggaaaccacgacncccaacttcgacaacgactcgggacggaccggaccagggctagngatataagctagtatttagttaatcggttagaggttgaggacngcgaggaacggtaaggtggtaccgggaggaggtaacccgaagtccg

SEQ ID NO: 427559 - DNA, 667 bp, Homo sapiens
  misc_feature: GZ8MTXP01EA7XS.39.20.B09.1.454.CMB.2.raw
  modified_base (204)..(204): a, c, t, g, unknown or other
  modified_base (235)..(235): a, c, t, g, unknown or other
  modified_base (253)..(253): a, c, t, g, unknown or other
  modified_base (260)..(260): a, c, t, g, unknown or other
  modified_base (275)..(275): a, c, t, g, unknown or other
  modified_base (356)..(356): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatcccctctcttcctcggcgtccttgcttactgcacaggatccgtggcctcctatgagctgtctcagccacgctcagtcgtccgtntccccgagacagacagccagcatcactgctntaggaaatcagttagganataaatntgcttgctggtactnagcagaacgccaggcctacgtcccctgtgctgactcatctacacaaacgactacgaacgcccgcctaagacggtactcccnggacgtcgtacttcgtcgtagtccttaccgaacgtcgtaacgggaaacccacgtaccgacccgtactaccgtacggaaaccctgttaccggggaccggtacccggggtaaccctaacgggtcctaaggtacgggtaactaacggtaaacgtcgttaaacgttaaccgtttaatttaacggttttcggttacggtagggggttttcggaagggggtaaccttacgggccggttaaacgggaaccggggttaaaagggggttccggttaacgggggaccgggttaaccgggaaccgttaacgggttaacccgg

SEQ ID NO: 427560 - DNA, 597 bp, Homo sapiens
  misc_feature: GZ8MTXP01EZBAP.39.20.B09.1.454.CMB.2.raw
  modified_base (250)..(250): a, c, t, g, unknown or other
  modified_base (257)..(257): a, c, t, g, unknown or other
  modified_base (269)..(269): a, c, t, g, unknown or other
  modified_base (293)..(293): a, c, t, g, unknown or other
  modified_base (309)..(309): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctctatgagctgtctcagccacgctcagtcgtccgtgtccccaggacagacagccagcatcacctgctctaggaaatcagttaganaataatntgcttgctgtancagcagacgcaggccacgtccccngtgctgatcatctaanacaaagtatactacgaaaacggcccggtccctacggacgggtacctccccgtagacgtcgtacttctcgtcggcctaccgaacgtcgtaacggaactaccgacgaccctacgtccacgaccgacgtacgggaacgggaccccgggaaccgtaggtacctaaggtacgggacttacggaaacgtccttaaggtaacttaagtttacgttggtacgttaggtgggtacgggacgttgacgaagggtacggtaagggggtcggtacgggacgggaacggttaaccgaacgg

SEQ ID NO: 427561 - DNA, 636 bp, Homo sapiens
  misc_feature: GZ8MTXP01AVXPE.39.20.B09.1.454.CMB.2.raw
  modified_base (254)..(254): a, c, t, g, unknown or other
  modified_base (262)..(262): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctactaggaaatacagttagganaataaatntgtcttagctggtatcgagcaagaacgccgaggccctacgtcccctagtcgtctagatcatctatacaaagactaccgaagcccgccctgacgggtactcccgtgacgtcgtattccgtacgtcggtacctacccaacgttccggtagggaaacccacgtacgacccacgttcgacgacctacgtaccgggacggtcccggggaaccctagggtaccttaggtcggaacgttaacggaaacgtcccgtaaggttaaccttaagttaagtttcggttacggtaggggttcgacgggtaacttacggacggaacggtaaccggggtaaagggggttccggtacggggacgggaacgggaaccgttaaaggtcccgg

SEQ ID NO: 427562 - DNA, 602 bp, Homo sapiens
  misc_feature: GZ8MTXP01CWC91.39.20.B09.1.454.CMB.2.raw
  modified_base (256)..(256): a, c, t, g, unknown or other
  modified_base (264)..(264): a, c, t, g, unknown or other
  modified_base (308)..(308): a, c, t, g, unknown or other
  modified_base (535)..(535): a, c, t, g, unknown or other
  modified_base (549)..(549): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacacgccagcatcacctgctctaggaaatacagttagganaataaatntgcttgctaggtatcagcaagacgccgacgccacgtcccctgtnctgatcattctactacaaagtactaaccgaacggccccggtacctcggacgggtacccttccccgagggaccgtacgttacttccgttcctcggtaccccttaccgaacgttacgtaccgggaaactaccgacgaccctacttaccacggaccacgtacggggaccggtccggggaacccctagggacctaggttgaacttaggaactcgtagtacttatgttacgngtaggttggaacgngacgcgacggaaggtaaggggtcgtcgggacggacggtaaccgaaggtcccgg

SEQ ID NO: 427563 - DNA, 610 bp, Homo sapiens
  misc_feature: GZ8MTXP01EWCZ5.39.20.B09.1.454.CMB.2.raw
  modified_base (295)..(295): a, c, t, g, unknown or other
  modified_base (300)..(300): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctggaaatacattaaggagataaatatgcttgctggatcagcagacgccaggccagtccccngtcgntgatcattcaataccaaaggactaacccaaggcccggaccctcgaacggggtctccccgtgacgtcgtattcctctcggtacctaccgaactacgtacgggaaaccacctaacggccccaagttccgacgtaaacccagtaccggacgggacccggggaaccccaggtacctaaggtcggtaactaggaaacgtcgtagtaaccttaagttaacgtttggttacgtagggttggtacgggaacaaggttcgaaggtaaccgggaaagggggttcggttacggggacgggacgggaaccgttaaggtcccg

SEQ ID NO: 427564 - DNA, 779 bp, Homo sapiens
  misc_feature: GZ8MTXP01BEROR.39.20.B09.1.454.CMB.2.raw
  modified_base (233)..(233): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctctatgagctgtctcagccacgctcagtgtccgtgtcccaggaccagacagccagcatcacctgctntagaaatacattaggagaataaatagtgacttgctaggtatcgagacgaagaagaccccgaggtacccacgtcccccgtagtcgtaccgtagtacttacctaattacctaaagttaaccgaaagttaaccgtaaaccgaaaccgtcccgggaccccttggacgggtacctaccccgttacggaacgtccggtaaacttccgttcgtacgggtacccgttaacccaaacgtttaccgtaacggggaaaacccgtacgtaaacccgtaccctaaaccgtacccgtaacgtaacccgtaaccgtaaccggggaacccggggtaacccgggaaacccgtacggtaacgttaacggtaacgggtaacggtaaacggtaaacgttaccggttaacgttaaaccgtttaacggtttaacgttaccgggttacgggttaaggggttacgggtaacgggtaaacggaacgttaccggttaacgggtaaaccggggtaagggggttccgggtacgggggaaccgggttaacgggtaacccgttaacgggtaacccg

SEQ ID NO: 427565 - DNA, 552 bp, Homo sapiens
  misc_feature: GZ8MTXP01E0HXS.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctggaaatacattaggagaataaatatgcttgctggtatcagcagaacgccaggcccacgtcccctgtgctgatcattctactacaaagactacccgaagcccgggcccctgagggactcccgtgacgcgtattcctctcggcctaccactcgtagggaaccacgacgcccacttcacgaccatcgacggccggggacccaggctagcggagtgaagtctagtaacttattaagttgttacggagggttcggtaggggacacggcgacggaacggaaagggggttcggtacggggcggggaggtaacccgaaggcccgg

SEQ ID NO: 427566 - DNA, 642 bp, Homo sapiens
  misc_feature: GZ8MTXP01BAIOT.39.20.B09.1.454.CMB.2.raw
  modified_base (258)..(258): a, c, t, g, unknown or other
  modified_base (266)..(266): a, c, t, g, unknown or other
  modified_base (538)..(538): a, c, t, g, unknown or other
  modified_base (631)..(631): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtgcctcctatgagctgtctcacgccacgctcagtcgtccgtcgtccccaggacagacacgccagcatccacctgctcgaggaaatacagttaagganaataaatntgcttgctaggtatcagacaagacgccgacggtcctacgttccccgtgtcgtctagactcattcctaactacgaaagactaacccgaacggccccgtaccctgaacgggtcctacccgagacgtcgttacttccgtctacggacctaccgtaacttcgggaacggaaacctccacgacccctacgtcgtaccaacctacgtaccggggacgggtacccggggaaccccaggtctaacggtgaacgtaacggaacgtcctagttaaacctttnttaacggttcggttacggtaaggggttccggagggaccttaggaccgaaggggtaacggtaagggggtcgtacggggagggaacggaacccgngggtaacccgg

SEQ ID NO: 427567 - DNA, 676 bp, Homo sapiens
  misc_feature: GZ8MTXP01CSUO4.39.20.B09.1.454.CMB.2.raw
  modified_base (253)..(253): a, c, t, g, unknown or other
  modified_base (261)..(261): a, c, t, g, unknown or other
  modified_base (326)..(326): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtcgtccccaggacagacagccagcatcacctgctctaggaaatacattagganaataaatntgcttgctggtatcagcaagaacgccgaacggccacggtccccctgtcgctgactacatcttaanacgaaaagactaaacccgaaacggtccccgacccgtcgaacggggtacctacccgtgaacgcgtacttcctcgttcggacctacccgaacgttccgtaacggggaaaccaccgtacgacccctacttaccgtacgaacccaacgtccggaacgggacccggggacccagggacctaagtcgggtaataacggtaacgtacgtacgtaactttaagttaacgttaggttacgttaggggttcggttaacggggaaccgttaaggccggaaagggtaacggggtaaaacggggggttcgggttaacccgggggacgggggaaaccgggtaacccggaacgggttaaccccgg

SEQ ID NO: 427568 - DNA, 588 bp, Homo sapiens
  misc_feature: GZ8MTXP01BY9I5.39.20.B09.1.454.CMB.2.raw
  modified_base (314)..(314): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcactgctctaggaaatacattaggagaataaatatgcttgctggtatcagcagaagccaggccacgtcccctgtcgctgatcatctacncaagactaacccaggccggaccctcgacgggactcccgtaggacgtcgtacttcctacgtcggcctaccaactccgtagggaaaccacgacgcccactactacgaaccacgtacggaacgggcccggggaaccccagggacctagtagggatagaagtcctagtaacttattaagttgttcgtagggttggtagggacgaggcgacgggtaacgggtaaagggggttcggttaccggggacggggttaacggggaacccgaagggtaacccggg

SEQ ID NO: 427569 - DNA, 599 bp, Homo sapiens
  misc_feature: GZ8MTXP01BBFEV.39.20.B09.1.454.CMB.2.raw
  modified_base (217)..(217): a, c, t, g, unknown or other
  modified_base (416)..(416): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacngcagcatccactgctcgtaggaatacataggagaataaatgtgcttagctggtatcaagcaagaacgccaacggccacgtccccgtgtcgctgatcatcatacaagactaccaacggcccggacccctaaggacggtaacctcccgtaggacgtcgtacttccctcgtcggtacctaccgaaacgtcgtagggaaaccncgacgtccaacgtctacgacctacgcggaacgggcccggaccgaggcgtaagtacggatacgatcctagtacgttattaacgttgttacgggtagggttacggtacgggacacggcgacgggtaaccgggttaaagggggtccggttaacggggccgggttaacggaaccgttaacggtccgg

SEQ ID NO: 427570 - DNA, 616 bp, Homo sapiens
  misc_feature: GZ8MTXP01ED1O7.39.20.B09.1.454.CMB.2.raw
  modified_base (255)..(255): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctctatgagctgtctcagccacgctcagtcgtccgtcgtccccaggacagacagccagcatccactgctactaggaaatacagttaagganaataaatatgtcttgctggtatcagcgaagaacgccgaaggccctacgtcccctgtgctgactcatctacacaagactaccaacgccggtaccctggacgggtactcccgtaggacgtcgtacgttcctctcggacctaccgtaactccggtaacgggaaaccacgtacgccaacgtctacggaacctacgtaccgggacggaccgggaacctagggtacctaggtagggaattacgggaatcggtactaacgtttagttaagttcggttacgtaggggttgtaacggggacgacggcgaaggtaaccgggtaaaggggttccggtacggggacgggttacggaacccggaaggtccccgg

SEQ ID NO: 427571 - DNA, 553 bp, Homo sapiens
  misc_feature: GZ8MTXP01BR0U8.39.20.B09.1.454.CMB.2.raw
  modified_base (249)..(249): a, c, t, g, unknown or other
  modified_base (272)..(272): a, c, t, g, unknown or other
  modified_base (414)..(414): a, c, t, g, unknown or other
  modified_base (453)..(453): a, c, t, g, unknown or other
tcagtcgcactagtcacgaccggtgctcgatttagtgtagtgtgaagggttgagaacctatgaacattctgtaggggcctcaggaagcagcatcggagtgcctcagccatggcatggatccctctcttcctcggcgtccttgcttactgcacaggatccgtggcctcctatgagctgtctcagccagctcagtgtccgtgtccccaggacagacagccagcaatcactgctacaggaatacattagganaataaatatgacttgctggtatnagcagaaacgccagaccacgtcccctagtcgctgatcatactaacgtcaaagactaccaagcccgccctcgagggtaactcccgtagagccgtattctactggaccttaccgaacttcgacggaaacacgacacaccttacncgaacagtcggaacgcgggacccagggtactagtacganagacgtactagtaacttagtaagttcgttacggtagttacggagacgagacgaacggaaggtaagggtcggtacgggacggacgggtaaccgaacggtcg

SEQ ID NO: 427572 - DNA, 570 bp, Homo sapiens
  misc_feature: GZ8MTXP01A1WNO.39.20.B09.1.454.CMB.2.raw
  modified_base (250)..(250): a, c, t, g, unknown or other
  modified_base (259)..(259): a, c, t, g, unknown or other
  modified_base (303)..(303): a, c, t, g, unknown or other
  modified_base (459)..(459): a, c, t, g, unknown or other
  modified_base (505)..(505): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcactgctcaggaatacagtaganataaatatnactgctggtatcagcaagaacgccagggaccacgtcccctgtcncgtgaactcatctaactactaaacgactaacccaacggtcccgaccctcggacgggtacctccgtacgacgtcgtactttcctacgtcggcctaccgaacgtcgtaacgggaaacacgacgccactcgacgactacgacggacggccgggaacccngggtactagcggaatagaagtctagactctttaagtgttcgtaggnggtacggacgttagcgttaggaacggtaaggggtgtaccggggacggaggtaaccgaagtaaccg

SEQ ID NO: 427573 - DNA, 641 bp, Homo sapiens
  misc_feature: GZ8MTXP01A0HQD.39.20.B09.1.454.CMB.2.raw
  modified_base (263)..(263): a, c, t, g, unknown or other
  modified_base (265)..(265): a, c, t, g, unknown or other
  modified_base (309)..(309): a, c, t, g, unknown or other
  modified_base (377)..(377): a, c, t, g, unknown or other
  modified_base (506)..(506): a, c, t, g, unknown or other
  modified_base (570)..(570): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagcccacgctcagtcgtccgtcgtccccaggacagacagccagcactccactgctcgaggaaatacagtaggagataaatntntctgcgtggtatcagcgaagacgccgacggcacgtccctgtcgntcgatcacgtactaccacaaagacgtaaccgaacggcccgtacccgtaaggaccgggtaccttcccgngacgttccgactttaccgtcgtcggtaccctaccgtaaggtaccgtaaggggaaacccacgaccgaccctacgtactaaccggaccacgtccgggaacggggtcccgggaacccacgggtactaacggnggtaacgagaacgtcgttaataccttagttaaccgtggttacgtagggttcggtacgggaaccnggttcgaacgggtaacgggtaacgggggtttcggccgggggaaccgggacggtaacccgttaacgggtccg

SEQ ID NO: 427574 - DNA, 662 bp, Homo sapiens
  misc_feature: GZ8MTXP01A2Q8V.39.20.B09.1.454.CMB.2.raw
  modified_base (254)..(254): a, c, t, g, unknown or other
  modified_base (262)..(262): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcacgccacgctcgagtcgtccgtcgtccccaggacagacacgccagcatcactgctctaggaaatcagtagganaataaatntagcttgctggtactacgagacaagacgcccgacggtccccacggttccccctaggtcgtacgttacgaacttcctattacctaacgttaacaaacgtaactaacccgaacggtcccgaccccgttggaaccgggtactccccgtaggtactacggttactttccgtcgttcgaccgtttaccgaaccgtcggtaacggaaaccaccgaccgacctaccgacgttaccgaaccgtaccgtacgggaacggggaccccgggtaccgaacgggtctaaggtcgtaagtacgacgtccgtagtacctagttaacgtcggttagaggttcgtacgggacttaggcttaggggaaccggtaaggggtcggttcggggacggttaacggccgttaacggtaaccgg

SEQ ID NO: 427575 - DNA, 609 bp, Homo sapiens
  misc_feature: GZ8MTXP01EAT1J.39.20.B09.1.454.CMB.2.raw
  modified_base (235)..(235): a, c, t, g, unknown or other
  modified_base (249)..(249): a, c, t, g, unknown or other
  modified_base (256)..(256): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtgcctcctatgagctgtctcagccacgctcagtcgtccgtcgtccccaggacagacacgccagcatcactgctnagaatacatagganataaatntgcttgctggtatcgagcagacgccaggccacgtcccctgtcgctgactcatctaacacaaagaactaccgaacgcccggtaccctcggacgggtaccttccccggtagacgtccggttactttcccgttacgtcgtaccttacccgtaaacgtcggtaaacgggaacctacgacgccctacttcgacgacctagtccggaacgggtcccgggaaccgaggtacgttagacggaagttacgaacgtcgttacgtaacttgttaagttcggaggtagggttggtacggaacaggttccgaagggtaacgggtaacggggtcggtacggggacgggacgaaccggttaaggtccg

SEQ ID NO: 427576 - DNA, 598 bp, Homo sapiens
  misc_feature: GZ8MTXP01DZEN8.39.20.B09.1.454.CMB.2.raw
  modified_base (250)..(250): a, c, t, g, unknown or other
  modified_base (431)..(431): a, c, t, g, unknown or other
  modified_base (523)..(523): a, c, t, g, unknown or other
  modified_base (543)..(543): a, c, t, g, unknown or other
  modified_base (554)..(554): a, c, t, g, unknown or other
tcagtcgcactagtcacgaccggtgctcgatttagtgtagtgtgaagggttgagaacctatgaacatttctgtaggggcctcaggaagcagcatcggaggtgcctcagccatggcatggatccctctcttcctcggcgtccttgcttactgcacaggatccgtggcctctatgagctgtctcagccacgctcagtcgtccgtgtccccaggacagacagccagcatcactgctcaggaaatacatagganataatatgcttgctaggtatcagcaagacgccgacggcctacgtccctgtcgctgtactacatccgtaatacaaacgtactaacccgaacgcccgggtaccctggacgggtaccttcccgtaggacgtcggttactttccgtcgtacggtccctaccgaaactcggtaaacgggaaacccncgacgtaccctacttccgaacaccacgtacggaacggccggggaacccagggtactaggtaggactaggatcctagtacttattaagttcgngtagggttgacggcaacggngttaaacgggngggttaagggggttccgacggggacggacggaacgcggtaaccg

SEQ ID NO: 427577 - DNA, 717 bp, Homo sapiens
  misc_feature: GZ8MTXP01BA3F6.39.20.B09.1.454.CMB.2.raw
  modified_base (124)..(124): a, c, t, g, unknown or other
  modified_base (263)..(263): a, c, t, g, unknown or other
  modified_base (278)..(278): a, c, t, g, unknown or other
  modified_base (316)..(316): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctntcttcctcggcgtccttgcttactgcacaggatccgtggcctcctatgagctgtctcacgccacgctcgtagtcgtccgtcgtccccagacagacacgccagcatcactgctatagaatacagttaggaataataaatntgtcttgctaggtancgagcagaacgccgacggcctacgtcccgtgtcgctanactcattactactacaagactaccgacggaccgtaccctcggacggtacctcccgtaggtacgcggtacttcccgcgttacggtaccctaccgtaacgtcggaaacggaacctacccgtagacccctaggtcctaaccgaacccgtagccgggaaccggggccggggaacccctaagggtccttaaacgggtcggaaagtacggtaacgttactaccgttaacgtttaagttttaaaccgtttcggggttaacgggttaaagggggtttaccggtaaccggggaacgttaccgggttaaaggggttaaaccggggaaacccggggtaaaaggggggttttccggaacccgggggaaaccgggggaaaccccggggtaacgttaaaaccccgggggttcccg

SEQ ID NO: 427578 - DNA, 541 bp, Homo sapiens
  misc_feature: GZ8MTXP01A7N8M.39.20.B09.1.454.CMB.2.raw
  modified_base (233)..(233): a, c, t, g, unknown or other
  modified_base (248)..(248): a, c, t, g, unknown or other
  modified_base (255)..(255): a, c, t, g, unknown or other
  modified_base (277)..(277): a, c, t, g, unknown or other
  modified_base (293)..(293): a, c, t, g, unknown or other
  modified_base (436)..(436): a, c, t, g, unknown or other
  modified_base (457)..(457): a, c, t, g, unknown or other
  modified_base (486)..(486): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtcccaggacagacagccagcatcactgctcnggaaatcattagganataaatntgcttgctggtatcagcaagancaggccagtcccctgngctgactcatctaacgtcaaagataccgaagccggacctcgaacgggtctcccgtagagcgtattcgtctggcctaccgaactcggtacggaacacgaactccactcacgaaacctgcggacggccgggacccagcctaaggngagacgactcgtacgtacttntaagtcgttaggtcggttgggaccggaanacggttcgaaggtaacgggtaaggggtcgtacggggacgggacggtaacgcgtcg

SEQ ID NO: 427579 - DNA, 702 bp, Homo sapiens
  misc_feature: GZ8MTXP01EF9IE.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtgcctctatgagctgtctcagccagctcagtcgtccgtgtccccaggaccagacagccagcactcaccgtgacctacgtaaggaaactacgtaagttaaaggataaattaaatacgttagtaccgtttggaccgtttagggtacttacgaaggaccgaacggaacgccccgaacgggtacccctacgttcccccgtgtacgtcgtacgacttacattacgtaactaacggaaatacaacccgtacggaacccgcccctggaccgtactaccccgtaggagcgttctttcccgtcgtaccgtacctacccgtacgtaccggtacgggaaaccacgtaccgaccacgttaccacaccgtagccgaacgggcccggggtaaccaacggtcctagttacggagtacggtaaacgtcgttacgtaacgtttaaatttcgggttgttaccggtaggttagggacggtaaccggagttacggacggttaacggggaaaggggtcgtacccggggtaggaaaccggggtaaccttaacggggtaacccg

SEQ ID NO: 427580 - DNA, 510 bp, Homo sapiens
  misc_feature: GZ8MTXP02HVN8A.39.20.B09.1.454.CMB.2.raw
  modified_base (328)..(328): a, c, t, g, unknown or other
  modified_base (351)..(351): a, c, t, g, unknown or other
  modified_base (370)..(370): a, c, t, g, unknown or other
  modified_base (421)..(421): a, c, t, g, unknown or other
  modified_base (424)..(424): a, c, t, g, unknown or other
tcagtcgcactagtcacgaccggtgctcgatttagtgtagtgtgaagggttgagaacctatgaacattctgtagggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagccgcctnagggactcccgtagagcgattcnctggcctacccgaactcgngggaacacacgcccaacttcagacccatcgacgccgggaccagggctaagnganagaagctagaacttagttacttgtacgaggtggacggacacgacgaaggaacggaagggtcggtacgggacggaacggacaacgcg

SEQ ID NO: 427581 - DNA, 491 bp, Homo sapiens
  misc_feature: GZ8MTXP02GO5BF.39.20.B09.1.454.CMB.2.raw
  modified_base (353)..(353): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagccgccctcgagggactcccgtgagcgattcnctgctccaactcgtggaacacagcccactctgaccatcagccgggacccagggcctatggatgaagctagactattatcgtgaggtgtagggacagcaggaacgtaaaggggtgttacgggacggacggaccaagccg

SEQ ID NO: 427582 - DNA, 480 bp, Homo sapiens
  misc_feature: GZ8MTXP02GGYNL.39.20.B09.1.454.CMB.2.raw
  modified_base (465)..(465): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagcggccctcagggactccctgagcgattctctggctccaactctgggaacacagccactctcgacccatcagcgggacccaggccatggatgaagctagactattatgtcaggtgtgggacagcagaacgaaaggggtgtcgggnggacggaccaagccg

SEQ ID NO: 427583 - DNA, 475 bp, Homo sapiens
  misc_feature: GZ8MTXP02H5DXS.39.20.B09.1.454.CMB.2.raw
  modified_base (328)..(328): a, c, t, g, unknown or other
  modified_base (348)..(348): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatcatcaagataccaagcggccctnagggatccctgagcgattcnctggctccaactctgggaaacacagccaactctgaccatcagcgggacccaggctatggatgaagctgactattatgtacaggtgtgggacagcaggcgaaaggggtgttcggaggacggacaagcg

SEQ ID NO: 427584 - DNA, 493 bp, Homo sapiens
  misc_feature: GZ8MTXP02JXIXT.39.20.B09.1.454.CMB.2.raw
tcagtcgcactagtcacgaccggtgctcgatttagtgtagtgtgagggttgagaacctatgaacattctgtaggggcctcaggaagcagcatcggaggtccctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatccaagataccaagcggccctcaggggactcccgtgagcgatttctctgctccaactctgggaacacgacgccactctcgaccatcagcggacccaggctatggatgaagctagactagttattgtcgaggtgtgggacagcaagcgaaaggggtgttacgggcggacggaccgaaggcgtacgg

SEQ ID NO: 427585 - DNA, 590 bp, Homo sapiens
  misc_feature: GZ8MTXP02H153W.39.20.B09.1.454.CMB.2.raw
  modified_base (125)..(125): a, c, t, g, unknown or other
  modified_base (253)..(253): a, c, t, g, unknown or other
  modified_base (274)..(274): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctntcttcctcggcgtccttgcttactgcacaggatccgtggcctcctatgagctgtctcagccacgctcagtgtccgtgtccccaggacagacagccagcatcacctgctctggaaaatacattaggaanaataaatatgctgtctgtatnagacagaacgaccgacggaccgacgtcccgtcgtcgctgatactactactaactacaaacgaactaaccgaacgaccggacccgtccgacgggtacgtacccgtacgacgacgtacttctcgtcgtacctacctaacgtaccgtacggaacgaacacgaccacctacgtacgacactacgacggaccggaccgacgacgtagtaggagacgacgacgtacgtacttaagttacgttagtacgtacggtacggtacggacgacgacgacggaacggtaacgggtacgggtacgggacgggacgggaacggaacgacg

SEQ ID NO: 427586 - DNA, 477 bp, Homo sapiens
  misc_feature: GZ8MTXP02GDH5B.39.20.B09.1.454.CMB.2.raw
  modified_base (382)..(382): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattaggagataaatatgcttgctggtatcagcagaagccaggccagtcccctgtgctgatcatctatcaagataccaagccggccctcgagggatccctgagctattctctggctccaactctgggaaacacagccactcngaccatcagcggacccaggctaatggatgaagctagactattatgtcaggtgtagggacagcagcgtaaaggggtgtacggcggaggaccagtcg

SEQ ID NO: 427587 - DNA, 514 bp, Homo sapiens
  misc_feature: GZ8MTXP02GU9OX.39.20.B09.1.454.CMB.2.raw
  modified_base (421)..(421): a, c, t, g, unknown or other
  modified_base (469)..(469): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattaggagataaatatgcttgctggtatcagcagagccaggccagtcccctgtgctgatcatctatcaagactaccaagtccgccctcgacgggctcccgtgacgcgattcctctggctccaactcgtaggaacacagccactctacgaccatacgacggccgggacccagggcctagnggactgaacgctagacttaattagttgtacagggttgagggacacggngaacggaacggtaacggggtcgtacgggacggacggacgacggcg

SEQ ID NO: 427588 - DNA, 483 bp, Homo sapiens
  misc_feature: GZ8MTXP02JGNSA.39.20.B09.1.454.CMB.2.raw
  modified_base (351)..(351): a, c, t, g, unknown or other
  modified_base (372)..(372): a, c, t, g, unknown or other
  modified_base (387)..(387): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagcggccctcagggactccctgagcgattcnctggctccaactctgggaacncagccactctgaccntcagcggacccaggcctagtggatgaagctagactattacttgtcaggtgtgggacagcagcgaaaggggtcgttcgggcggacggaccaagtccg

SEQ ID NO: 427589 - DNA, 546 bp, Homo sapiens
  misc_feature: GZ8MTXP02GHMR2.39.20.B09.1.454.CMB.2.raw
  modified_base (251)..(251): a, c, t, g, unknown or other
tcagtcgcactagtcacgaccggtgctcgatttagtgtagtgtgagggttgagaacctatgaacattctggtaggggcctcaggaagcagcatcggaggtgcctcagccatggcatggatccctctcttcctcggcgtccttgcttactgcacaggatccgtggcctcctatgagctgtctcagccacgctcagtgtccgtcgtccccaggacagacagccagcatcacctgctcaggaaatacatagganaataaatatgcttgctggtatcagcaagaagccaggccacgtcccctgtgctgatcatctatacaagactaaccaagccgccctgagggactcccgtagacgcgtattctcgtgcctaccaactcgtacgggaaacacgacgcccactctacgaaccatacgacggccgggaacccagggcctaagtggatagaagcgtagtacttaattacgttgtacgtaggtggtagggacaggcgaaggaacggtaaaagggggttcggtacgggggacgggaacgggaccgaagtaccgg

SEQ ID NO: 427590 - DNA, 492 bp, Homo sapiens
  misc_feature: GZ8MTXP02H4ZJM.39.20.B09.1.454.CMB.2.raw
  modified_base (317)..(317): a, c, t, g, unknown or other
  modified_base (357)..(357): a, c, t, g, unknown or other
  modified_base (368)..(368): a, c, t, g, unknown or other
  modified_base (410)..(410): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaaggccagtcccctgtgctgatcatctatcaaagntaccaagcggctctcagggactccccgtgacgcattctcnggcctccaacnctgggaaaccacagcccactctagaccaatcagcgggacccnggacctatggatgaagctagatatattgtcaggtgtaggcagcaaggcgaaaaggggtcttacgggcggacggggaccaagg

SEQ ID NO: 427591 - DNA, 528 bp, Homo sapiens
  misc_feature: GZ8MTXP02FNCL9.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattaggagataaatatgcttgctggtatcagcagagccaggccagtcccctgtgctgatcatctatcaagataccaagccgccctcgagggactcccgtgacgcgattctctggcctaccaactcgtagggaaacacacgcccactctagaaccatcgacgccggggaccccagggcctaagtggactaggaaacgctagacttaattaacgttgtagaggtggtacgggacagcgaaggaacggaaaagggggtcgttacgggacgggaacggaccgaaggtccg

SEQ ID NO: 427592 - DNA, 474 bp, Homo sapiens
  misc_feature: GZ8MTXP02F8W09.39.20.B09.1.454.CMB.2.raw
  modified_base (371)..(371): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagcggccctcagggatccctgagcgattctctggctccaactctgggaacncagccactctgaccatcagcgggacccaggctatggatgaagctagactattattgtcaggtgtggacagcagcgaaaggggtgtacggcgagggaccaagcg

SEQ ID NO: 427593 - DNA, 470 bp, Homo sapiens
  misc_feature: GZ8MTXP02FGY9A.39.20.B09.1.454.CMB.2.raw
  modified_base (341)..(341): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagcggcctcagggatccctgancgattctctggctccaactctgggaacacagccactctgaccatcagcgggacccaggctatgatgaagctgactatattgtcaggtgtgggacagcagcgaaaggggtgtcggcggagggaccaagcg

SEQ ID NO: 427594 - DNA, 591 bp, Homo sapiens
  misc_feature: GZ8MTXP02GVPFS.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtcccaggacagacagccagcatcacctgctctggaaaatacattaggagataaatatgcttgctggtatcagcagaagccaggccacgtcccctgtgctgatcatctatcaagataccaagccggccctcgaacgggtactccccgtagacgtcgtactttctcgtcggacctacccaacgtcgtacggggaaaccaccgaacgcccctaactcctacggaacccagtccgacggccggggaaccccaggggcctaagtacggatacggaaacgtcctagtaacttaagtttaattcggtacgtaaggggttggtaggggaccaggaccgaaggaacggaaaagggggttcggttaccggggacggaacggggaacccgaaaggtcccgg

SEQ ID NO: 427595 - DNA, 662 bp, Homo sapiens
  misc_feature: GZ8MTXP02HBT08.39.20.B09.1.454.CMB.2.raw
  modified_base (124)..(124): a, c, t, g, unknown or other
  modified_base (247)..(247): a, c, t, g, unknown or other
  modified_base (269)..(269): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctntcttcctcggcgtccttgcttactgcacaggatccgtggcctcctatgagctgtctcagccacgctcagtcgtccgtgtcccaggacagacagccagcatcacctgctcagaatacatagganaataatatgctgctgtatcagnagacgccaggccacgtcccctgtcgcttgactacatactactacaaagactaaccgaacgcccggaccctcgacgggtactccccgtagaacgtccgtactttcctacgtcggccctacccgtaaccgttacgtaacggggaaaccaaccgaccggaccctaacctaccttaacggaaccaaccgttaccgaaccgggacccgggaaccccgagggtacctaggtaacggaagttaacggaacggtctaaccggtaaacgtttatttaaacgtttcggtacggtaaggttcggggtaacggacgaacggaccgaaaggggtaaccgggtaaaagggggttcgggttacccggggaacgggggtaacggtaaacccggtaaacggtaccccggg

SEQ ID NO: 427596 - DNA, 471 bp, Homo sapiens
  misc_feature: GZ8MTXP02JP92X.39.20.B09.1.454.CMB.2.raw
  modified_base (251)..(251): a, c, t, g, unknown or other
  modified_base (373)..(373): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattagganataaatatgcttgctggtatcagcagaagccaggccagtcccctgtgctgatcatctatcaagataccaagcggccctcagggatccccgtgagcgattctctggctccaactctgggaacncagccactctgaccatcaggcggacccaggctagtgatgaagctgactattatgtcaggtgtgggacagcagcgaagggtgtcggcgagggccaagcg

SEQ ID NO: 427597 - DNA, 482 bp, Homo sapiens
  misc_feature: GZ8MTXP02JZTWG.39.20.B09.1.454.CMB.2.raw
  modified_base (470)..(470): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagccggcctcacgggactcccgtgacgcgattctctcggctcccaactctgggaacacagcccactctgaccatccagcggacccagggctagtgggatgaagctagactattattgtcgaggtgtggacagcagcgaaggggtgtcggnggaggaccagcg

SEQ ID NO: 427598 - DNA, 546 bp, Homo sapiens
  misc_feature: GZ8MTXP02I8Y4N.39.20.B09.1.454.CMB.2.raw
  modified_base (253)..(253): a, c, t, g, unknown or other
  modified_base (261)..(261): a, c, t, g, unknown or other
  modified_base (298)..(298): a, c, t, g, unknown or other
  modified_base (390)..(390): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcacctgctctagaatacagttagganaataaatntgcttgctggtatcagcaagagccaggccacgtcccngtgctgactcatcatacaagataccgagcccgcctcgagggtacctccgtagacgtcgtacttctcgtcgccctacgtaactcgtaggaacncgacgcccaacttcacgaccctagtaccgacggaccgggacccagggacctagtaggactaggaaacgtcgtaagtacttaagttcgtacgtacggtaggtcggtagggacaggcgaagaacggtaagggtcgtacggggaggacggaacgagtcg

SEQ ID NO: 427599 - DNA, 499 bp, Homo sapiens
  misc_feature: GZ8MTXP02HVJLO.39.20.B09.1.454.CMB.2.raw
  modified_base (431)..(431): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagccggccctcgagggactcccgtgacgcgtattctctgcctccaactcgtagggaacacacgcccactctacgaccatcacggccgggacccagggcctagtggatggaanctagacttattattgtcgagtggtacggacgagcagcgaaaggggtcgttacggcggacggacaagcg

SEQ ID NO: 427600 - DNA, 528 bp, Homo sapiens
  misc_feature: GZ8MTXP02IR7XH.39.20.B09.1.454.CMB.2.raw
  modified_base (252)..(252): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtcccccaggacagacagccagcatcacctgctctggaaatacattagganaataaatatgcttgctggtatcagcagaagccaggccagtcccctgtgctgatcatctatcaagataccaagccggcccctgagggactcccgtgagcgtatttcctctggcctacccaaactcgtaggggaaacacgacgccctaactctacgaacccatccgaacggccgggaccccagggacctaagtggaatgaaacgctagactatttacgtgtacgaggtggtcggacagcgagaacgaaaggggtgtacggacggacgggaccgaagcg

SEQ ID NO: 427601 - DNA, 498 bp, Homo sapiens
  misc_feature: GZ8MTXP02HELN7.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagaataaatatgcttgctggtatcagcagaagccaggccagtcccctgtgctgatcatctatcaagataccaagccggccctcagggatcccgtgagcgattctctggcctccaactctagggacacacgccactctgaccatcgacggccgggacccagggcctagtggatgaagctagactattacttgtcaggtgtcgggacagcaggaacgtaaagggggtgttacgggcggagggaccaaggccg

SEQ ID NO: 427602 - DNA, 482 bp, Homo sapiens
  misc_feature: GZ8MTXP02FMX2D.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagccggccctcgagggactccctgagcgattctctggctccaactctgggaacacagcccactctcgaccatcacgccggacccagggcctagtggatgaagctagactattatgtcaggtgtggacagcagcgaaagggtcgtacggcggacgggacagcg

SEQ ID NO: 427603 - DNA, 494 bp, Homo sapiens
  misc_feature: GZ8MTXP02JRX3E.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaatacattaggagataaatatgcttgctggtatcagcagaagccaggccagtcccctgtgctgatcatcatcaagataccaagccggccctcgagggactcccgtgagcgattctctgctccaactctagggaacacacgcccactctcgaccataccgaggccgggacccagggcctagtggatgaagctagactattatgtcgaggtgtgggacagcaggcgaaagggggtcgtacgggcggacggaccgaagccg

SEQ ID NO: 427604 - DNA, 579 bp, Homo sapiens
  misc_feature: GZ8MTXP02IWSB6.39.20.B09.1.454.CMB.2.raw
  modified_base (249)..(249): a, c, t, g, unknown or other
  modified_base (256)..(256): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattagganataaatntgcttgctggtatcagcagagccaggccagtcccctgtgctgatcatctatcaagactaccaagccggccctgagggactccccgtagacgcgtattctcgtcggcctccgaaactcgtaggggaaaccaccgacgcccaactctcgaacccagtccgaacggcccggggaaccccaggggacccttaagtgggaatggaaagccgtagtactttaagtttacgttggttacgtaaggggttcgtacgggggtaaccaggccgaaaggaacggtaaaagggggttcggttacggggacgggtaacggggaaccaacggtcccg

SEQ ID NO: 427605 - DNA, 526 bp, Homo sapiens
  misc_feature: GZ8MTXP02F6MKP.39.20.B09.1.454.CMB.2.raw
  modified_base (250)..(250): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattagganataaatatgcttgctggtatcagcagaagccaggccagtcccctgtcgctgatcatctatcaagataccaagccggccctcgacgggactccccgtgagcgattctctggcctccaactctgggaaacacgacgaccactctacgaccatccgacggccgggacccagggacctagtggatggaacgctagaacttattacttggtacgagggttgtagggacagacgaggaacggaaaaggggttcgtacggggacggacgggaccgaagtccgg

SEQ ID NO: 427606 - DNA, 563 bp, Homo sapiens
  misc_feature: GZ8MTXP02H2P7F.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagccggaccctcgaagggactcccccgtgacgtcgatttcctcgtggcctcccaaactcgtagggaaacacgacgcccaactctacgaccaatccgaacggccggggaaccccagggcctaagtggaatacggaaacgtcgtagaacttaagtttacttaggtcgaagggttggtagggacaggccgaaggaacggtaaaagggggtcggttacggggacgggaacggggaccaaaggtccgg

SEQ ID NO: 427607 - DNA, 565 bp, Homo sapiens
  misc_feature: GZ8MTXP02ID37X.39.20.B09.1.454.CMB.2.raw
  modified_base (357)..(357): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattaggagaataaatatgcttgctggtatcagcagaagccaggccacgtcccctgtcgctgatcatctatcaagatacaagccgccctcagggactcccgtgacgcgatttcnctggcctaccaactcgtacgggaacacacgacccaacttctacgacctatccgacgccgggaccccagggacctagtacggataggaaacgccgttaggaaccttaagtttacgttaggtaccgaaggttcggtaggggaaccagaccgaggaaccgtaaaagggggttcggttaccggggacgggtacggaacccgtaaaggcccgg

SEQ ID NO: 427608 - DNA, 505 bp, Homo sapiens
  misc_feature: GZ8MTXP02JNG6M.39.20.B09.1.454.CMB.2.raw
  modified_base (450)..(450): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagcggccctgacgggactcccgtgagcgtattcctctggcctcccaacgtcgtagggaacacgacgcccactcctgacccatcgacgccgggacccagggcctagtggatgaagctagactattagtgtnaggtgtagggacaggcaggcgtaaaaggggtggtcggacggacgggaccaagccg

SEQ ID NO: 427609 - DNA, 506 bp, Homo sapiens
  misc_feature: GZ8MTXP02IX9J7.39.20.B09.1.454.CMB.2.raw
  modified_base (380)..(380): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagccggccctgagggactccccgtgacgcgtattctcgtgcctccaactcgtagggaacncagccactctgaccatcagccggacccaggctagtggatgaagctagacttattattgtacgtagggtaggtgggacaggctaggaacgaaagggggtcgttacggggcggacgggaccaaggtcg

SEQ ID NO: 427610 - DNA, 503 bp, Homo sapiens
  misc_feature: GZ8MTXP02IUHO1.39.20.B09.1.454.CMB.2.raw
  modified_base (252)..(252): a, c, t, g, unknown or other
  modified_base (457)..(457): a, c, t, g, unknown or other
  modified_base (463)..(463): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattagganataaatatgcttgctggtatcagcagaagccaggccagtcccctgtgctgatcatctatcaagataccaagccggccctgagggactcccgtagagcgattctcgtggcctcccaactcgtacgggaacaccagccaactctcgaccatccgaggccggacccagggcctagtggatgaaagctagacttattagtgtcaggtgnggtacngcagaacgaaaggggtcgtacgggcggacggacgaagtcg

SEQ ID NO: 427611 - DNA, 548 bp, Homo sapiens
  misc_feature: GZ8MTXP02I1QL2.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagaataaatatgcttgcttggtatcagcagaagccaggccagtcccctgtgctgatcatcatcaagactacagccgcctcgagggactcccgtagacgtcgtattcctctcggtcctacccaacgtcgtacgggaacaccgacgcccactctacgaccactcgacggccggacccaggcgtaacgtggagtgaaaggctagtactaatttacgttgtacgtaggttagggtacggacgacggccgaaggaaccggtaaagggggtcggttacgggacgggacgggaaccgaacgtaccgg

SEQ ID NO: 427612 - DNA, 593 bp, Homo sapiens
  misc_feature: GZ8MTXP02H5F5H.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaatacattaggagaataaatatgcttgctggtatcagcagagccaggccagtcccctgtcgctgaatcatctactacaagactaccaagccggccctgacgggactcccgtgacgcgattctctgctaccaactcgtacggaaacacgacgaccactctacgaccatccgacggaccggacccgaggaccttagacggagtaggaacgtaccgtagtaactaagtttacgttaggttaccgtaacgggtttggtacggggtaaccgacgggaccgaacggggaacgggtaaaaagggggtttcgggttaccgggggacggggaaaccgggggaacccgttaaaacggggtacccgg

SEQ ID NO: 427613 - DNA, 589 bp, Homo sapiens
  misc_feature: GZ8MTXP02GEE9H.39.20.B09.1.454.CMB.2.raw
  modified_base (234)..(234): a, c, t, g, unknown or other
  modified_base (246)..(246): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcactgctcngaatcattaganataaatatgcttgctggtatcagcagaagcaggccagtcccctgtcgcgtgatcattctataccaagactaccaagccggaccctcgagggactcccgtagacgtcattcctctggcctaccgaacttcgtacgggaaacacgacgccctactctacgacctattaccacgggaccgggaccccgagggtaccctaacgttcgggaacttaggaaacgtccgtaggaactttacttaacgtttggtacgtaacgggttaggaggggtaaccaggaccgaaggaaccgggtaaaagggggtcgttacgggggaccgggtacgggtaacccgtaaaggtacccgg

SEQ ID NO: 427614 - DNA, 527 bp, Homo sapiens
  misc_feature: GZ8MTXP02IHWZV.39.20.B09.1.454.CMB.2.raw
tcagtcgcactagtcacgaccggtgctcgatttagtgtagtgtgagggttgagaacctatgaacattctgtaggggcctcaggaagcagcatcggaggtccctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattaggagataaatatgcttgctggtatcagcagaagccaggccagtcccctgtgctgatcatctatccaaagactaccaagcggccctcgaggggactcccgtgacgcgatttctcgtcgctcccaactctagggaaaccacgacgccactctacgaccatccagccggaccaggctagtgggatagaagtctagtactagttagttcgtacgtagggtgtacgggacacgacgagacggaaaagggggtcgttacgggcggaagggaccaaggtccgtacgg

SEQ ID NO: 427615 - DNA, 505 bp, Homo sapiens
  misc_feature: GZ8MTXP02GKEB9.39.20.B09.1.454.CMB.2.raw
  modified_base (250)..(250): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattagganataaatatgcttgctggtatcagcagaagccaggccagtcccctgtgctgatcatctatcaagactaccaagccgccctgacgggactcccgtgacgcgtattctctggcctccaactcgtagggaacacgacgccactctagaccatcacggaccggacccagggctagtcggatgaacgctagacttagttactcgtgaggtgaggacagcgagaacgtaaggggtcgttacgggacggacggaccgaagtcg

SEQ ID NO: 427616 - DNA, 498 bp, Homo sapiens
  misc_feature: GZ8MTXP02IVBWM.39.20.B09.1.454.CMB.2.raw
  modified_base (397)..(397): a, c, t, g, unknown or other
  modified_base (462)..(462): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaatacattaggagaataaatatgcttgctggtatcagcaagaagccaggccagtcccctgtgctgatcatctatacaagactaaccaagccggccctcgagggactccccgtgacgcgattctctcggcctaccaaactctagggaacacacgccaactcncgaacccatcgacggccgggaaccccagggcctaagtggatgaagctagactattatgtcagtgnggacagcagcgaagggtgtcggaggacggacaagcg

SEQ ID NO: 427617 - DNA, 549 bp, Homo sapiens
  misc_feature: GZ8MTXP02I49E4.39.20.B09.1.454.CMB.2.raw
  modified_base (251)..(251): a, c, t, g, unknown or other
  modified_base (297)..(297): a, c, t, g, unknown or other
  modified_base (387)..(387): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattagganataaatatgcttgctggtatcagcagagccaggccagtcccctgtnctgatcatctatacaagactaccaagccggccctcgacgggactcccgtgacgcgtattctctcggcctaccaactcgtacgggaaaccncgacgcccactctcgacccatccgacggccggacccagggactagtcggatcggaaagctagtacttagtttacgttgtacgagggttaggtcgggacgaggcgaaggtaacggtaaacgggggtcggttaccggggacgggaacgggaccgaacggtccgg

SEQ ID NO: 427618 - DNA, 528 bp, Homo sapiens
  misc_feature: GZ8MTXP02J0STK.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattaggagataaatatgacttgctggtatcagcagagccaggccagtcccctgtgctgatcatctatcaagataccaagccgcctcagggactccctgacgcgattctctcggctccaactcgtagggaacacgacgccaactctagaccatcgacgcggaccacgggacctagtcggatggaaacgtcgtagtaaccttattaacgttggtacgagggttggtagggaccaggcaaggaacgaaaagggggttcggtacgggacgggacgggaccgaacgtccgg

SEQ ID NO: 427619 - DNA, 569 bp, Homo sapiens
  misc_feature: GZ8MTXP02IFZXH.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggactccgtggcctctatgagctgtctcagccacgctcagtcgtccgtcgtccccaggacagacagccagcatcacctgctctaggaaatacattaggagaataaatatgcttgctggtatcagcaagaacgccaacggcacgtcccctgtcgctgatcatctactacaagtactaaccgaacgccggaccctggacgggtactccccgtagacgcgtattctcgtagccttacactcgtacggaacacgacacctactctcgacctataccgacggacccgggacccagggtacctagtaggagtagaacgtctaggtaacttagtttacgttgtagacgggttaggacggacacggacacggtaacggtaaagggggttcggtacggggacgggacggggactaacggtccgg

SEQ ID NO: 427620 - DNA, 487 bp, Homo sapiens
  misc_feature: GZ8MTXP02JLOCZ.39.20.B09.1.454.CMB.2.raw
  modified_base (250)..(250): a, c, t, g, unknown or other
  modified_base (257)..(257): a, c, t, g, unknown or other
  modified_base (297)..(297): a, c, t, g, unknown or other
  modified_base (403)..(403): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattagganataaatntgcttgctggtatcagcagaagccaggccagtcccctgtnctgatcatctatcaagataccaagcggccctcgagggactccctgagcgattctctggcctccaactctagggaacacagcccactctgaccatcacgccggaccnggactatggatgaagctagactattatgtcaggtgtacggacagacagcgaaaggggtgtcgggacggacgggaccaggtaccg

SEQ ID NO: 427621 - DNA, 541 bp, Homo sapiens
  misc_feature: GZ8MTXP02IC0KX.39.20.B09.1.454.CMB.2.raw
  modified_base (298)..(298): a, c, t, g, unknown or other
  modified_base (362)..(362): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattaggagaataaatatgcttgctggtatcagcagaagccaggccagtcccctgngctgatcatctatacaagactaccaagcccggccctcgacgggtactcccgtgacgcgtattcncgttcggctaccgactccgtagggaaccacacgcccactccgtacgaccctagtccgacggccgggaccccagggtcctagtggatagaacgtcgtagtacttagtttacgtgtcgtaggttggcggacaggtcaggaacgtaagggggtgtacggggacggacggaccgaacgtccgg

SEQ ID NO: 427622 - DNA, 508 bp, Homo sapiens
  misc_feature: GZ8MTXP02GBYEO.39.20.B09.1.454.CMB.2.raw
  modified_base (431)..(431): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcaagaagccaggccagtccccctgtgctgatcatctatcaagataccaagccggccctcgagggactccctgagcgattctctggcctccaaactcgtacgggaacacagacccaactctcgaaccacgtacaacggcgggaccccagggccttaagnggatgaaagctagacttattaattgtacgaggtgtgggacagcagaacgaaagggtgtcggaggacggaccaagtcg

SEQ ID NO: 427623 - DNA, 514 bp, Homo sapiens
  misc_feature: GZ8MTXP02HBXI4.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaatacattaggagaataaatatgcttgctggtatcagcagaacgccaggccagtcccctgtgctgatcatctatcaagataccaagccgcctgagggactccctgacgcgattctctgctccaactcgtacgggaacacacgacccacgtcacgaccatcgacgccggacccagggctagtgatagaagctagacttattagtcgtacgtacggtggtacggacacggcgaggaacgtaaagggggtcggttacgggacggacgggaccgaaggccgg

SEQ ID NO: 427624 - DNA, 509 bp, Homo sapiens
  misc_feature: GZ8MTXP02GQ7WW.39.20.B09.1.454.CMB.2.raw
  modified_base (295)..(295): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtccccngtgctgatcatctatcaagataccaagccggccctcgagggactccccgtgacgcgattctctggcctccaactcgtagggaaacacagcccaactctcgaaccataccacggaccggggaccccaagggctagtggatgaagctgaactattattgtctaggtgtgggacagcaggaacgaaaggggtcgtacgggacggacggaccgaagcg

SEQ ID NO: 427625 - DNA, 538 bp, Homo sapiens
  misc_feature: GZ8MTXP02JIYIT.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattaggagaataaatatgcttgctggtatcagcagaagccaggccagtcccctgtgctgatcatctatcaagactaccgaagccgccctcgagggactcccgtgacgcgtacttctctggcctacccaactcgtacgggaaacacacgccctactcacgtacccatccgaacggccgggaacccagggactagtcggaatgaagctagaacttagttagtgtacgtagggtgtacgggacacggacgaggaacggtaaagggggtcggtacggggacgggacggaccgaggtaccg

SEQ ID NO: 427626 - DNA, 660 bp, Homo sapiens
  misc_feature: GZ8MTXP02H1SAI.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatacattaaggagaataaatatgcttgctggtatcgagcaaggaacgcccgaggccctacgtcccctgtcgctgactcattacctataccaaagactaaccgaaggccggaccctggacgggtactccccgagacgtcgtactttcgtcgtcgtccctaccgtaccgtcgtacgggaaaccaccgacgacccactctacgaaccctagtcccgaacgggcccgggaaaccccgagggtacccgtaagtacgggtaacgttaggaacgtaccgttagtaactttaagtttacgttacggttacggtaaacggggttgggttaaacgggaccgtaaggacccggtaaggggtaaccggggtaaaagggggttcgggttacccgggggaacgggggtaacgggaccggtaaaacggtcccgg

SEQ ID NO: 427627 - DNA, 559 bp, Homo sapiens
  misc_feature: GZ8MTXP02H59TL.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataaccaagccggccctgacggggtactccccgtgacgcgatttctcgtggcctcccaactcgtagggaaaccacacgcccaactctacgaccatacgacggccgggacccagggcctagtggaacttggaaagtccgtagaacttaatttagttaggttacgtagggtggttacggggacacggcgaaggaacggtaaaagggggttcggttacggggacgggacggggaccgaaacggtcccgg

SEQ ID NO: 427628 - DNA, 573 bp, Homo sapiens
  misc_feature: GZ8MTXP02JP3YX.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagactaccaagccggccctcgaggggactcccgtgacgcgattctctggcctccaactcgtagggaacacacgcccactctcgaacccatccgacggccgggaccccaggggacctaagtgggaactaggaaacgccgttaggaaccttaatttaacgttggtaccgtaaggggttggttagggggaccaggccaagggaaccggtaaaacggggggttggttacgggggacgggaacgggggaaccctaaagggtcccgg

SEQ ID NO: 427629 - DNA, 551 bp, Homo sapiens
  misc_feature: GZ8MTXP02INFS5.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccagccagtcccctgtgctgatcatctatcaagataccaagccggccctcgagggactccctgacgcgattctctggcctccaactcgtagggaaacacacgcccactctacgacccatcacgccgggacccagggacctagtaggactgaaacggtctgtaactatttagttcgttagtaacggttggtacggggtaaccaggtacaacgggaacggtaaaagggggtcgggtttaccggggacggggacgggaaccgaaacggtcccgg

SEQ ID NO: 427630 - DNA, 533 bp, Homo sapiens
  misc_feature: GZ8MTXP02IYVQ1.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattaggagataaatatgcttgctggtatcagcaagagccaggccagtcccctgtgctgatcatctatcaagataccaagccggcctgacgggactcccgtgacgcgtattcctcgtcgtactaccaactcgtacgggaaacaccgagacccaactctacgaccactacgacggaccggacccgagggacctacgtaggatcggaaacgcgtagacttattagttgtacgtaggtcggtagggacacgcaaggtaacgaaaggggttcgtacggcggacggaccgaagtccg

SEQ ID NO: 427631 - DNA, 561 bp, Homo sapiens
  misc_feature: GZ8MTXP02HQWH5.39.20.B09.1.454.CMB.2.raw
  modified_base (251)..(251): a, c, t, g, unknown or other
  modified_base (361)..(361): a, c, t, g, unknown or other
  modified_base (402)..(402): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattagganataaatatgcttgctggtatcagcagaacgccgaggccacgtcccctgtgctgatcatctatcaagactaccaagcccgcctcgagggtactcccgtgacgcgtacttcncgtggcctacaactcgtacgggaacacacgcccacgttccncgaccatccgacggccgggacccagggtacctagtaggacgttaggaagtcctagtaacttagtttacgtttcgtacggtaggtgggttacgggaccgaggacgagaacgggtaaaaggggtcgggtttacggggacggtacgggaacgaacggtccgg

SEQ ID NO: 427632 - DNA, 530 bp, Homo sapiens
  misc_feature: GZ8MTXP02JZ9X6.39.20.B09.1.454.CMB.2.raw
  modified_base (349)..(349): a, c, t, g, unknown or other
  modified_base (469)..(469): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtcgctgatcatctatcaagataccagccggccctcgaacggggacttccccgngacgcgtactttcctcgtggcctccctaaactcgtagggaaccacacgcccactcctacgaccatccgaggcccgggaacccagggcctagtgggatggaagctagacttattagttcgngtaggtggtaggacaggcaggaagtaaacggggtcgtcgggacgggacggaccgaagtccg

SEQ ID NO: 427633 - DNA, 527 bp, Homo sapiens
  misc_feature: GZ8MTXP02G9U0G.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagaataaatatgcttgctggtatcagcagaagccaggccagtcccctgtgctgatcatcatcaagactaccaagccggccctcgagggactcccgtgacgcgtattcctctggcctaccaacgtcgtagggaaaccacgacgaccctaacgtctacgaacctactcgacggccggaacccagggacctagtgactagaagtcgtagaacttattagttgtcgaggtcgtaggacagcgaagaacgtaaaggggtcgtacgggaggtacggacaagtccg

SEQ ID NO: 427634 - DNA, 627 bp, Homo sapiens
  misc_feature: GZ8MTXP02GQ5ZE.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccacgtcccctgtgctgatcatctactcaagactaaccgaagccggccctcgacgggtactcccgtgacgtctacttcctcgtcggtcctaccctaacgtccgtacggggaaccaccgacgaccctaactcgacgaacccactaccgacgggacccgggaccccgagggacctagtacggagtaggaaacgtccgtagtacttagtttacgttacggttacgtacggggtttagggtacggggtacacggggaccgaagggtaaccggggtaaaaggggggtttcgggttaacccgggggacgggggtaaaccggggtaaccccggaaacgggttaccccggg

SEQ ID NO: 427635 - DNA, 510 bp, Homo sapiens
  misc_feature: GZ8MTXP02FZOBF.39.20.B09.1.454.CMB.2.raw
  modified_base (477)..(477): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagaataaatatgcttgctggtatcagcagaagccaggccagtcccctgtgctgatcatctatacaagactaccgaagccggccctgacgggactcccgtgacgcgtattcctcgtggcctaccaacgtcgtggggtctgacgccgcccaccctcaccctactcctacccacgccccttccgagtccgtggagatggagctagactatactgtcacgccgtcgggaccncgtgctgtacgtagtggtacgtacgtcggacgg

SEQ ID NO: 427636 - DNA, 597 bp, Homo sapiens
  misc_feature: GZ8MTXP02G5VT3.39.20.B09.1.454.CMB.2.raw
  modified_base (255)..(255): a, c, t, g, unknown or other
  modified_base (362)..(362): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcactgctctggaaatcataggagataaatntgcttgctggtatcagcagaagccaggccagtcccctgtcgctgactcattcatacaagactaccgaagtccggccctcgagggactcccgtgacgcgtattcctcnggtccttccaaacgttcgtagggaaccacgacgaccactactcgaacccataccgacggaccgggacccctagggtaccctaacgttggaacgtaggaacggtcctaggtaaactttagtttaagttcgtacggtacggggtacggttaggggaacgtaggaccgaaggaaccgggtaaaagggggttcggttaccgggggaacggggtaacggggaacccgtaaaaggtcccgg

SEQ ID NO: 427637 - DNA, 562 bp, Homo sapiens
  misc_feature: GZ8MTXP02HI0GN.39.20.B09.1.454.CMB.2.raw
  modified_base (359)..(359): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaaggccacgtcccctgtcgctgatcatctatcaaagactaccaagccgccctcgagggactcccgtgacgcgattcnctggcctaccaactcgtacgggacacgaacgcccaactctacgaccatccgacggccgggaccccgaggtcctagtaggactaggaaagtcctagtaacttaagtttagttcgtcgtaaggggtcggttaggggaccaggaccgaggtaaccggtaaaagggggttcggttacggggacgggacgggaaccgaacggtcccgg

SEQ ID NO: 427638 - DNA, 602 bp, Homo sapiens
  misc_feature: GZ8MTXP02HVBLF.39.20.B09.1.454.CMB.2.raw
  modified_base (350)..(350): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacataggagataaatatgcttgctggtatcagcagaagccaaggccagtcccctgtgctgaatcatctaatacaaagactaaccaagccggccctcgagggactcccgngacgcgtacttctcgtcggtcctaccaaccgtcgtacgggaaccaacgacaccacctctacgacctaacgtcaacgggcccgggaacccagggtacctaagtaggaacgtaggaaacgtccgtaggtaaaccttaagtttagttacgttacggtagggttaggtacggggaaccacgggacgaaagggtaacgggtaaaagggggtcggtttaccgggggacggggtaaccggggaacccgtaaaggcccgg

SEQ ID NO: 427639 - DNA, 638 bp, Homo sapiens
  misc_feature: GZ8MTXP02GS23O.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattaggagataaatatgcttgctggtatcagcagaagccaggccagtcccctgtgctgatcatctatcaagactacaagccggccctcgagggactcccgtgacgcgacttctcgtggtcctaccaactccgtggggaaaccaccgacgtccccaacttcctacgaaacccgataccgacgggcccgggaaccccgagggtaccctaagttacgggaagttacggaaaacggtccgttaaggaacctttaaacgtttacgtttaggttaccgtaacgggggtttggtacgggggtaaccaaacggggtccgaaagggaaccggtaaaaacgggggggtttggttacccgggggaacgggggtaaaccgggggtaaccccggaaaaggtaccccggg

SEQ ID NO: 427640 - DNA, 559 bp, Homo sapiens
  misc_feature: GZ8MTXP02JUNCT.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagagccaggccagtcccctgtgctgatcatctatcaagataccaagccggccctcgaggggactccccgtgagcgatttctcgtggccttccgaactcgtcgggaaacacgacgacccaactcctacgaccaatcgacggccggggaacccagggcctaagtcgggattaggaagtctagtaactaagtttacgttagtcgtaagggtgttacgggaccaggcgaaggaacggtaaaagggggttcggttacgggggacgggaacggggacccgaaaggtcccgg

SEQ ID NO: 427641 - DNA, 497 bp, Homo sapiens
  misc_feature: GZ8MTXP02FLJUI.39.20.B09.1.454.CMB.2.raw
  modified_base (295)..(295): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtccccngtgctgatcatctatcaagataccaagccggccctcgaacgggatcccgtgacgcgattctctggcctaccaactcgtgggaacacagcccactctgacccatccgaggccgggacccagggactagtggactgaagctgactattatgtcaggtgaggacagcgagcgaaaggggtcgtcggacggacggaccaaggtccg

SEQ ID NO: 427642 - DNA, 486 bp, Homo sapiens
  misc_feature: GZ8MTXP02JF1HC.39.20.B09.1.454.CMB.2.raw
  modified_base (383)..(383): a, c, t, g, unknown or other
  modified_base (422)..(422): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattaggagataaatatgcttgctggtatcagcagaagccaggccagtcccctgtgctgatcatctatcaagataccaagccggccctgacgggatcccgtgagtcattctctggctccaactctagggaacacagccaacnctagaccatcacgcgggacccaggctagtggatgaacgntgactattatgtcaggtgtgggacagcagcgaaaggggtcgttacggacggacggaccgaagcg

SEQ ID NO: 427643 - DNA, 538 bp, Homo sapiens
  misc_feature: GZ8MTXP02JRKNZ.39.20.B09.1.454.CMB.2.raw
  modified_base (251)..(251): a, c, t, g, unknown or other
  modified_base (450)..(450): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctggaaatacattagganataaatatgcttgctggtatcagcaagagccaggccacgtcccctgtgctgatcatctaatcaagactaaccacgccgccctcgacgggactcccgtgacgcgtattcctcgtcgtcctaccaactcgtaggaacacacgaccctacgtctacgacccataccgacggccggacccagggactagacggtatagaacgngttacgtattacgtttactgtacgtagggtgtacgggagacgacgagaacggtaaggggtcgtacggggacggtacggaccacggtcg

SEQ ID NO: 427644 - DNA, 490 bp, Homo sapiens
  misc_feature: GZ8MTXP02HLWSE.39.20.B09.1.454.CMB.2.raw
  modified_base (390)..(390): a, c, t, g, unknown or other
  modified_base (454)..(454): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaatacattaggagaataaatatgcttgctggtatcagcagaagccaggccagtcccctgtgctgatcatctatacaagactaccaagccggcctcgacgggactcccgtgagcgattctctgcctaccaactcgtaggaacacacgccactcngaccatcacggcggacccaggactagtgatgaagctagactattagtcgtgtaggtgtcggacngtcagaacgaaggggtcgtcggaggacggacagtcg

SEQ ID NO: 427645 - DNA, 482 bp, Homo sapiens
  misc_feature: GZ8MTXP02I34H1.39.20.B09.1.454.CMB.2.raw
  modified_base (345)..(345): a, c, t, g, unknown or other
  modified_base (420)..(420): a, c, t, g, unknown or other
  modified_base (437)..(437): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagagccaggccagtcccctgtgctgatcatctatcaagataccaagccggccctcgagggatcccgtgancgattctctgctccaacgtctggaacacagccaactctcgaccatcaggccgggacccaggcctagtggatgaanctagactattactgtcnggtgtggacagcaggcgaagggtcgtacgggcggaggaccagtcg

SEQ ID NO: 427646 - DNA, 542 bp, Homo sapiens
  misc_feature: GZ8MTXP02JT658.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattaggagataaatatgcttgctggtatcagcagagccaggccagtcccctgtgctgatcatctatcaagactaccaagccgccctcgagggactcccgtgagcgtattctcgtcggcctaccaactcgtacgggaacacgacgtccactctacgaccataccgacggccggacccagggtacctagtggaactacgaacgtctacgtaacttatttacgttgtacgtagggtggtacgggacacgtcgaagaacggtaaaggggtcggtacgggacgggacggaccggaacgtccgg

SEQ ID NO: 427647 - DNA, 516 bp, Homo sapiens
  misc_feature: GZ8MTXP02I1GRM.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagccggccctcgagggactccctagagcgatttctctggcctcccaaactctacggggaaacacaacgcccaactctacgaacccataccgaacgccgggaaccccagggacctaagtggatgaaacgctagactattattgtcaggtgtggacagcaagcgaaaggggtcgttacggacggtacggaccaagccg

SEQ ID NO: 427648 - DNA, 496 bp, Homo sapiens
  misc_feature: GZ8MTXP02I1HVF.39.20.B09.1.454.CMB.2.raw
  modified_base (388)..(388): a, c, t, g, unknown or other
  modified_base (416)..(416): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattaggagataaatatgcttgctggtatcagcagaacgccaggccagtcccctgtgctgatcatctatcaagactaccaagccggccctcgacgggactcccgtgacgcgacttctctggcctccaactctggaaacacacgccacnctcgaccatcagcggacccagactacgngatgaagctagactattatagtcaggtgtagggacagcgagaacgtaaaggggtcgtacgggacggacgggaccaaggcg

SEQ ID NO: 427649 - DNA, 619 bp, Homo sapiens
  misc_feature: GZ8MTXP02H5TWO.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtcgctgatcatctatcaaagataaccaagccggaccctcgagggtactcccgtagacgtcgattcctacgtggcctaccaactcgtacgggaaacacacgacccaactctacgaaccataccgacggaccgggtacccgagggtacctaagtcggaacttacggaaagtccgtagtaacctttaagtttaagttcggttaacgtacggggttagggtacgggtaaccgaaggtaccgaaagggtaaccggggtaaaaacgggggttcgggtttacccgggggaacgggggtaaaccgggggtaacccgaaaacggtacccggg

SEQ ID NO: 427650 - DNA, 533 bp, Homo sapiens
  misc_feature: GZ8MTXP02JO4WG.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtcgctgatcatctatcaagactaccagccggccctgacgggatcccgtgagctattcctctggcctccaacgtcgtacgggaacacacgcccactctacgaccatcacggccgggacccaggcctagtggatgaacgctagtaactatttaacttggtacgagggtggtcggggacaacggcaaaggaacggtaaaagggggttcggttacggggacgggtacggaccgaacggccgg

SEQ ID NO: 427651 - DNA, 547 bp, Homo sapiens
  misc_feature: GZ8MTXP02JM172.39.20.B09.1.454.CMB.2.raw
  modified_base (315)..(315): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattaggagaataaatatgcttgctggtatcagcaagagccaggccacgtcccctgtcgctgactcatctanacaagactaccaagccgaccctcgagggactcccgtagacgcgtattctctcggcctacccaacgtcgtacgggaaacaccgacgcccactcgtacgaccactcgaacggccgggaacccagggcctagtcggactcggacgctagtacttatttacgtgtcgaggtgtacggacacgacgaggtaaccggtaaaggggtcggtacgggacgggacggtaccgaaggtccgg

SEQ ID NO: 427652 - DNA, 585 bp, Homo sapiens
  misc_feature: GZ8MTXP02I4OZ5.39.20.B09.1.454.CMB.2.raw
  modified_base (254)..(254): a, c, t, g, unknown or other
  modified_base (441)..(441): a, c, t, g, unknown or other
  modified_base (471)..(471): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatccacctgctctaggaaatcagttagganaataaatatgcttgctggtactcgagcaagacgcccgaaggcccagtcccctgcgctgactcattacactacaagtactacccgaaggcccggaccctcggacgggtactcccgtagacgtcgtacttcgtacgtcgccctaccaacgtcgtaacggacaccacgtaccctactcgacgaacctacnccgacgggaccggaccccagggtacctagnggataggaaactcgtagtacttattacgtgtacggtaggttagacggacgacgcgaacggtaacggtaaacggggttcggtaccgggacggggtaacggacccgaaggtcccgg

SEQ ID NO: 427653 - DNA, 499 bp, Homo sapiens
  misc_feature: GZ8MTXP02GAF1B.39.20.B09.1.454.CMB.2.raw
  modified_base (294)..(294): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcataggagataaatatgcttgctggtatcagcagagccaggccagtcccctgngctgatcatctatcaagataccaagccggccctgacgggatcccgtgacgcgattctctgcctaccaactctagggaacacgacgccactctcgaaccactcacggccggacccgaggcctagtggatagaagctagactattagttgtcgaggtgtacggacgacgcagaacgaagggtcgtacggcggacggaccgagtaccg

SEQ ID NO: 427654 - DNA, 594 bp, Homo sapiens
  misc_feature: GZ8MTXP02JYALS.39.20.B09.1.454.CMB.2.raw
  modified_base (251)..(251): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctagaatacattagganataaatatgcttgctggtatcgagcagaagccaggccagtcccctgtgctgatcatctactacaagactaccagccgccctgacgggactcccgtagacgtccgtattcctcgtcggtaccctacccgtaaacgtccgtacggggaaaccacgccgaccctaactccgtacgaaccctgtaccgacgggccgggaaccccagggtacctagagggtaactagggaaactcgttacgaacgttaatttacgttcggtaccgtagggttacggtaggggacaacggtacgaaggaaccggtaagggggtacggtcggggaacgggacggtaaccgacggtaccgg

SEQ ID NO: 427655 - DNA, 508 bp, Homo sapiens
  misc_feature: GZ8MTXP02HUI5A.39.20.B09.1.454.CMB.2.raw
  modified_base (125)..(125): a, c, t, g, unknown or other
  modified_base (280)..(280): a, c, t, g, unknown or other
  modified_base (311)..(311): a, c, t, g, unknown or other
  modified_base (316)..(316): a, c, t, g, unknown or other
  modified_base (326)..(326): a, c, t, g, unknown or other
  modified_base (332)..(332): a, c, t, g, unknown or other
  modified_base (336)..(336): a, c, t, g, unknown or other
  modified_base (340)..(340): a, c, t, g, unknown or other
  modified_base (346)..(346): a, c, t, g, unknown or other
  modified_base (369)..(369): a, c, t, g, unknown or other
  modified_base (381)..(381): a, c, t, g, unknown or other
  modified_base (401)..(401): a, c, t, g, unknown or other
  modified_base (404)..(404): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctntcttcctcggcgtccttgcttactgcacaggatccgtggcctcctatgagctgtctcagccacgctcagtcgtccgtgtccccaggacagacagccagcatcacctgctctggaaatacataggagataaatatgcttgctggtatcagcagaanccaggccagtcccctgtgctgatcatctaanacaanacacagcgcngacgcnccgngacnctatcnctcgctacacgtcgagacacacncactcacgacancgacggcgacgacgactagnganacgaacgtctagtaacttatttacgtacgtacgaggtacggacggacgacgacgaaggtaacggtaaggggtcggtacggggacggaacgggaaccgaacggcg

SEQ ID NO: 427656 - DNA, 683 bp, Homo sapiens
  misc_feature: GZ8MTXP02J31AW.39.20.B09.1.454.CMB.2.raw
  modified_base (265)..(265): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcacgccacgctcagtcgtccgtcgtccccaggacagacagccagcatcactgctacgtaggaatacagttaggaagtataaatntgcttgctggtatcagacgagacgccacggccacgtcccctgtcgctagactacatactactacaagactaaccgagcccggacctcgacgggtacctccgagacgtcgtacttccgacgtacggtaccctaccgtaaccgttaccggacgggaaaccaccgaccgtaccctaaaccgttccgtacgaacccgtaacgtacccggaacggggtaccccgggaacccgtacggggtaacctttaaggacgggtaacgtaacggtaaacgttcgttaacgttaaaccgtttagttttacggtacggttacggtaagggggtttacgtaacgggacaacgggaccggtaacgggtaacggggttaaaacgggggttccggttaccggggaacgggtaaccggaacccgtaacgtacccggg

SEQ ID NO: 427657 - DNA, 614 bp, Homo sapiens
  misc_feature: GZ8MTXP02JR6YF.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaacgccgaggccacgtcccctgtcgctgatcatctactcaagactaccgaagccgaccctcgacgggactcccgtagacgtcgtacttcgtcgtcggcctacccaaccttcgtacggggaaaccaccgacgacccctacttccgtacgaacccacgttccgaccgggacccgggaccccaggggtacctaagtaggacttaggacgtaccgtaggtaaccttagtttaacgttcggtacggtagggttagggtacgggaccacgggtaccgaaggtaaccgggtaaaagggggttcgggtacggggaccgggacggggtaaccccgaagggttacccg

SEQ ID NO: 427658 - DNA, 606 bp, Homo sapiens
  misc_feature: GZ8MTXP02IUYTF.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattaaggataataaatatgtcttgctggtatcgagcgagaacgccaggccacgtcccctgtcgctgatcatctaatacaagactaccgagccggaccctgacgggactcccgtagacgtacgtacttcgtctcggtaccctaccgaacgttcgtaacgggaaaccaccgacgcccctaactaccgttacgaaaccctagttaccgaacgggacccggggaaccccaggggtacctaagtaggggaacttaggaaacgtccgtaagtaaaccttaagtttacgtaggtaccgtagggtaggtacggggacagcgaaggaacggtaaagggttcgtacggggcggtaacgggacaacggtaccg

SEQ ID NO: 427659 - DNA, 641 bp, Homo sapiens
  misc_feature: GZ8MTXP02JT4GI.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattaggagataaatatgcttgctggtatcagcaagaagccaaggccacgtcccctgtgctgatcatctatcaagactaccgaagcccggcctcgaacgggtactccccgtagacgtccgtatttcctcgtcggtaccctacccgtaaacgtccgtaacggggaaaccaccgacgtccccacttcccacgaaccctagttacccgaacgggtacccgggggaacccctaggggaccttagtacgggaattcggaaacgttcttaacggtaacctttaaagtttacgttcggtacggtaaggggttcgggttacggggaactacgggacgaacgggtaacggtaaaacgggggttcggttaccgggggaacggggtaaccggggaacaacgggtacccgg

SEQ ID NO: 427660 - DNA, 530 bp, Homo sapiens
  misc_feature: GZ8MTXP02HPJ03.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattaggagaataaatatgcttgctggtatcagcagacgcagccacgtcccctgtgctgatcatctatacaagactaccgaagccggacctcgagggtactcccgtagactcgtacttctctgccttaccgaacgtctacgggaaacacgagacccacgtctacgaccataccgacggacccgggacccagggcctaagtggaactaggaacgtctagacttagttagtcgtagaggtgtacggacagcgagaacgtaaaggggtcgtacgggagacggacaagtcg

SEQ ID NO: 427661 - DNA, 531 bp, Homo sapiens
  misc_feature: GZ8MTXP02HR72Q.39.20.B09.1.454.CMB.2.raw
  modified_base (259)..(259): a, c, t, g, unknown or other
  modified_base (446)..(446): a, c, t, g, unknown or other
  modified_base (450)..(450): a, c, t, g, unknown or other
  modified_base (454)..(454): a, c, t, g, unknown or other
  modified_base (462)..(462): a, c, t, g, unknown or other
  modified_base (473)..(473): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagaataaatntgcttgctggtatcagcagaacgccaggcccacgtcccctgtcgctgatcatctatcaaagactaaccgaagcccggaccctcgaacggggtacctccccgtagacgcgtattcccgtcgttggccctaccaactcgtagggaaaccacacgcccactcacgaccatcacggcggacccaggctagngtangagntacgattnttagtgtacgnggtgtcgggacagacgaggaacgtaaaggggtcggttacgggacggacggacagtccg

SEQ ID NO: 427662 - DNA, 523 bp, Homo sapiens
  misc_feature: GZ8MTXP02IEJT3.39.20.B09.1.454.CMB.2.raw
  modified_base (358)..(358): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaacgccaggccagtcccctgtcgctgatcatctatacaagactaccaagccgcctcgacgggactcccgtgacgcgattcnctggctcccaactcgtaggaacacgacgccaactctacgaccatccgaggccggaccaggctagcgatagagctagactagttactgtacgaggtggtacgggacacgaccgaggaacgtaaaggggttacggtacgggacgggtacgggaaccgtaaggtccgg

SEQ ID NO: 427663 - DNA, 559 bp, Homo sapiens
  misc_feature: GZ8MTXP02FNFXD.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatcagttaggagaataaatatgcttgctggtatcagcagaacgccgacggccacggtcccctaggtcgctgatcattctaatacaaagtataccgaagcccggccctgacgggactcccgtgacgcgtattcctacgtcgacccttaccaaactcgtaacgggaaacacgacgaccctaactccgtacgaaccacgtaccgacggaccgggaccccagggactacgagatagaacgctagtacttattagtcgtagtagggtggtacggacagacaggaagtaaacgggggtcgtacggggacggaacggacgaacggcg

SEQ ID NO: 427664 - DNA, 587 bp, Homo sapiens
  misc_feature: GZ8MTXP02IQANI.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattagagaataaatatgcttgctggtatcagcagaagccaggccagtcccctgtgctgatcatctatcaagataccaagccggccctcgagggactcccgtgacgtctattctctggccttaccaactcgtacgggaaacacagccctaactctcgaaccctatacgacggccggggaaccccagggacctagtgggattaggaaacgtcgttagtaacttagtttaacttggttaccgaggggtttaggtacgggggaacctaagggtccgaaagggaaccggtaaaaggggggtttcggttacccgggggacggggtaaacgggggacccgaaaaggtcccgg

SEQ ID NO: 427665 - DNA, 533 bp, Homo sapiens
  misc_feature: GZ8MTXP02JAY97.39.20.B09.1.454.CMB.2.raw
  modified_base (299)..(299): a, c, t, g, unknown or other
  modified_base (402)..(402): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctcaggaaatacattaggagaataaatatgcttgctggtatcagcagaagccaggccagtcccctgtnctgatcatctatcaagataccaagccgccctcgagggactcccgtgacgtcgttctctgcctccaactcgtagggaaaccacgacgcccactcacgaccctanccgacgccgggacccaggcctagtggatgaacgctagaacttagttattgtcgtaggtgtacggggacaggacgaggacggtaaaagggggttcgttaccggggaggaacggggaccgaaggtcgtaacgg

SEQ ID NO: 427666 - DNA, 549 bp, Homo sapiens
  misc_feature: GZ8MTXP02JXJDA.39.20.B09.1.454.CMB.2.raw
  modified_base (250)..(250): a, c, t, g, unknown or other
  modified_base (273)..(273): a, c, t, g, unknown or other
  modified_base (407)..(407): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctggaaatcattaganataaatatgcttgctggtatcancagaacgccaggccacgtcccctgtgctgatcatctagtacaagactaaccaagccggccctcgagggactcccgtgacgcgattctctcgcttaccgaactcgagggaaacacacgtcccactcacgaaccanacgacggccggaccgtaggactaagtagaagtacgacgtcgtagtaacttaattacgttcggacgtagggtcggacggacacggtacgaacgggaaggtaaacgggggtcggtacggggagggaaccggtaaccgaggtccg

SEQ ID NO: 427667 - DNA, 548 bp, Homo sapiens
  misc_feature: GZ8MTXP02HAMGC.39.20.B09.1.454.CMB.2.raw
  modified_base (251)..(251): a, c, t, g, unknown or other
  modified_base (389)..(389): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattagganataaatatgcttgctggtatcagcagaagccaggccagtcccctgtgctgatcatcatcaaagactaaccaagcccggcctgacgggactcccgtagacgcgtattcctcgtcgcctaccaacgtcgtacgggaaacncgacgacccactcctacgaccatacgacggaccgggacccagggctaagtggatagaacgtctagtacttatttacgtgtacgtaggtggtacggacacggacgaaggaacggtaaaagggggttcggtacggggacggaacgggaaccgaacgcccgg

SEQ ID NO: 427668 - DNA, 640 bp, Homo sapiens
  misc_feature: GZ8MTXP02GPX2W.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcacctgctctaggaaatacattaggataataaatatgcttgctggtatcgagacagaacgccgacggccctacgtcccctgtcgctagatcatctaactacaaagtactaaccgacggcccggaccctggacgggtactcccgtagacgtcgtacttccgtcgtcggtacctaccgtaacgttccgacgggaaccaccgacgtaccctactcctacgaacctacgtaccggaacgggacccggggacccgacgggtacgtaacggtaggaacgtacggaaacgttcgtacgtaaactttagtttaacgttcgggttaggtacgggttcgggtacgggaaccgaggacggtaacgggaaccggggttaaaggggtcgggttacgggacggggaaccggaaccggacgtacccggg

SEQ ID NO: 427669 - DNA, 618 bp, Homo sapiens
  misc_feature: GZ8MTXP02H7TD9.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcacctgctcgtaggaaatacagttaggaataataaatatgacttgctggtactgaagcaagaacgccgaaggccacgtcccctgtcgctgatcatctactacaaagactaaccgaagccggtaccctcggacggtactccgtagacgcgtattctcgtcgcctacctacgtacgacggaacacgacgtaccctacttcacgacctacgtaccggacgggacccggaccgaggtaccgtagtacggtaagtacggaacgtacgttaacgtaacgtttaagtttacgttaggttaccggtaagggttacgggacggtaaccgacggcggtaaagggtaacgggtaaacgggggtcggtacggggaccggggaacggaaacgtacggtacccgg

SEQ ID NO: 427670 - DNA, 576 bp, Homo sapiens
  misc_feature: GZ8MTXP02GBYKV.39.20.B09.1.454.CMB.2.raw
  modified_base (251)..(251): a, c, t, g, unknown or other
  modified_base (392)..(392): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgcctcagccacgctcagtgtccgtgtccccaggacagacagccagcatcacctgctctaggaaatcattagganaataaatatgcttgctggtatcgagcagacgccaggccacgtcccctgtcgctgactcatctaactcaagactaccgaagccgcctcgacgggactccgtgacgcgtatctcgtcgtacctacgaactcgtacggaaaccncgacgaccctactcgacgtaaccacgtaccgacggtacccggacccgagggtcctaagtggaataggaaacgtctagtaacttagttacgttgtacgtacggggttacgagggacgtacggccaaggggtaacgtaaacgggggttcgttacgggggacggggaacggaaccgtaacgtaccgg

SEQ ID NO: 427671 - DNA, 586 bp, Homo sapiens
  misc_feature: GZ8MTXP02I4AF1.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagaataaatatgcttgctggtatcagcagaagccaggccagtcccctgtgctgatcatctatcaagactaccaagccggccctcgacgggactcccgtgacgcgtattcctcgtcggcctacccaaactcgtacgggaaaccacgacgccctaactcctagaacccataccgaacggccggggaaccccaggggaccctagtcggaataggaaacgtccgtaagaacctttatttaagttcggttaccgtagggttcggtacggggacaacggcgaaggtaaccggtaaaagggggttcgttaccggggacgggaacggggaacccgaaaggtcccgg

SEQ ID NO: 427672 - DNA, 483 bp, Homo sapiens
  misc_feature: GZ8MTXP02FGC92.39.20.B09.1.454.CMB.2.raw
  modified_base (235)..(235): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctcnggaaatacattaggagataaatatgcttgctggtatcagcagaagccaggccagtcccctatgctgatcatctatcaagataccaagccggccctcagggatccctgagcgattctctggcctccaactctgggaacacagccactctgaccatcagcgggacccaggctatggatgaagctgactatattgcaggtgtgggacaggcaaggcgaaaagggggtcgtacgggcgacgggaccaagccg

SEQ ID NO: 427673 - DNA, 607 bp, Homo sapiens
  misc_feature: GZ8MTXP02HC6NH.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagaataaatatgcttgctggtatcagcagaagccaggccagtcccctgtcgctgatcatctatcaagataccaagcggaccctcgagggactccctgacgtctatttcctcgtggccctaccgtaactcgtacgggaaacacgacgaccctaactctacgaaccacgtacacgggacccggacccgacgggtacctaagtggtaagttacggaaaggtccttagtaactttaagtttaaagttcggttacgttaacggggttcggttaggggaaccgaaggacgaacggaaccggggtaaaagggggttcgggttaccgggggaaccggggtacggggaaacccggaacggtaacccgg

SEQ ID NO: 427674 - DNA, 563 bp, Homo sapiens
  misc_feature: GZ8MTXP02F9JO4.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattaggagaataaatatgcttgctggtatcagcagaagccaggccacgtcccctgtgctgatcatctatcaagactaccaagccggccctgacgggtactcccgtagagcgtacttctctggcctacccaacgttcgtagggaaaccacgacgacccactctacgaccatcgacggccgggaccctagggctaagtggaactaggtaaagtccgtagtaacttaagttaacgttggtacgagggttggtacgggaccaggccaaggaaccggtaaagggggttcggtacggggacgggtaacgggaaccgaggtaccgg

SEQ ID NO: 427675 - DNA, 534 bp, Homo sapiens
  misc_feature: GZ8MTXP02JUT24.39.20.B09.1.454.CMB.2.raw
  modified_base (299)..(299): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaacgccaggccagtcccctgtnctgatcatctatcaagactaccaagccggcctcgacgggactcccgtagagcgtattctcgtggcctccaacgtcgtagggaacacgagcccaactctacgaccatcgacggccggacccagggacctagtggatggaagtcgtagtacttattacgttagtacgtagggtgtagggacaggaccaggaaccggtaaagggggttcgtacggggacggacggaccgaacggtccg

SEQ ID NO: 427676 - DNA, 500 bp, Homo sapiens
  misc_feature: GZ8MTXP02FKOB4.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtccccctgtcgctgatcatctatcaagataccagccggccctcgacgggactccctgagcgattctctggcctccaactcgtgggaaccacacgccactctcgaccatcgagccggacccaggcctagtggatgaagctgactattacttgcgtaggtcgtggacacgcgagaacgaaaggggtcgtacgggacggacggaccgaagtccg

SEQ ID NO: 427677 - DNA, 706 bp, Homo sapiens
  misc_feature: GZ8MTXP02FY1M5.39.20.B09.1.454.CMB.2.raw
  modified_base (253)..(253): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatacattagganaataaatatgcttgctggtatcagcagaacgccaggccacgtcccctggtcgctgactcatctacgtacaagtactaaccgaacggcccggccctacggacggggtacctacccgtagacgtcgttaacgttcccttacgtcggtacccttacccgaaacgttacggtacggggaaaaccacccgtaacggacccctaacttacccgtacggtaaacccacgttaccggaacccggggtaccccggggaacccccgtaacgggggtaacccttaaagggtaccgggtaaagttacgggaaaacgtccgttaaggtaacctttaagtttaagttcggttacggtacggggttacggttagggggaacctaaggcccgaaagggtaaccgggtaaaaggggggttcggttaccgggggaaccgggggtaaacggaaccggttaacggtacccggg

SEQ ID NO: 427678 - DNA, 563 bp, Homo sapiens
  misc_feature: GZ8MTXP02HNTJ7.39.20.B09.1.454.CMB.2.raw
  modified_base (281)..(281): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatacattaggagataaatatgcttgctggtatcagcaganccaggccacgtcccctgtcgctgactcatctatacaagtactacgaagccgccctgagggtactccgtgacgcgtacttcctcgtcgcctacccaactcgtacgggaaacacgacgccctacttcacgaacctactcgacggccgggacccaggtcctagtgactagaacgctacgtattagttattcggtacgagggtttaggacggggacacggaccgaaggtaaccggtaaaagggggttggttaccgggggacgggaacgggacccgtaaggtcccgg

SEQ ID NO: 427679 - DNA, 513 bp, Homo sapiens
  misc_feature: GZ8MTXP02FS806.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaacgccaggccagtcccctgtcgctgatcatctatcaagataccaagccgccctcgagggactcccgtgacgcgtattctctcggcctaccaactcgtagggaaacacgagcccaactctacgaccatcgacggccgggaccccagggactaagtggaatgaagctagacttattattgtcaggttgtggacgagctaggaacgtaaaggggtcgtcggacggaggaccgaggtcg

SEQ ID NO: 427680 - DNA, 579 bp, Homo sapiens
  misc_feature: GZ8MTXP02GLA0M.39.20.B09.1.454.CMB.2.raw
  modified_base (261)..(261): a, c, t, g, unknown or other
  modified_base (410)..(410): a, c, t, g, unknown or other
tcagtcgcactagtcacgaccggtgctcgatttagtgtagtgtgaagggttgagaacctatgaacattctgttggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatacattaggagaataaatntgcttgctggtatcagcagaacgccaggccacgtcccctgtcgctgatcactctaactacgaaagactaccgaagccggaccctgacgggactcccgtgacgtacgtacttcgtacgtcggtacctaccgtaaacgtcgtacggaaacncgacgccctactcgtcgaacctacgcgacggccggaacccaggtaccgtaagtggaacgtaggaaactcgtaacgtacttagttaagtcggtagtacgggttaggacggacgaggcgaagggaacggtaacgggggtcggtacgggacgggaacggtacgacgtaccgg

SEQ ID NO: 427681 - DNA, 553 bp, Homo sapiens
  misc_feature: GZ8MTXP02G7ZK1.39.20.B09.1.454.CMB.2.raw
  modified_base (271)..(271): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattaggagataaatatgcttgctggtatnagcagaagccaggccagtcccctgtcgctgatcatctatcaagataccaagccgaccctgagggactcccgtagacgcgtattctcgtgtccctaccactcgtacgggaacaccgaacgcccaactctcgaacccagtacgaacggaccgggaccccgagggtaccctaagtggaacgtagaaggtcctaggtactatttacgttaggtcgtagggttcgaggacgacgcgaaggaaccggtaaaaggggtcgtaccggggaggacggaaccgaaggtcccg

SEQ ID NO: 427682 - DNA, 545 bp, Homo sapiens
  misc_feature: GZ8MTXP02H57MA.39.20.B09.1.454.CMB.2.raw
  modified_base (253)..(253): a, c, t, g, unknown or other
  modified_base (329)..(329): a, c, t, g, unknown or other
  modified_base (336)..(336): a, c, t, g, unknown or other
  modified_base (364)..(364): a, c, t, g, unknown or other
  modified_base (410)..(410): a, c, t, g, unknown or other
  modified_base (424)..(424): a, c, t, g, unknown or other
  modified_base (482)..(482): a, c, t, g, unknown or other
  modified_base (498)..(498): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctctatgagctgtctcagccacgctcagtcgtccgtgtcccaggacagacagccagcatcacctgctctaggaaaatacattaggaanaataaaatatgtacttggactaggtatcgagacgagaagcccaaggccacgtcccctgtgctgactcatctaacanaaagtanaaccgagccggcctgagggtcctcccgngacgtcactttcacttcgactaccaaacgtcgaacggaacacgacncccaactcacaccntacgaggtaccggaccagggacctaagtggatacggaactcgtagaaattatttacgngtagaggtgacggacncgacgagaacgggtaagggtcgtacgggacggacggaacgacgtacg

SEQ ID NO: 427683 - DNA, 677 bp, Homo sapiens
  misc_feature: GZ8MTXP02JDJXN.39.20.B09.1.454.CMB.2.raw
  modified_base (234)..(234): a, c, t, g, unknown or other
  modified_base (249)..(249): a, c, t, g, unknown or other
  modified_base (298)..(298): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcactgctcnggaaatcattagganaataaatatgcttgctggtatcagcaagaagccaggccagtcccctgtnctgatcatctatacaagactaccaagccggccctcgagggtactcccgtagacgtcgtactttccgtcgtcggtaccctacccgaaacgttccgtaggggaaaacccaccgaacgacccctaaaccgttcctacgaaacccacgttaccggaaaccgggtaccccgggggaacccccaagggggtaccctaaggttacggggaacttagggaaaaccggtccttaaggtaaccctttaacgtttaaacgttggtaaccgtagggggtttaccggtacgggggtaaccaaggtaccgaaagggaaccgggtaaaaggggggtttcggttacccgggggaacggggtaaaacgggggtaaccccgaaaagggttccccggg

SEQ ID NO: 427684 - DNA, 576 bp, Homo sapiens
  misc_feature: GZ8MTXP02F734H.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattaggagataaatatgcttgctggtatcagcagaagccaggccagtcccctgtgctgatcatctatcaagataccaagccgccctcgagggactccccgtgacgtcgacttcctcgtggaccctaccaaactcgtacgggaacaccgagcccactctgaaccatccgacggccgggacccaagggcctaagtcggattaggaaacgtcgtagtacttaagttacttaggttacgtacgggttaggtacggggacaacggccgaaagggaaccgggtaaaagggggttcggttaccgggggacggggaacggggtaacccgaaacggtacccgg

SEQ ID NO: 427685 - DNA, 561 bp, Homo sapiens
  misc_feature: GZ8MTXP02FSAOV.39.20.B09.1.454.CMB.2.raw
  modified_base (234)..(234): a, c, t, g, unknown or other
  modified_base (250)..(250): a, c, t, g, unknown or other
  modified_base (430)..(430): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctntaggaaatcatagganaataaatatgcttgcgtggtatcagcaagaacgccgaggcccacgtccccgtgtcgctagactctatctaactacaaagactaaccgaacgcccggccctcgagggtactcccgtgacgcgtactctcgtcgcctaccgaacttcgacgggaaacacgaacgacctacactcgaccctancgaacggccggaccctagggactagtggatagaacgtctagtacttattagttacgtagtaggttggaggacgacggcgacggaacggtaaaggggtcggttaccggggacggaacgggaccaaggtccgg

SEQ ID NO: 427686 - DNA, 599 bp, Homo sapiens
  misc_feature: GZ8MTXP02H0CML.39.20.B09.1.454.CMB.2.raw
  modified_base (253)..(253): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatacattagganataaatatgcttgctagtatcagcaagacgccaggccacgtcccctgtagtctgactcatctaatacaaagtactaaccgaagcccggccctcggaacgggtactccccgtagacgtcgtacttctccgtcggtacctacccgtaacgtcgtaacggggaaaccacgacgccctaacttcgtacgaaccctaacgtccgaacggtaccggggaaccctagggaccgtagttaccggaagttcgaagtccgtagtaacttagttaagttcgtaggaggttggacggtaacgacgacgaggtaacggtaaaggggtcggtcggggacggtacgggactaacggcccgg

SEQ ID NO: 427687 - DNA, 549 bp, Homo sapiens
  misc_feature: GZ8MTXP02JA44I.39.20.B09.1.454.CMB.2.raw
  modified_base (313)..(313): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaatacattaggagaataaatatgtcttgctggtatcagcagaagccgaggccagtccccctgtcgctgatcatctanacaagataccaagccgaccctcgacgggactccctgacgcgtattctcgtggcctacccaactcgtggaaccacgacgcccactcacgaccatcgacgccgggacccaggacctagcggagtagaagcctagtacttagtttacttgtaccgtagggtacggtagggaccgaggccgaaggaaccggtaaaagggggtcggttaccggggacggggaacgggaccgaggtacccgg

SEQ ID NO: 427688 - DNA, 619 bp, Homo sapiens
  misc_feature: GZ8MTXP02GWT8M.39.20.B09.1.454.CMB.2.raw
  modified_base (247)..(247): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcactgctctgaatacatagganaataaatatgcttgctggtatcagcaagaacgcccaaggcccaagtcccctgtcgcctgacttcatctaactacaaacgtactaaccgaagcccggacccctggacgggactcccgtagacgtacgtacttctacgtcggacctaccgaacgtcgtaacgggaacacgacgacccactacctacgaaccacgtaccgacgggacccgggacccgagggtacccttaagacggtacgttaggaaacgtccgtagtaacttagtttaagttcggtacgtacggggttagacggggtacaacggaccgaacggaacgggttaaaagggggtcgggttacggggaccggggaacgggaacccgaaaggttcccggg

SEQ ID NO: 427689 - DNA, 501 bp, Homo sapiens
  misc_feature: GZ8MTXP02I17E7.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagagccaggccagtcccctgtgctgatcatctactcaagactaccaagccggcccctgagggactcccctgacgcgatttcctctcggctccaaactcgtagggaaacacaagcccactctgacctaatccacggccgggaccccagggcctatggatgaaagctagactattagtgtacgaggtgtggacagcagcgaaagggtcgtcggcggaggaccaagtcg

SEQ ID NO: 427690 - DNA, 635 bp, Homo sapiens
  misc_feature: GZ8MTXP02HJPGA.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaatacattaggagaataaatatgcttgctggtatcagcagaagccaggccacgtcccctgtcgctgatcatctactacaagactaccaagccggccctcgacggggactccccgtagacgcgtactttccgtcgttcggcccttacccaaacttccgtacgggaaaccaccgacgccctaactcctacgaaccctagtaccgaacgggacccgggaaccccgaaggggtacccttaagtacgggtaagtacggaaacgtaccgttaggtaaacctttaagttttagtttacggtacgtaacgggggttggtacggggaccgtaggaccgtaagggaacgggtaaaagggggttcggttaccgggggacggggaaccggggtaaccgaacggtacccgg

SEQ ID NO: 427691 - DNA, 654 bp, Homo sapiens
  misc_feature: GZ8MTXP02JYARA.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattaggagaataaatatgcttgctggtatcgagcagaagccaggccacgtcccctgtcgctgatcatctatcaagactaccaagccggccctcgacggggtactcccgtgacgtcttacttctcgtcggcctaccgtaacctcgtacgggaacacgacgccctactctacgacctacgtaccgacgggtacccggggaccccgacgggtaccttaagtcgggtaaacgttacgggaagtaccgttaacgtaaccgtttaattttaaccggtttaggtttaccggtaagggggttacggttacgggggaaaccgacggggtaaccgaaacggggtaacgggtaaaaacggggggtttcgggttaccgggggaccgggggtaaacggggaacccggtaaacgggttccccggg

SEQ ID NO: 427692 - DNA, 545 bp, Homo sapiens
  misc_feature: GZ8MTXP02GQSQD.39.20.B09.1.454.CMB.2.raw
  modified_base (347)..(347): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagaataaatatgcttgctggtatcagcagaacgccaggccacgtcccctgtcgctgatcatcatacaagactaccagccgcctcgacgggactcccgngacgcgtattctctcggtcctaccaacgtcgtacggaaacaccacgaccctactcacgaaccacgtcgacggaccgggacccagggtcctagtcggatagaagtcctagacttattagttgtacgtaggtggtacggacgacggacaggaacggtaagggggttcggtacggggacgggacgggaccgacggtaccgg

SEQ ID NO: 427693 - DNA, 606 bp, Homo sapiens
  misc_feature: GZ8MTXP02FSL2T.39.20.B09.1.454.CMB.2.raw
  modified_base (392)..(392): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattaggagtaaataatgcttgctggtatcagcagaagaccaggccacgtcccctgtgctgactcatactatactaaagactaacaaacgcggccctcaggggactccctcgagcgtactcgtctagctaccaactacgtgggaacaaccncgacctactcaccgaacacgtaccgaacggacccggaccgtacgtacgtacgtaggtaagtacgaaacgtctacgttaaactttacgtttaagttacggtacggtaggggttacgggacgggaaacgtacgacggtacgggtaaacggggtaaaacgggggtttcgggtaccggggaacggggaaacgggtaaaccctaacgggtcgtaaccgg

SEQ ID NO: 427694 - DNA, 569 bp, Homo sapiens
  misc_feature: GZ8MTXP02GWJJ8.39.20.B09.1.454.CMB.2.raw
  modified_base (258)..(258): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatacataggagataaatntgcttgctggtatcagacagacgccaggccagtcccctgtgctgatcatctactacaaagactaaccgaagccggacctcgacgggactcccgagacgcgtatttcctcgtcggaccctaccaactcgtacgggaaaccacacgacccaactcgtacgacccagtccggacggacccgggacccagggtactacgtggacgtagaacgcttagtacttagttactcggtagtacggtggtacggaacgacgacgtagggaacggtaaacgggggtcggtaccggggacgggaacgggaaccgaacggtccg

SEQ ID NO: 427695 - DNA, 593 bp, Homo sapiens
  misc_feature: GZ8MTXP02GX302.39.20.B09.1.454.CMB.2.raw
  modified_base (251)..(251): a, c, t, g, unknown or other
  modified_base (258)..(258): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctagaaatacattagganataaatntgcttgctggtatcagcagacgccaggccacgtcccctgtcgctgatcatcaatcaagactaccagccgccctgacggactcccgtagacgtacgtactttccgtacgtcgtccctacctaacgtcgtacgggaaaccacgacgaccctacgtcctacgacctacgtaccgacggacccgggacccgagggacctaagtggaagtacggaacgtcgtagtacttaagtttacgttaggtacgtacggggttaggtacgggacgaggaccgaaggtaacgggtaaaacgggggttcggtaccgggggacgggaaccgggtaaccgaacggtaccgg

SEQ ID NO: 427696 - DNA, 553 bp, Homo sapiens
  misc_feature: GZ8MTXP02JJHX4.39.20.B09.1.454.CMB.2.raw
  modified_base (248)..(248): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcactgctctgaaatcattagganataaatatgcttgctggtatcagcagaagccgaggccacgtcccctgtcgctgatcatctactacaagactaccagccggccctcgacgggactcccgtagacgtcgtacttcgtcgtcggtaccctaccgacgtcgtacgggaaccacgacgccctactctacgaccatcgacggccgggaccaggctaagtcggatagaacgtcgtagaacttagttagttgtacgtaggtgggtacggacgaggcgtaacggaacggtaaagggggttcggtacgggggacggacgggacccgaaggtccgg

SEQ ID NO: 427697 - DNA, 536 bp, Homo sapiens
  misc_feature: GZ8MTXP02IBJXW.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattaggagataaatatgcttgctggtatcagcagagccaggccagtcccctgtcgctgatcatctatcaagactaccaagcccggaccctgacgggacttcccgtgacgtcgtattctctgcctaccaactctagggaacacacgccactctacgaccataccgacggaccgggacccagggacctagtcggataggaacgcgtagacttatttacgttgtcgagggttggtacgggacaaggccgtaaggaacggtaaaggggttcgtcgggacggacggaccgaacggtccg

SEQ ID NO: 427698 - DNA, 621 bp, Homo sapiens
  misc_feature: GZ8MTXP02GYH6F.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctctatgagctgtctcagccacgctcagtcgtccgtcgtccccaggacagacagccagcatcacctgctctaggaaatcaattaggagaataaatatgcttgctggtatcagcagacgccaggccacgtccctgtgctgatcatctactacaagactaccgagccgaccctcgacggtactcccgtagacgtcgtacttccgtctcgcctaccctaacgtcgtaacggggaaaccacgaccgaccctactaccgtacgaaaccctacgtaccggaaccgggtaccgggaacccctaggggtacctaaacggtagggtaacgtacgggaaacgtcgttaacggtaactttaaagttttcgttaggttaccggtaaggggttcggaacgggtaccgagtccgaaaggtaacggtaaagggggtcgggtacgggaccgggaacggaacccgaaggtccgg

SEQ ID NO: 427699 - DNA, 548 bp, Homo sapiens
  misc_feature: GZ8MTXP02G11H1.39.20.B09.1.454.CMB.2.raw
  modified_base (297)..(297): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcacctgctctaggaaatcattaggagataaatatgcttgctggtatcagcagaagccaggccagtccccngtgctgatcatctatcaagactaccgaagccgcctcgagggctcccgtgacgcgtattctctgcctaccactcggtacggaaccacgacgcccactctacgaccacgtaccgacggacccgggacccagggtactagtacggatacggaaggctagacttagttagttcggtacgtaggtggtacgggacaggccgaaggaacggtaaacgggggtcggttacggggacgggtaacggacgaacggtccgg

SEQ ID NO: 427700 - DNA, 536 bp, Homo sapiens
  misc_feature: GZ8MTXP02HHS7Q.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatacagttaggagaataaatatagcttagctggtatcagcagaacgccaggccacgtcccctgtcgctgatcatctatacaagactaccgaacgtccggccctcgacgggtactcccgtagacgtcgtatttccgcgtgtcctaccaacgtcgtacggaacacgacgacccactcacgaccataccgacggcggaacccagggacctagtagatagaatcgtagtacttattagtgtgaggtgtaggacgacgcgaggaacgtaaggggtcgtacgggaggacggacgaacgtcg

SEQ ID NO: 427701 - DNA, 688 bp, Homo sapiens
  misc_feature: GZ8MTXP02H5MFP.39.20.B09.1.454.CMB.2.raw
  modified_base (125)..(125): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctntcttcctcggcgtccttgcttactgcacaggatccgtggcctcctatgagctgtctcagccacgctcagtcgtccgtgtccccaggacagacagccagcatcacctgctcgtaggaatacattaggagaataaatatgcttgctaggtatcagcagacgccgaggcctacgtcccctgtcgctgaactcatctactacaagactaccgaagccggaccctgacgggtactcccgtggacgtcgtaactttccgtaccgtcggtaccttaccccgaacgttaccggtaacgggggtaaaccctaaaccggaaccggtacccccgtaaccgtcccttaacggaaaccccctaccgttaccggaaccgggtaccccggggaacccccgaagggttaccgtaacgtagggtaacgttacggaaacgtccgttaggtaaacctttaagtttacgttacggttacgtaacggggtttaggacggggtaaccacgggacgaaggtaaccggggtaaaagggggttcgggttaccggggacggggtaaacgggtaaccgaaacggtcccgg

SEQ ID NO: 427702 - DNA, 606 bp, Homo sapiens
  misc_feature: GZ8MTXP02GVRQ0.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctcaggaaatacattaggagataaatatgcttgctggtatcagcagaacgccaggccacgtcccctgtcgctgatcatctactacaagataccgaagccgcctcgacgggactcccgtagacgcgtattcctacgtcggtccttaccaaccgtcgtacggggaaaccaccgacgaccctaactcgtaccgaaccactcgaacggaccgggaccccagggacctaagtggaatacggaaacgtctagtaacttagtttagttacggtacggtaggttacgggtagggaccgaaggacgtaacgggaaccgggtaaaagggggttcggttaccgggggaaccggggaacggggaaccccgttaagggtaaccccggg

SEQ ID NO: 427703 - DNA, 533 bp, Homo sapiens
  misc_feature: GZ8MTXP02JUPE7.39.20.B09.1.454.CMB.2.raw
  modified_base (252)..(252): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattagganataaatatgcttgctggtatcagcagacgccaggccacgtcccctgtcgctgatcatctatcaagactaccagccgcctcgagggactcccgtagacgcgtattctcgtcggcctaccaactcgtacgggaaacacacgcccactctacgaccatccgacgccgggacccagggtctaacgtgactagaacgcttagacttattacgttgtacgtaggtcgtagggacaggacaaggaacgtaaagggggtcggtacgggacggacgggaccgaggtaccg

SEQ ID NO: 427704 - DNA, 562 bp, Homo sapiens
  misc_feature: GZ8MTXP02JZ7A2.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaatacattaggagataaatatgcttgctggtatcagcagaagccaggccagtcccctgtcgctgatcatctactcaagataaccgaagccggccctcgacgggactcccctgacgcgtattcctcgtcggctccaactcgtacggaacacagcccacgtctacgaccatccgacggccgggtacccagggactagtcggataggaagcctagtaccttaatttaattcgtacgtacgggtacggttagggacacggtacgacggaacggtaaaacgggggttggttaccggggacggggtaacggggaaccccgtaaaggtcccgg

SEQ ID NO: 427705 - DNA, 712 bp, Homo sapiens
  misc_feature: GZ8MTXP02GIYNV.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatccacctgctctaggaaatacattaggagataaatatgcttgctggtatcagcagagccaggccagtccccctagtcgctgatcatctatacaagataaccagccgccctgacgggtactcccgtagacgtacttactttccgtactcgggtaccctacccgtaaaccgttccggttaaccggggaaaaccctaccgaacggtaccctaccgttacctacggaaacccttaccgtacgtaaccgggcccgggaaaccccgaggggtaaccctaaggttacgggtaaaccgttaaggaaacggtccttaacggggttaaaccttaaagtttttaaccggttggttaacccggttaagggtttacggggtacgggtaaccgtaaacggaccgtaaaacggggtaacccggggttaaaaaggggggttcggtttaacccgggggtcgggggtaaaacccggggtaaccggaaaccggtttaaccccggggg

SEQ ID NO: 427706 - DNA, 613 bp, Homo sapiens
  misc_feature: GZ8MTXP02G6HPI.39.20.B09.1.454.CMB.2.raw
  modified_base (251)..(251): a, c, t, g, unknown or other
  modified_base (435)..(435): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctagaaatcattagganaataaatatgcttgctggtatcagcaagaacgccaggcctacgtcccctgtcgctgatcatctacacaagactaaccgagcccgcctacggacgggtactccccgtagacggtactacgttcctacgtcggtacctaccgtaaacgtcggtaacggaacaccgacgacctaacgtcacgaaccngtaccgacggaccggacccgaggtactagtacggatacgaacgtccgtaagtaacttagtttaagtcggttacggtaacgggtggttacgggaaccgaggtaaccgaaagggtaaccgggtaaaagggggttcgggtaccgggggaacgggaccgggtaaaccgaacgggttacccgg

SEQ ID NO: 427707 - DNA, 694 bp, Homo sapiens
  misc_feature: GZ8MTXP02GJR8D.39.20.B09.1.454.CMB.2.raw
  modified_base (253)..(253): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcacctgctctaggaaatcattagganaataaatatgcttgctggtatcagcagaacgccgaggccacgtcccctgtcgctgatcatctatacaagactaccgaagcccggccctcggacgggtactcccgtaggacgacgtacttccgtccgtcggtacctaccctaaccgtcgtaacggggaaacccacgtacggcccctaacgtcccgtacggaaccctaacgtacccgaacgggtccccggggaacccctaacggggtacccttaaggtaccgggtaaagtacgggtaaaacgtccgttaacggtaaaccttttaaagtttacggtttacggttacgggtaaggggttacggggttacggggaaaccgtacgggaccgtaaggggtaaacggggtaaaagggggtttccggggttaccgggggaacggggtaaaccggggaacccgtaacggggttaaccccgg

SEQ ID NO: 427708 - DNA, 774 bp, Homo sapiens
  misc_feature: GZ8MTXP02IE7EZ.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatacattaggagtaataaatatgcttagctaggtaatcagcaagacgccgaaggccctacgttccccctaggtcgtaccgtaggtaacttaccgtaactttacctaacgttaacccgaaaacggtaaccttaaaacccccggaaaacggggttcccccggaccccctttacggggaaaccgggggtttaaaccctttccccccggttagggaaaccggtcccgggtttaaacttttcccgtacccggtttccggggacccctttaacccgaaccggttttacccggtaacggggtaaaaccctacggtaacgacccctaaaccgtcttaaccggaaccctacgtaccgaaacgggtaccccgggaaaccccgtaggtacgttaaggtacggtaacgtacggtaaacgtacgttacgttaaacgtttaagtttacgttacggtacggtacgggttacggacggtaacgacggacgtaaacggggtaacgggtaacggggttcggacggggacggaaccggtaaccgtacggtcg

SEQ ID NO: 427709 - DNA, 563 bp, Homo sapiens
  misc_feature: GZ8MTXP02F7F54.39.20.B09.1.454.CMB.2.raw
  modified_base (264)..(264): a, c, t, g, unknown or other
  modified_base (469)..(469): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcacctgctcaggaaatacaattaggagaataaatatncttgctggtatcgagcagaacgccaggccacgtcccctgtgctgactcatctaactacaagtactaaccgaacgccggaccctcgacgggacctcccgtagacgtcgtacttcctcgtcggtcctaccgaactcgtacggaaccacgacgacccactactacgaccatccgaacggccggacccagggacttagcggatcggaancgtagtacttattacgtgtacgtaggtgtacgggacgacgcgtaggaacggtaaaggggtcggttacggggcggaacgggaccgaacgtaccgg

SEQ ID NO: 427710 - DNA, 649 bp, Homo sapiens
  misc_feature: GZ8MTXP02GQZR7.39.20.B09.1.454.CMB.2.raw
  modified_base (250)..(250): a, c, t, g, unknown or other
  modified_base (257)..(257): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcactgctctaggaatacattagganataaatntgcttgctggtatcagcaagacgccgaggcctacgtcccctgtgctgatcactctactacaaagtactaaccgaaggcccggaccctcggaacgggtacttaccccgtaggaacgtcggtactttccgttaccgttcggtacccttacccgaaacgttcccgtacggggaaacccaccgacgcccctaacttccgacgaaaccctacgtaccgacgggacccgggaaccccgagggtaccttaagtacgggatacggaacgtctacggtaacttaatttacgttaggtacgtagggtacggttacgggaacgtacggacggaagggtaaccgggtaaagggggttcggttaccgggggaacggggaaccgggtaaccgaacgggttacccgg

SEQ ID NO: 427711 - DNA, 497 bp, Homo sapiens
  misc_feature: GZ8MTXP02H68N0.39.20.B09.1.454.CMB.2.raw
  modified_base (333)..(333): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgttggtatcagcagaagccaggccagtcccctgtgctgatcatctatccaagactaccaagcgccctcgngggactcctgacgtcgattctctgctccaactctacgggacacacgccactctcgacatcaggccggaccaggctagtggatcggagctagtactattacttgtcgtagggtgtaggacagcagacgaagggggtctacgggacggacggacaacggcgtacgg

SEQ ID NO: 427712 - DNA, 512 bp, Homo sapiens
  misc_feature: GZ8MTXP02GS598.39.20.B09.1.454.CMB.2.raw
  modified_base (429)..(429): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcactgctctggaatacattaggagataaatatagcttgctggtatcagcagaagccaggccagtcccctgtgctgatcatctatcaagtataccaagccgccctgagggactcccgtgagcgattcactggcctaccaactcgtagggaacacgagccctaacgtcacgaaccagacgacggaccgggaccccaggtacctagnggaatcgaaagctacgtatagttactgtacgtaggtcgtaggacagcgagaagaaagggtcgtcggacggacggaccaagccg

SEQ ID NO: 427713 - DNA, 582 bp, Homo sapiens
  misc_feature: GZ8MTXP02JF42L.39.20.B09.1.454.CMB.2.raw
  modified_base (298)..(298): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtcgtccccaggacagacagccagcatcacctgctctggaaaatcattaggagataaatatgcttgctggtatcagcagacgccgaggccacgtccccngtcgcttgactcaattctatccaaagtactaccgaagccggccctgacgggactccccgtgacgcgtactttcacgtcggacccttacccaactcgtacggggaacaccgacgaccctactcctacgaccaagtccgacgggtcccgggaccagggcctagcggaacgtgaaacgtccgtagtaaccgttattacgttgtacggtacgggtggtacgggacgaacggcaaggaaccggtaagggggtcggttacgggggacggaacggggtacaacggtaccgg

SEQ ID NO: 427714 - DNA, 646 bp, Homo sapiens
  misc_feature: GZ8MTXP02H40RJ.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacacgccagcatcacctgctctaggaaatacagttagagaataaatatgcttgcgtggtatcgagacgaagaagacccgaggccctacgtccccctggtcgtctgactcatctactacaaacgactaccgaagccggaccctgacgggactcccgtagacgtcgtacttcgtcgtcgacctaccgaaccgtcgtacggaaaccacgacgaccctactcgtacgacctacgtaccgaccgggacccgggaccccgagggtaccgtaggtaggtaacgtacggaacgtacgtacgtaactttaacgtttagttcggttacggttacggggttacggtagggggaccaagggtaccggtaaaggtaaccggggtaaaagggggttcggggttaaccggggacgggggtaaccggaaccgtaacgggtacccgg

SEQ ID NO: 427715 - DNA, 566 bp, Homo sapiens
  misc_feature: GZ8MTXP02HPIFQ.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaatacattaggagataaatatgcttgctggtatcagcagaagccaggccagtcccctgtcgctgaactcatactactacaagataccgaagccggccctcgaggggtactcccgtagacgcgtattctcgtcggcctacctaaactccgtagggaaccacgacgccctactactacgacccatccgacggccgggacccagggtaccttagaggtatacggaaacgcgtagtaacttaactttagttggttacgagggttacggtgggaacaggaccgagtaaccggtaaaggggtcggtacgggacgggtacgggaaccgaacgccgg

SEQ ID NO: 427716 - DNA, 628 bp, Homo sapiens
  misc_feature: GZ8MTXP02FHGZ5.39.20.B09.1.454.CMB.2.raw
  modified_base (245)..(245): a, c, t, g, unknown or other
  modified_base (253)..(253): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcactgctcagaatcatagganataaatangcttgctaggtatcagcagacgccaggcccacgttcccctggtcgcttgatctaattctactacaaagactaaccgaacgccggaccctcggaacgggacttcccgtagacgtacgtacttctccgtcggtcctaccaacgtcgtagggaacaccgacgaccactactacgaaccataccgacggaccgggaccccgagggtaccttacgtaggtagtacggaacgtacgtagtaacttaagtttagttacggtacggtacggggttaggtacgggtaaccgaagggtaccgaaagggtaaccgggttaaaaaggggggttccggttaccgggggaacggggtaaaccggggaaacccggtaggttaaccccggg

SEQ ID NO: 427717 - DNA, 658 bp, Homo sapiens
  misc_feature: GZ8MTXP02GLJWB.39.20.B09.1.454.CMB.2.raw
  modified_base (386)..(386): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattaggagataaatatgcttgctggtatcagcagaagccaggccagtcccctgtcgctgatcatctatcaagactaccaagccggccctcgacgggactcccctgacgcgtattcctctggccctaccaactctacgggaaccncgtaacgcccaactcgtacgaaccctagtccgaacgggcccgggaaccccgtaggggtacccttaaagttcggggaatttacgggaaaacggtcccgttagggtaaacccttttaagtttaaagtttcccggttacggtaaacggggttcgggttaacgggggtacgtaaacgggccgaaaagggggtaacccggtaaaaagggggggtttcggtttacccggggggaaccggggttaaccgggggtaaacccgaaaacggtttaccccggg

SEQ ID NO: 427718 - DNA, 597 bp, Homo sapiens
  misc_feature: GZ8MTXP02IQFTK.39.20.B09.1.454.CMB.2.raw
  modified_base (312)..(312): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcactgctctagaaatacattaggagataaatatgcttgctggtatcagcagacgccaggcctacgtcccctgtcgctgatcatctanacaagactaccaagcccggcctcgaagggactcccgtagacgcgtacttctcgtgcctaccaacgtcgtacggaactaccacgacccactcacgaaccactccgacggacccggaacccgagggtaccctagtacggtacgtaggaaacgtccgttagtaacgttaattttacgtcggttacggttaagggttcggtacgggtacgaacggtaccgaaagggtaacgggtaaaacgggggttcggttaaccgggggacgggtaacgggaaccgaaacggtcccgg

SEQ ID NO: 427719 - DNA, 667 bp, Homo sapiens
  misc_feature: GZ8MTXP02GWPW6.39.20.B09.1.454.CMB.2.raw
  modified_base (321)..(321): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatcattaggataataaatatgcttgctggtatcagcagaacgccaggccacgtcccctgtcgctgactcattacatacaanactaaccgacgccgccctcgacgggactcccgtagacgtcgtatttccctcgtcggtaccctacccgtaacgtaccgtacggggaaaccaccgacgcccgtaacctccgtacgtaacccgactaccggaccgggacccggggaacccctaggggtacccttaaagtacggggtaataacgggtaaaacgtcccgttaaggttaacctttaaggttttagttacgggttaaccggtaacgggggttggtaacggggaacctaggaaccggaaaggggtaaccgggtaaaaggggggttcggttaaaccgggggacggggtaaaccggggaccgaaacgggttcccgg

SEQ ID NO: 427720 - DNA, 622 bp, Homo sapiens
  misc_feature: GZ8MTXP02I90I1.39.20.B09.1.454.CMB.2.raw
  modified_base (249)..(249): a, c, t, g, unknown or other
  modified_base (256)..(256): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctgaaatcattagganataaatntgcttgctggtatcagcagacgccaggccacgtcccctgtcgctgactcatctaactcaaagactaccgaagcccgcctcggacgggtactcccgtagacgtcttacgttcctcgtcggacctaccgaaccgtcgtacgggaaccaccgacgccctaccttcgacgaacccacgtaccgaccgggacccgggtacccgacgggtaccttaagtagggtactacggtaaacgtccttagtaacctttagtttaaggttcgttaccggtaggggttacggtagggacctacggcgaaacgggtaaccggggttaaaggggttcgggttaccgggggacgggtaaccggggaaccgaacgggtccccgg

SEQ ID NO: 427721 - DNA, 607 bp, Homo sapiens
  misc_feature: GZ8MTXP02GI4UH.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagaataaatatgcttgctggtatcagcagaagccaggccagtcccctgtcgctgatcatctatacaagactaaccaagcccggccctcgacgggactcccgtagacgcgtacttctcgtcgcctaccaacgtcgtacgggtaaaccaccgacgaccctactactacgaaaccacgtaccgacggacccgggaacccgagggtacctaaggtagggaacttacggaaacgtcgtaacggtaactttaagtttacgtttaggtacgtaacggggttaggtacggggaaccgaggaccgaaaggtaacggtaaaagggggttcggttaccggggacggggaacgggaaccgaacggtcccgg

SEQ ID NO: 427722 - DNA, 567 bp, Homo sapiens
  misc_feature: GZ8MTXP02FZ43T.39.20.B09.1.454.CMB.2.raw
  modified_base (250)..(250): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctcaggaaatcattagganaataaatatgcttgctggtatcgagcagaacgccaggcctacgtcccctgtcgctgactcatctactacaagactaccgaagccggacctcgacgggactcccgtagacgcgtacttctcgtcggtccctaccgaacgttcgtacgggaaccacacgacctactcgcaccatcgacggccggaccctagggactacgaggtataggaaacgtctagtacttagttacttgtacggtacggttggtacgggacgtacggacgaagggtaaccggtaaagggggttcgttaccggggagggtaacggaccgaggtcccg

SEQ ID NO: 427723 - DNA, 582 bp, Homo sapiens
  misc_feature: GZ8MTXP02GBNUL.39.20.B09.1.454.CMB.2.raw
  modified_base (252)..(252): a, c, t, g, unknown or other
  modified_base (464)..(464): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtcgtccccaggacagacagccagcatccacctgctcaggaaatcattagganaataaatatgcttgctaggtatcagcaagaacgccacggccacgtcccctgtcgctgatcatctaatcaaagactaccaagcccgcctcgagggacctcccgtagacgcgtatttcctcgtccggtacctaccaacgtcgtaacgggaaaccaccgacgacccactaccacgaaacccataccgaccggccggacccgaggtacctaacggngaacgttagaaacgtctacgtaattaagttaagttccggtaggtacgggttaggagggacaggacaacgggaacggtaaaaggggtcgtacggggacggaacgggaccgaagtcccgg

SEQ ID NO: 427724 - DNA, 568 bp, Homo sapiens
  misc_feature: GZ8MTXP02GYEVW.39.20.B09.1.454.CMB.2.raw
  modified_base (251)..(251): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatcattagganaataaatatgcttgctggtatcagcaagacgccaggccacgtcccctgtcgctgatcatctaactacaagactaccgaaggccggaccctcgacgggactccccgtaggacgtcgtactttcctcgtcggtcctacccaacgtccgtacgggaacaccgacgaccctactactacgaaccataccgacggccgggaacccagggacctaagtggaactaggaaacgtcgtagtacttaagtttacgttacgtacgtagggtagtacgggacacgcgtaggaacggtaagggtcggtcggacggacggaccgagtccg

SEQ ID NO: 427725 - DNA, 641 bp, Homo sapiens
  misc_feature: GZ8MTXP02HEQWS.39.20.B09.1.454.CMB.2.raw
  modified_base (263)..(263): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggactccgtggcctcctatgagctgtctcagccacgctcagtcgtccgtcgtccccaggacagacagccagcactcacctgctctaggaatacagtaggataataaatntagtcttgcgtgtatcagcaagacgcacggcctacgtcccctgtcgctgactcactctaactacaaacgtactaaccgaacggcccgaccgtcgacgggtacctcccgagacgtacgtactttccgtcgtcggtaccctaccctaacgtccggtaacggaacaccgacgtacccacgttacgaccacctacgacgacccgggtaccggaacccgacgggtacctaagtagggaacttacggaaacgtcttaacggtactttacgtttaagttcggtaggttacggggtagggtaacggaccgtaaggacgaaaggggtaaccgggttaaagggggttcggtaccgggggacgggtaccggaacccggtaagtcccggg

SEQ ID NO: 427726 - DNA, 590 bp, Homo sapiens
  misc_feature: GZ8MTXP02JIXLV.39.20.B09.1.454.CMB.2.raw
  modified_base (242)..(242): a, c, t, g, unknown or other
  modified_base (248)..(248): a, c, t, g, unknown or other
  modified_base (357)..(357): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcacctgctcagaatanataganaataaatatgcttgctggtatcagacaagacgccgacggcctaccgtcccctgtcgctgatcatctatacaagtactaccgaacgcccgcctacggacggtcctaccgngtactctttactcctcgtacgcctaccaacgttcggtaacgaacaccgacgccctatacgtaccacgtacgaccgaacgggtcccggaccgacgggtacctaggtacggacgtaaggacgtccgttaagtacttaagtttcgtagtacggtaggtcggtaggacctaggacgtaacggggtaaggtaaacgggggttcgtacgggggacggaaacgggtaccgaagtcccggg

SEQ ID NO: 427727 - DNA, 524 bp, Homo sapiens
  misc_feature: GZ8MTXP02IPUAK.39.20.B09.1.454.CMB.2.raw
  modified_base (392)..(392): a, c, t, g, unknown or other
  modified_base (442)..(442): a, c, t, g, unknown or other
tcagtcgcactagtcacgaccggtgctcgatttagtgtagtgtgagggttgagaacctatgaacattctgtaggggcctcaggaagcagcatcggaggtgctcagccatggcatggatccctctcttcctcggcgtccttgcttactgcacaggatccgtggcctcctatgagctgtctcagccacgctcagtgtccgtgtcccccaggacagacagccagcatcacctgctctaggaaatacattaggagaataaatatgcttgctggtatcagcagaagccaggccagtcccctgtgctgatcatctatacaagactaccaagccggccctgagggactcccgtgacgcttattcctactggcctccaactcgtagggaaacaccgaacnccactcacgacatacgacggaccggaccgaggactagtagatagaaacgntacgtacttattagttgtagtaggtgtaggacgacgacgaaggaacggtaaaggggtcggtacgggacggacggaacgagcg

SEQ ID NO: 427728 - DNA, 543 bp, Homo sapiens
  misc_feature: GZ8MTXP02GSFXR.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattaggagaataaatatgcttgctggtatcagcagaagccaggccagtcccctgtgctgatcatcatcaagactacagcgcctgagggactcccgtgacgcgtagttcctcgtcggtaccctaccaacgtccgtaggggaaaccacgacgacccaacgtctacgaccactacgacggccggacccaggctacgtggaactggaaacgtctagaacttattaacgtgtacgtagggtcgtagggacagcgtaaggaacggtaaaaggggtcggttacgggacggtaacgggaccaaggtccgg

SEQ ID NO: 427729 - DNA, 617 bp, Homo sapiens
  misc_feature: GZ8MTXP02JOKYW.39.20.B09.1.454.CMB.2.raw
  modified_base (486)..(486): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcactcacctgctacgtaggaaaactacgtaattaaggagtaataaatatgtacttgcgtggtaatcgagcgaagaacgccgacggcctacggtccccctggtcgctgatccatactaactacaaagactaaccgaacgcccggaccctcggacgggtactcccgtagacgtcgtattccgctcggaccttaccgaacgttcgtacggaaacaccgaccgtacctacgtacctacgacctacgccgaacgggcccggaaaccgngggtaacctagtgaacgtacggaactcgttacgtaattacgttaacgttgacggtagggtcggtaacggagacggtacgaggaacggtaagggggtacgtcgggggacggaaccgggaacgtacggaccgg

SEQ ID NO: 427730 - DNA, 562 bp, Homo sapiens
  misc_feature: GZ8MTXP02FT90H.39.20.B09.1.454.CMB.2.raw
  modified_base (311)..(311): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctagaaatacattaggagaataaatatgcttgctggatcagcagaagccagccagtcccctgtcgctgactcatctanactaaagactaaccgaaagcccggacctacgacgggaacttcccgtagacgtcgtatttcctcgtcggtcctaccaacgtcgtaacgggaaacaccacgccactactacgacaacgtccaacggccggaacccaggctaagtggactagaaacggtctagacttaattagtttagacgtaggtgagggtacacggcgaaggaacggtaaaacggggttcggtacgggaccgggaagggaccgaagtaccgg

SEQ ID NO: 427731 - DNA, 548 bp, Homo sapiens
  misc_feature: GZ8MTXP02G7DBK.39.20.B09.1.454.CMB.2.raw
  modified_base (347)..(347): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatcattaggagaataaatatgcttgctggtatcagcagaacgccaggccagtcccctgtgctgatcatctagtacaagactacaagccggacctcgacgggctcccgngagcgattctcgtgcctaccaactcgtaggaaccacacgacccaactccgtacaacccacgtaccgacgggaccgggacccaggggtacctaagtgggaacttaggaaacggcttacgtaattatttacgtgtacgtaggtggtagggacagacgaaggaacggtaaagggtcgtacggggacggaacgggaccaaggtcg

SEQ ID NO: 427732 - DNA, 625 bp, Homo sapiens
  misc_feature: GZ8MTXP02JRJWB.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagcggccctcgacgggactcccgtgacgtcgaatttccgtcgtggcctacccgtaacctcgttacgggaacaccgacgtcccaacgtctacgaccacgtaccgacggcccgggaacccgtagggacctaagtcggaagttacggaaagtcgttacggtaactttaagttttaacgttggttacggtaacgggttcggttaagggggaccctaagggtaccgaaaggggtaaccggtaaaaagggggttccgggtttaccgggggaacgggggtaaccggggaacccggttaaaaggtaccccgggg

SEQ ID NO: 427733 - DNA, 618 bp, Homo sapiens
  misc_feature: GZ8MTXP02I7256.39.20.B09.1.454.CMB.2.raw
  modified_base (266)..(266): a, c, t, g, unknown or other
  modified_base (527)..(527): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatccacctgctacgtaggaaatacaagttaggataataaatntgtcttgcgtaggtatcgagcgaagacgccgacggcctacgtcccctgtcgctagactctatctatacaaacgtactaaccgacgtcccgcctacggacgggtacctcccgtagacgtacgtacttcctcgtcggtaccctaccgtaacgtaccggtacggaaccaccgacgaccctaacgtccgtacgaaccctagtaccgaccggacccgggtacccagggtactacgaggtactaggtaacgtcgttagtaaactttnttaagttcgtggtaggtaggtacggacacggtcgaaggtaaccgggtaagggggttccggtacggggaccggacggaacgtaacggtccgg

SEQ ID NO: 427734 - DNA, 549 bp, Homo sapiens
  misc_feature: GZ8MTXP02IXGFF.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgacttgctggtatcagcagacgccaggccagtcccctgtcgctgatcatctatcaagataaccgaagccggaccctgacgggtactccccgtagacgtcgaacttctacgtggacctccaaactccgtagggaaacctacgacgcccaactcctacgacctactaccgacggccgggaccccagggcctaacgtggatcgaagtctacgtacttactttagtcgtacgtaggttacggtagggacagccgaagcggaaagggtcgtacgggacggacggacctaggaccg

SEQ ID NO: 427735 - DNA, 609 bp, Homo sapiens
  misc_feature: GZ8MTXP02G68QA.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatacagttaggataataaatatgcttgctggtatcagacagaacgccacggccacgttcccctgtcgctgatcatactactacaaacgactaaccgacggtccgaccctgacgggtactcccgtagacgtacgtacttcgtctcggtaccctaccaacgtcgtacgggaaccacgacgtcccaactctacgaccagtacgacggcccggaccgagggtactagtaggtataggaaacgtcgtacgtaacgttattaagttcggttaccgtagggttagggtacgggaacgtaacgccggtaaacgggtaagggtaaaacgggggttgggttaaccgggggacgggaaccggaaccggaaggtacccgg

SEQ ID NO: 427736 - DNA, 672 bp, Homo sapiens
  misc_feature: GZ8MTXP02JZROK.39.20.B09.1.454.CMB.2.raw
  modified_base (250)..(250): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattagganaataaatatgcttgctggtatcagcagaagccaggccacgtcccctgtcgctgatcatctactacaagactaccaagccggccctcgacgggtactcccgtgacgtcgtactttccgtcgttcggtaccctacccgtaaaccgttcccggtaacgggggaaacccaaccgaaccggtaccccctaaccttcccgtaccggaaacccctacgtacccgaaccgggggtaccccggggaacccccgaaggggtacccttaggtacgggtaagtacgggtaaacgcgttacgtaaactttaagtttaaccgttggtaccggtaaggggtttcggtacgggggaacctacgggaccgaaggtaaccgggtaaaagggggtttcggtaccgggggaccggggtaacggggaacccgaacggtcccgg

SEQ ID NO: 427737 - DNA, 662 bp, Homo sapiens
  misc_feature: GZ8MTXP02J04XC.39.20.B09.1.454.CMB.2.raw
  modified_base (306)..(306): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatacattaggagaataaatatgacttgctggtatcagcaagaacgccaggccacgtcccctgtcnctgatcatctatacaagactaccaagccgccctgacgggactcccgtgacgcgtattctcgtcggcctacccaacgtcgtacgggaacaccgacgccctaacgtcctacggaacccacgttaccgaacgggtacccgggaaccccgtacggggtacccttaaggtaccgggtaaagttacggaaacgggtccttaacgggtaacctttaaacgtttacgtttacgggttaccggtaacgggggtttaggttacggggaaccgtaggtaaccggaacggtaaccggggttaaaaggggggttcggtttaccgggggaccggggttaaacggggaacccggttaaacggtaccccggg

SEQ ID NO: 427738 - DNA, 578 bp, Homo sapiens
  misc_feature: GZ8MTXP02HVUT5.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaatacataggagataaatatgctgctggtatcagcagaacgccgaggccacgtcccctgtcgctgatcatctatacaaacgactaaccgaagccggaccctcgacgggactcccgtgacgcgatttctcgtcgcctaccaactcgtacgggaacaccgacgccctaactccgtacgaaccctataccgaacggcccgggaacccagggtacctaagtaggacgtaggaacggtccttaggtaaacttagtttagttacggttacgtacgggtaggtcgggaacgagaccgaggaacggtaaagggggtcggttacggggacgggaacggacgaacggccgg

SEQ ID NO: 427739 - DNA, 622 bp, Homo sapiens
  misc_feature: GZ8MTXP02GXHVS.39.20.B09.1.454.CMB.2.raw
  modified_base (281)..(281): a, c, t, g, unknown or other
  modified_base (284)..(284): a, c, t, g, unknown or other
  modified_base (572)..(572): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacacgccagcactcacctgctctaggaaaatacattaggagaataaagtatgacttgctggtatnagngagaagccaggcccacgttccccctggtcgcctgactaccattcctaactacaaagactaaccgaaggcccggacccctgaacggggtaccttccccgtagacgggtacgtactttccgtccgtggtacccctacctaaccgttccgtaacgggggaaaccaccgaacggcccctaaacttcccagaaccccgataccgaccggggaccggacccgtagggaccttagacgtagttacggaacgcgttaggaacttagtttaagttcggtagtacgggtgtagggacncggagacgggaagtaaacgggggtggtacggacggacggacgaacggtcg

SEQ ID NO: 427740 - DNA, 573 bp, Homo sapiens
  misc_feature: GZ8MTXP02JD8FI.39.20.B09.1.454.CMB.2.raw
  modified_base (250)..(250): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattagganaataaatatgcttgctggtaatcagcaagaacgccaggccagtcccctgtcgctgatcatctatcaagataccaagccggaccctcgagggactcccgtagacgtcgtacttctcgtcggcctaccgaaactcgtacggaacacacgccactctacgacctactcgacgccgggacccagggtacctagtacggataggaacgtcgtagtaacttagttagttacgtacgtacgggttacggtagggtacgaacggtacgaaggaacggtaaagggggttcggttaccgggggaacggtacgggggtaacccaaggtacccgg

SEQ ID NO: 427741 - DNA, 654 bp, Homo sapiens
  misc_feature: GZ8MTXP02I770E.39.20.B09.1.454.CMB.2.raw
  modified_base (251)..(251): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcacctgctctagaaatcattagganaataaatatgcttgctggtatcagcagaacgccgaggccacgtcccctgtcgctgactcatctactacaagactaaccgaacgccggacccctgaacgggtactcccgtagacgtcttacgttctacgtcgccctacaaccgtcgtacggaaacacacgacccacgtacctacgaaccctataccggaaccgggcccggtaaaccccgagggtacctaaggtacgggtaacttaggaaacgtacgttaagtaaactttaagtttacgtttacggtacgaacggggtttacgtaacggtaaacggacccgtaaggaaccggaaaagggttaaacggggtaaaaccggggggtttcggtaaacccgggggtaccggggtaaacgggggaaaaccctaaccggggg

SEQ ID NO: 427742 - DNA, 521 bp, Homo sapiens
  misc_feature: GZ8MTXP02FH7MZ.39.20.B09.1.454.CMB.2.raw
  modified_base (329)..(329): a, c, t, g, unknown or other
  modified_base (343)..(343): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagaataaatatgcttgctggtatcagcagaagccaggccagtcccctgtgctgatcatcatcaagataccaagccgccctnacgggactcctgancgattctctggcctccaactcgtaggaacacagcccaactctcgaccatacgacggccgggaaccccagggactacgtggatggaaagcgtagtactaattacttgtacgtaggtggtagggactacgcgtaaggaacgaaagggggttcgttacggggcgggaacggaccaaggccg

SEQ ID NO: 427743 - DNA, 712 bp, Homo sapiens
  misc_feature: GZ8MTXP02F3GT4.39.20.B09.1.454.CMB.2.raw
  modified_base (252)..(252): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatcattagganaataaatatgacttgctggtatcgagacaggaacgccgaacggcccaacggtccccctgtcgcttgactcatctatacaagataccgaagcccgaccctcgaacgggctcccgtagacgacgtacttctcgtggacccttaccgaaacgttcgtaacggggaaaccacccgaacggtacccctaacctaccgtacggaaaccctaacgtaccggaaccgggaccccggggtaaaccccgaagggggtacccttaaaggtacgggtaagttaaccgggaaaggttacccttaagggttaaaccgtttaattttaaacggtttccggggttaacggtaacggggtttaggggtacgggggtaacctaacgggaaccgtaaaggggtaaccgggtaaaaggggggtttacggttacgggggaaccggggaaccgggggtaaaaccgaacgggtttaacccggg

SEQ ID NO: 427744 - DNA, 597 bp, Homo sapiens
  misc_feature: GZ8MTXP02IZ3PZ.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattaggagataaatatgcttgctggtatcagcagagccaggccagtcccctgtcgctgatcatctatcaagactaccaagccggccctgacgggactcccgtgacgtctattcctcgtcggtcctaccctaaactcgtacgggaactaccgacgccctactctacgacctacgtaccacggccgggacccgagggtaccgtagtcggaagttacggaaacgtcgttacgtaacttacgtttaagtttcggttacgtacgggttaggttacgggacgtaacggtacgaacggaacgggtaaaacgggggttcggttaccgggggacgggtaacggggtaaccgaacgggtaccgg

SEQ ID NO: 427745 - DNA, 552 bp, Homo sapiens
  misc_feature: GZ8MTXP02FR56Q.39.20.B09.1.454.CMB.2.raw
  modified_base (472)..(472): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattaggagaataaatatgcttgctggtatcagcagaagccaggccacgtcccctgtgctgatcatctatcaaagataccaagccggccctcgaggggactcccgtgacggtcgaatttcctcgtcggcctacccgaaacttccgtaaggggaaacaccgaacgcccaacgttaccagacccaagtaccgacgggcccgggaacccagggactaagtagggataggaaacgntagtaactattaattgtacgtaggtcggtaggacgagcgagaaggtaaaggggtgtacgggacggacggaccaaggtccg

SEQ ID NO: 427746 - DNA, 702 bp, Homo sapiens
  misc_feature: GZ8MTXP02IHMQE.39.20.B09.1.454.CMB.2.raw
  modified_base (260)..(260): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtcccaggacagacagccagcatcactgctcgtaggaatacagtaggataataaatntgcttgcgtggtatcgagacagaacgccgacggccctacgtcccctggtcgtctcgatcatacttaacgtaccaaaagacctaaccgaacggccccgtacccttcggaacgggtaccttccccgtaggaccgtcgtaactttcccgtacgttccggcccttaaccctacgttaccggtaacgggaaaccacgtaccgaccctaacgtcgtaaccggacctaacgtacccgggaacgggtacccgggaaccccgaacgggtacctttaggtaacgggaacgttaacgggaaccgtaaccgtttacgtaaaacgtttaagttttacggttacggtccgggtaaaggttcgggaaacggggtacgaacgaacgggtaacggaaccggggttaaaagggggtcggttacccgggggaagggaaccggggtaaccgaaggtacccgg

SEQ ID NO: 427747 - DNA, 570 bp, Homo sapiens
  misc_feature: GZ8MTXP02HWUXL.39.20.B09.1.454.CMB.2.raw
  modified_base (261)..(261): a, c, t, g, unknown or other
  modified_base (400)..(400): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgctttactgcacaggatccgtggcctcctatgagctgtctcagcccacgctcagtcgtccgtgtccccaggacagacagccagcatcacctgctctaggaatacagtaggataataaantgacttgacgtggtatcgagcagaacgccgacggcctacggtcccctgtcgctgactcatctatcaaagctaaccgagcccgcctgacgggcctccgagacgcgtactttctacgtcgctaccgacgtcgtaggaaccncgacgtccctactccacgaacctcgacgacggaccggaccaggtactagtcggattacggaacgttcgtaagtacttaagtttacgttaggtacggtggttacgggaacgacgacgacgtaggaacggtacgggggttcgtacggggaggaccggaaacgacgtacccgg

SEQ ID NO: 427748 - DNA, 568 bp, Homo sapiens
  misc_feature: GZ8MTXP02FRJ08.39.20.B09.1.454.CMB.2.raw
  modified_base (250)..(250): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtcgtccccaggacagacagccagcatcacctgctcaggaaatacatagganaataaatatgcttgctggtatcaagcaagaacgccgaggccacgtcccctgtcgctgatcatctaatacaaagataccaagccgaccctgacgggacttcccgagacgtaccgtattctcgtcgtccctaccgaacgttcgtagggaaaccacgacgcccacttaccacgaaaccacgtaccgaacgggaccgggacccagggtacctagtaggatagaacgctagtaacttattacgttgtacgtaggttggacgggtacagacgaaggaacggtaaagggggttcgtacggggacgggaacggtacgaacgtccgg

SEQ ID NO: 427749 - DNA, 719 bp, Homo sapiens
  misc_feature: GZ8MTXP02FH6LA.39.20.B09.1.454.CMB.2.raw
  modified_base (250)..(250): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatcattagganaataaatatgcttgctggtatcgagcaagacgccgaggcctacgtcccctgtgctgactcattctaatacgaaagactaaccgaacggtcccggccctcggaacgggtacctcccgtagacgtcgtacttacctcgtcggacccttaccaaaccgttcgtaacggggaaacccaccgaccgtaccctactaccgtacgaaaccctagtaccggaacccgggacccggggaacccccagggggtacccttaaagggtacggtaaacgttacgggaaaacgtccgttaacggttaaacctttaagttttaaacgtttccgggttacggtaaagggggtttcggttaaacgggggtaaccgtaaacgggacccggtaaagggggtaacccggggttaaaaagggggggtttcggttaacccggggggaccggggtaaaccgggggaaaccctaacggggtttaacccccggg

SEQ ID NO: 427750 - DNA, 590 bp, Homo sapiens
  misc_feature: GZ8MTXP02F53ZU.39.20.B09.1.454.CMB.2.raw
  modified_base (424)..(424): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatccactgctctaggaaaatcagttaggataataaatatgcttgctggtaatcagcgaagaacgccaggcccaacgtcccctgtgctgatcatctactacaaagactacgaagcccgacctcgacgggacctccgtagacgtcgtacttcgtacgtcgacctacctaacgtcgtagggaaaccacgacgtaccctactaccngaaaccctagcgacggaccggacccagggtactaggagaatggaaacgcgtaagtagtttattaagttggtacgagggtttcggaacgggtagaaccggacgtaaggaaccgggttaaaagggggtcgttacgggggacgggtacgggaaaccgacgtaacccggg

SEQ ID NO: 427751 - DNA, 636 bp, Homo sapiens
  misc_feature: GZ8MTXP02FGF2L.39.20.B09.1.454.CMB.2.raw
  modified_base (234)..(234): a, c, t, g, unknown or other
  modified_base (247)..(247): a, c, t, g, unknown or other
  modified_base (352)..(352): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctcngaatacatagganataaatatgcttgctggtatcagcagaacgccaggccacgtcccctagcgctgactcatctaatcaagactaccaagccggccctcgacgggactcccgtagacncgtacttctctcggtccctacccaactcgtacgggaaaccacgtaacgccctacttccgacgacccaacgtccgaccgggacccggggacccctaaggggaccttacggtaggaacttagggaaacgccgtaaggtaaccttaaagtttacgtttacggtaccggtaaggggttacgggttacggggaaaccaggtacccgaaagggtaaccggggtaaaaggggggttcgggttacccgggggaccggggtaaacgggggtaaaccccgaagggtaaccccgg

SEQ ID NO: 427752 - DNA, 664 bp, Homo sapiens
  misc_feature: GZ8MTXP02JW509.39.20.B09.1.454.CMB.2.raw
  modified_base (305)..(305): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacacgccagcatcacctgctctaggaaatacattaggagaataaatatgcttgctggtatcagacagaagccaggccacgtcccctgtcnctgatcatctactacaagactaaccgaagccggccctcgacgggactccccgagacgcgtacttccgtcgtcggtcctaccctacgtcgtacgggaactaccgacgccctaactccgtacgaacctacgtaccggaaccgggacccggggaaccccgagggtaacccgttagtacggggtaacgttacggaaacgttacggttacgttaaaaccgttagttttaaccggtttaggtttaacccggtaggggttacgggttaacgggacgtaacgggtacgaaacggggtaacggggtaaacgggggttacggttaccgggggacgggtaaccggggaaccggtaaacggttaccccggg

SEQ ID NO: 427753 - DNA, 565 bp, Homo sapiens
  misc_feature: GZ8MTXP02IE1FP.39.20.B09.1.454.CMB.2.raw
  modified_base (261)..(261): a, c, t, g, unknown or other
  modified_base (305)..(305): a, c, t, g, unknown or other
  modified_base (409)..(409): a, c, t, g, unknown or other
  modified_base (452)..(452): a, c, t, g, unknown or other
  modified_base (464)..(464): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatacattaggagaataaatntagcttgcttggtatcagcagaagccaggccacgtcccctgtcnctgactcatcgtatcaagactaccgaacgccggccctggacgggtactccccgtagacgcgtactttcctcctggcctacccaacgttcgacgggaacacgacncccactcacgacccagtacgacggccgggacccagggcctagnggatagaacgtntacgtacttagttacgttcgtacgtaggtaggacggacgacggtacgacgggaacgggtaaggggttcggtacggggacgggacggtaaccgaacggtccg

SEQ ID NO: 427754 - DNA, 592 bp, Homo sapiens
  misc_feature: GZ8MTXP02JLPKQ.39.20.B09.1.454.CMB.2.raw
  modified_base (251)..(251): a, c, t, g, unknown or other
  modified_base (258)..(258): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatcattagganaataaantgcttgctggtatcgagcagacgccaggccacgtcccctgtcgctgactcatctatacaagactaaccgagcccgacctcgacgggacttcccgagaacgtcgtacttccgtcgtcgtcctacccgtaacgtcgtacgggaaacaccgacgtacccactctacgaccagtaccggacggacccgggacctacgggtactaacgtcggaagtacgaacgtccgtagtaacttagtttaacgttcggttacgtaagggtcggttacgggacgaacggccgtaaggaacgggtaaaggggttcggtacggggacgggaacgggaccgtacggaccgg

SEQ ID NO: 427755 - DNA, 497 bp, Homo sapiens
  misc_feature: GZ8MTXP02FIMLB.39.20.B09.1.454.CMB.2.raw
  modified_base (250)..(250): a, c, t, g, unknown or other
  modified_base (256)..(256): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattagganataaanatgcttgctggtatcagcagaagccaggccagtcccctgtgctgatcatcatcaagataccaagccggccctcgagggactccctgagcgattctctggcctccaactctacgggaacactacgccactctagaccatcacggccgggacccagggctagtggatgaagctagactattactgtacgaggttgagggacagcgagaagaaacggggtgtcgggaggacggaccgaagtccg

SEQ ID NO: 427756 - DNA, 573 bp, Homo sapiens
  misc_feature: GZ8MTXP02H4GTX.39.20.B09.1.454.CMB.2.raw
  modified_base (125)..(125): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctntcttcctcggcgtccttgcttactgcacaggatccgtggcctcctatgagctgtctcagccacgctcagtcgtccgtgtccccaggacagacagccagcatcacctgctctaggaaatacagttaggagaataaatatgcttgcttaggtatcgagacagaacgccgaggccctaacgtccccctgtcgctagactcatactactacaaagtactaccgaagccggaccccgtcgaacgggtactcccgtagacgcgtacttctaccgtcggaccctaccgtaacgttacgacgggaaccaacgtacgaccctacgtcgtacgaccagtccgaacggaccggacccgaggtcttagagacgtagacgctagtactaattgtacgtgaggtgacggacacggacaggaaccgtaaggggtcggtacgggcggacggaaccgtagaccgg

SEQ ID NO: 427757 - DNA, 577 bp, Homo sapiens
  misc_feature: GZ8MTXP02HAP9K.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctcgtaggaaatacattaggagaataaatatgcttgctggtatcagcagagccagccagtcccctgtgctgatcatctatacaagactaaccgaagccggccctcgaacgggactccccgtagacgcgtacttcctcgtcggtaccctaccgaactcgtacgggaaacctaccgacgacccactcgtacgaacctactccgaacgggcccgggaacccgagggtacctaagtacggattaggaacgtctagtaacttatttaagtcgtacggtaggtaggtcggacgaggcgtaaggaacgggtaaaggggtcggtacgggacgggaacggaccgaggtacccgg

SEQ ID NO: 427758 - DNA, 575 bp, Homo sapiens
  misc_feature: GZ8MTXP02JTQX7.39.20.B09.1.454.CMB.2.raw
  modified_base (252)..(252): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattagganaataaatatgcttgctggtatcagcagaagccaggccacgtcccctgtgctgatcattctatacaagactaaccaagccggccctgacgggactccccgtagacgtcgtattcctcgtcggtcctacccaaacgtcgtacgggaacaccgacgcccaactctacgaccagtcgacggccgggacccgagggcctaagtcggaatcggaaacgccgtaagtacttaagtttacgttcgttaccggaaggttggtacgggacgacggcgaacggaacggtaaagggggtcgttacggggacggggaacgggaccgaaggtaccgg

SEQ ID NO: 427759 - DNA, 752 bp, Homo sapiens
  misc_feature: GZ8MTXP02H0IYR.39.20.B09.1.454.CMB.2.raw
tcagtcgcactagtcacgaccggtgctcgatttagtgtagtgtgaagggttgagaacctatgaacattctgtaggggcctcaggaagcagcatcgggaggtgcctcagccatggcatggatccctctcttcctcggcgtccttgcttactgcacaggactccgtggcctcctatgagctgtctcacgccacgctcagtcgtccgtcgcccgaggacagacacgccagcactccacctcgctacgtaaggaaactactaagtaaggaataataaatgtcgtacttgacgttaggtatacgagacgaagacgccgaaggccctaccggttccctgtacgtactagtactactactactaactaccgaaaacgtacctaaaccggaacggccccggtacctacgggtaacgggtaccttccccggaggtaaccgtcggttaacctttccgccgtcggtaacccttacccgaacggttaccgaacgggtaaacccacggtaccgaccccttaacgaccgttaaccgtaaacccgtacgtaccccgggaaccggggaccccgggtaaacccggtacgggtaaccggtttaggtacgggaaccgtagggtaaaaccgtcgtaaccggtttaaacttaagtttaccggttaggtacggttagggttacgggacggtaacgacgtaacgggaaacgggtaaggggttaaacgggggttcggggtacccgggaagggaaccggtaacccgtagggtcccgg

SEQ ID NO: 427760 - DNA, 541 bp, Homo sapiens
  misc_feature: GZ8MTXP02GZUTR.39.20.B09.1.454.CMB.2.raw
  modified_base (248)..(248): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctgaaatcattagganataaatatgcttgctggtatcagcagaagccaggccagtcccctgtgctgatcattctactacaagactaccaaggccgaccctcgacgggtactcccgagacgtcgtactttccgtcgtcggtccttaccgacgttacgacgggaacaccacgcctaactcgacgaccagtacgacggccggacccaggacctagtacggatgaacgtcgtagtacttattagtcgtagtcggttagacgggacacggcaggaacggtaagggtcggtacggacggacggaccgaggtccgg

SEQ ID NO: 427761 - DNA, 588 bp, Homo sapiens
  misc_feature: GZ8MTXP02JF3Z2.39.20.B09.1.454.CMB.2.raw
  modified_base (311)..(311): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcacgccacgctcagtcgtccgtcgtcccaggacagacagccagcactcactgctcaggaactacagttagagaattaaatatgacttgctggtatcgagcaagaacgccgaggcccacgtccccctgtcgntcgtactctatactactacaagactaaccgaacgccggccctcggacgggtactccgtagacgcgtacttcgtccgtcgtaccctacctacgtcgtaacggacaccacgcctactcgtacacctcgacgacggaccggaccgacgggtactacggttacggagttacgacgttcgtacgttactagtttagtcggttacgacgggttaggacgaccgagccgtaaggtaaccggtaaggggtacggtaccggggaggaccggaacgacggtcccggg

SEQ ID NO: 427762 - DNA, 672 bp, Homo sapiens
  misc_feature: GZ8MTXP02JS7ZK.39.20.B09.1.454.CMB.2.raw
  modified_base (260)..(260): a, c, t, g, unknown or other
  modified_base (300)..(300): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcactgctctaggaaatacattaggagaataaatntgcttgctggtatcagcaagagccaggccagtcccctgtnctgatcatctatacaaagactaaccgaacggccggaccctcggacggggacttccccgtaggacgtcgtactttccgtccgtcggtccctaacccgtaacgtaccggtacggggaaaccaccgaaccggtcccaaacgttccgtaacgaacccgtacgttacccggaacggggacccccggggaaccctacggggtaccgttaaggtacgggaacgtacggtaaacggtcgttaacgttaaccttaagttttaacgttccggtacggtagggggttacggtaaggggtaaccgacggacgaacggggtaaccgggtaaagggggttccggttacgggggaacggggtaaccgggaccggaacggttacccgg

SEQ ID NO: 427763 - DNA, 603 bp, Homo sapiens
  misc_feature: GZ8MTXP02GEUUJ.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatccacctgctcgtaggaaaatacattaggagaataaatatgtcttgctggtatcagcaagaacgccgaggcctacgtcccctagtcgctgactcatctactacaaagactaaccgaacggtcccgaccctcgacgggacctcccgtagcgtcgtacttccgtcgtcggtccctaccgaactcggtaacgggaaaccaccgacgaccctactccgtacgaaccctacgtaccggaccggacccggggaaccccgagggtaccgtaacgtacgggaactaggaaaccgtgtacgtaaacttagttacgtgtacgaggttaggaggacgagccgagaacggtaaggggtcgtacggggacggacggtaacgaggtaccgg

SEQ ID NO: 427764 - DNA, 788 bp, Homo sapiens
  misc_feature: GZ8MTXP02GE0ZS.39.20.B09.1.454.CMB.2.raw
  modified_base (272)..(272): a, c, t, g, unknown or other
  modified_base (326)..(326): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccgaggacacgacacgccagcactccacctgcctactaggaaaatactagttaaggataataaatntgtcttgcgtagtatcagacaacgacgccgacggacctacggtcccctaggtcncgtagactcgtacttactaacgtaccgtaaacgaacgtaaaccccgacgggcccccggtaccctaccggggtaacggggtacccttaccccggtacggaacgggtaccgtttacctttaccgttcccggtcgggttaacccccttacccgtaaaccgtttccggggtaaacccgggaaaacctcccggtaaaccggtacccctacccgtttaacgacccggttaaaccccaacggttacccgggaaaccggggacccccggggtaaacccgtacgggttacccgtaaacggtgggtaacgtaccggtaaagtacggtttacgttaaacgtttaccgttttaagttaccgggtacggttaaggggttcgggaaacgggaacgtaaccggaggttaacggaaaccgggggttaagggttcggggtaccgggggacggtaaaccggggaaccgtacggtacccgg

SEQ ID NO: 427765 - DNA, 617 bp, Homo sapiens
  misc_feature: GZ8MTXP02F0OHW.39.20.B09.1.454.CMB.2.raw
  modified_base (252)..(252): a, c, t, g, unknown or other
  modified_base (276)..(276): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagttgtccgtgtccccaggacagacagccagcatcacctgctctaggaaatacattagganaataaatatgcttgctgtatcagnagaacgccaggccacgtcccctgtcgctgactcatctatcaagactaccacgccggccctgacgggactcccgtagacgtcgtactttcgtacgtcggaccctaccgaaacttcggacgggtaaacccacgacgccctaactccgtacgaccataccggaacggcccggggtacccaagggtcctaacgtacgggtaactaggaaacgtcgttaagtaacctttaagtttacgttacggtacgtaggggttacggacggggtacacggacgaacgggaaccggggtaaaacgggggttcgggttacggggaccgggtaaacggggtacccaggttacccgg

SEQ ID NO: 427766 - DNA, 583 bp, Homo sapiens
  misc_feature: GZ8MTXP02HN0LD.39.20.B09.1.454.CMB.2.raw
  modified_base (251)..(251): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaatacattagganataaatatgcttgctggtatcagcagaagccaggccacgtcccctgtcgctgatcatctactcaagactaccgaagccggacctcgacgggactcccgtagacgtctattcctctggccttaccaaacgttcgtacgggaaccaccgacgacccaacttccacgacccagtccgaacggtcccggggaacccaaggggccttaagtacgggtactaggaacgtccgttagtaacttagtttacgttgtaccgtagggtaggtagggaccaggacgacggaaccgggtaaagggggtcggttacggggacgggacgggaaccgaacggtccgg

SEQ ID NO: 427767 - DNA, 572 bp, Homo sapiens
  misc_feature: GZ8MTXP02FQWO4.39.20.B09.1.454.CMB.2.raw
  modified_base (344)..(344): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattaggagataaatatgcttgctggtatcagcagaagccaggccacgtcccctgtgctgatcatctatacaagactacgaagccgcctgacggactcccgngacgcgtacttctcgtgtcctaccgaacgtcgtacgggaacacgtacgccctactcctacgaccctacgtaccgacgggacccgggacccgaagggtcctaaggtaggtacgtaggtaacgacgtacgtaacttatttaacgttcgtacgtagggtagtacgggacacggacgaacggaacgggtaaaggggtcggtacgggacgggtaacggaaccgacggtaccgg

SEQ ID NO: 427768 - DNA, 726 bp, Homo sapiens
  misc_feature: GZ8MTXP02J1XGY.39.20.B09.1.454.CMB.2.raw
  modified_base (254)..(254): a, c, t, g, unknown or other
  modified_base (477)..(477): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcacctgctcgaggaaatacagttaganaataaatatgacgttgcttaggtatcgagcgaagtaacgccgaggccctacgtcccccgtgtcgctagtactcgtactctaactacaacgtaacgtaacccgaagccccggtcccgtacggaggggtaacccttcccgagacgtccgtaactttcccgtcgttacggtaccctacccgtaacgtccggtacggaaaccaccgaccggtaccctacttacccgngaaccccgtacgtacggacggacccgggaacccaggggtacccttaagacgggtaaacgaggtaaacgccgttaacggtactttaacggtttaacgtttagggtaaccggtacgggggtttaaaggtaccgggggtaagaccggggaacccggtaaaaggggtaaaccgggggttaaaacgggggttccggttaaccgggggtaaccgggggaaaacggggttaaccccggaaacggttaccccggggg

SEQ ID NO: 427769 - DNA, 559 bp, Homo sapiens
  misc_feature: GZ8MTXP02IEBEC.39.20.B09.1.454.CMB.2.raw
  modified_base (472)..(472): a, c, t, g, unknown or other
  modified_base (515)..(515): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagcagcatcacctgctctaggaaatacagttaggataataaatatgcttgctaggtatcagacagaacgccaaggcctaaccgtcccctgtcgtctagactactactactaacgtacgaaacgtacaaaccgaacggcccggaccctggaacgggtctccccgtagtaccgcgtacttctcgtcgacctaccacgtcgtaacggacaccgacgccacgttcgacaccagtccgacggccggaacctaggcttagnggtacgagacgtcgtacgtattattacgtgtgtagtggagacngtacaggaacggtaagggtcgtacgggaggacggacacggtccg

SEQ ID NO: 427770 - DNA, 850 bp, Homo sapiens
  misc_feature: GZ8MTXP02GOTBQ.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcacctgctctaggaaatcagtaggataataaatatgtcttagctaggtactcgagacaacggaacgacccgacgggacccctacggttcccccgtgggttacggtaccgttcggtaaacttacccgtaaactttacctaaacgtaacccgtaaaaacgggtaccttaaaaccccggaaaccggggcccccggttaaccccccttacgggggtaaacggggttacccccttacccccggtgggtaaacccgtccgttaacgttttcccgtaccgttaccggggtaacccccttaccccgttaaaaccgttacccgggttaaacggggaaacccctaccgaaacccgggtccccctaaacctccgttaaacccgaacccgtaaacgtacccggaaccgggtaccccggggtaacccccgagggtaccgttaaggtacgggtaaactaacgggtaaacggcctttaaggtaaccttttaaagtttaacggttccggttaacggggtaggggttttacgggaaccggggaaaccgttacggaccgggtaaagggaaccgggtttaaaaggggggttcggggttacccgggggaaccggggtaaacggaaccggaaacggtttccccgg

SEQ ID NO: 427771 - DNA, 504 bp, Homo sapiens
  misc_feature: GZ8MTXP02FQQT4.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtccccctgtgctgatcatctatcaagataccaagccggccctgagggactccctgacgcgattctctggcctccaactcgtagggaacacgagcccactctcgaccatcgacggccggacccaggcctagtcggatgaagctagactattacgtgtcgtaggtgtacggacagcaggaacgtaaaggggtgttacgggcggacggaccaggtccg

SEQ ID NO: 427772 - DNA, 614 bp, Homo sapiens
  misc_feature: GZ8MTXP02G994K.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcactgctctaggaaatcatagagataaatatgcttgctggtatcagcagaacgccaggccacgtcccctgtcgctgactcatctatacaagactaaccgaacgccgccctcgacgggtactcccgtagacgcgtacttccgtcgtcgaccttaccgaacgttcgtacgggaaacaccgacgccctacgtccgtacgaacccgagtaccgaccggaccgggaccccagggtaccttagtacgggaatacggaaacgtccgttaagtactttaagtttacgttacggtaccggttacgggttaggtacggggtaacctaggaccgaaaggtaaccgggtaaaagggggttcgttacgggggaacggggacgggaacccgtaaaggtccgg

SEQ ID NO: 427773 - DNA, 563 bp, Homo sapiens
  misc_feature: GZ8MTXP02JZH2J.39.20.B09.1.454.CMB.2.raw
  modified_base (249)..(249): a, c, t, g, unknown or other
  modified_base (270)..(270): a, c, t, g, unknown or other
  modified_base (315)..(315): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaatacattagganataaatatgcttgctggtatnagcagaagccaggccagtcccctagtgctgatcatctactcgaanctaaccaagccggaccctcgaacgggactccccgtgacgcgtatttccctccgttcggtacctacccgaaacgttccgtacgggaaacaccgacgtccaacctctacgaacccactacgacggccgggaacccagggtacctagtcggaatcgaaagctagtaacttattaacttgtacgaggttggacgggacacgcaggtaaccggtaaaggggtcgtacggggacggacggaacccaaggacccg

SEQ ID NO: 427774 - DNA, 652 bp, Homo sapiens
  misc_feature: GZ8MTXP02JIR88.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctctatgagctgtctcagccacgctcagtcgtccgtcgtccccgaggacagacagccagcactcacctgctcgtaggaaatacaagtaggaagtaataaatatgacttgctggtatcgagcaaggacgccgacggccctacgtccccgtgtcgactcgtactctaacttctaactaccgaaagtaacctaaccggaaccgcccggtacccttcgggaacgggtactacccggtagacgtcgtacttccgtcgtacgtccctacgaacgtcgtaacggaacctacgcgaccctactacgtacgaaccgtacaccgacgggacccggaacccgacgggtactaagaccggtagtaacgtacgtcgttaagtacttaacgtttacggtacgttaggtacgggtaggttaacggggactacgggccgtaaaggggtaaccggtaagggggtccgggtacggggacgggtaccggtaacggacgtaacccggg

SEQ ID NO: 427775 - DNA, 578 bp, Homo sapiens
  misc_feature: GZ8MTXP02GAO5R.39.20.B09.1.454.CMB.2.raw
  modified_base (252)..(252): a, c, t, g, unknown or other
  modified_base (470)..(470): a, c, t, g, unknown or other
  modified_base (475)..(475): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtcgtccccaggacagacagccagcatcactgctctaggaaatacattagganaataaatatgcttgctggtatcgaagcagaacgccgacggcccacgtcccctgtcgctgactcattactactacaaacgtaactaaccgaaggcccgaccctggacggtactcccgtagcgtacttacttctcgtcgtacctaccgaactcgtaggaaaccacgacgcctactcgacaacctagtaccgacggaccgggacccacgggtacttaacgnggtanacgtacgctacgtatttattacgtgtacgtgggtacgtagggacacggacgaagtaagggtaaacggggtcggtaccgggaggtaacggtacgaacgtcccgg

SEQ ID NO: 427776 - DNA, 595 bp, Homo sapiens
  misc_feature: GZ8MTXP02HX50D.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctaggaaatacattaggagaataaatatgcttgctggtatcagcagaacgccgacggccacgtcccctgtcgctgactcattctactacaaacgtactaacccgaaggccccggtccctacgacggggtaccttacccccggtaggtacgtacggtactttcccgtcgtacggtccctacctaacgtcgaacgggtaacaccacgccactcacgaacctagtaccgacggtccgggacccagggtcctaagtggagtagaacgtaccgtacgtacttagtttaacgtggtacgtacgggttggtacggacgacgacgaggaacggtaaagggtcgtacggggacggacggaccgaaggtccg

SEQ ID NO: 427777 - DNA, 542 bp, Homo sapiens
  misc_feature: GZ8MTXP02FQ89S.39.20.B09.1.454.CMB.2.raw
  modified_base (250)..(250): a, c, t, g, unknown or other
  modified_base (258)..(258): a, c, t, g, unknown or other
  modified_base (412)..(412): a, c, t, g, unknown or other
  modified_base (458)..(458): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcacctgctcagaaatcattagganaataaatntgcttgctaggtatcgagcaagaacgccaggcctacgtcccctgtcgctagatcaagtctagtacaagataccaggccgccctgagggacctccgtagacgtcgtattcctgtcgcctacaactcgtagggacaccagccctacttcacgaccnctacgaacggcccgggaacccaggacttaagtgggatagaaccgtntagtacttagttacgtgtacgtaggtcggacggacgtacgacgaggaacggtaacgggtcggtacggacggacggacgacgtcg

SEQ ID NO: 427778 - DNA, 650 bp, Homo sapiens
  misc_feature: GZ8MTXP02GL75C.39.20.B09.1.454.CMB.2.raw
  modified_base (364)..(364): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacacgccagcactccacctgctcgtaggaaatacaagttaggaagaattaaatagtgtacttgcgttaggtatcgagacgaagaacgccgacggcccacgttcccctgtcgctgactcattctactacaagactaccgaacgcccgccngacgggactcccgtgacgtcttacttccgtacgtcgtaccctaccgtaacgttcggaacggtaaccaccgaccgtaccctacctactaccgacctacgtaccgacggacccgggacccgaggtaccgtaggtacgaagtacggaacgtctaacggttaactttacgttacgttacggttacgtaggggttacgggtacgggaccgtaggaccgtaagggtaacggggtaaacgggggtttccgggtaccgggggaccggggaacgggtaaccgaacggtacccggg

SEQ ID NO: 427779 - DNA, 803 bp, Homo sapiens
  misc_feature: GZ8MTXP02IJ3IR.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtcccaggacagacagccagcatcacctgctcgtaggaatacattagagaataaatatgtcttgcttaggtatacgacgacgaacgaacggcccgaaggtacccctaccggttaccccccgttgggtaccgtaccgttaggaacttaccgtaacgttaccttaaccgttaaccaaaacgtaacgttaaccccgaaacggtcccccgggtaccccctacgggaacggggttaaacccttacccccgtacgggtaaccgtacggtacctttttacccgtaccgtttacggaccccttaaccccgtaaaccgttaccgggttaaacccggggtaaaccaacccgttaaaccggaccccttaaccggttacccgtaaccggtaaaccccgtaacgttacccggaacccggggttacccggggaaaccccctaaggggttaccctaggtaacggtaacgtacggaacggttaccgtaggttaacctttaaagtttccgttaggtacggtaggttcgggtacggaaacgtacgtaacggacggtaaaccggggtaagggggttccggttacgggggaccggtacgggtaaaccgtacgggtacccgg

SEQ ID NO: 427780 - DNA, 568 bp, Homo sapiens
  misc_feature: GZ8MTXP02FLD7L.39.20.B09.1.454.CMB.2.raw
  modified_base (253)..(253): a, c, t, g, unknown or other
  modified_base (262)..(262): a, c, t, g, unknown or other
  modified_base (374)..(374): a, c, t, g, unknown or other
  modified_base (504)..(504): a, c, t, g, unknown or other
  modified_base (510)..(510): a, c, t, g, unknown or other
  modified_base (522)..(522): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggctccttgcttactgcacaggatccgtggcctcctatgagctgtctcagcccacgctcagtgtccgtcgtccccaggacagacagccagcatccacctgctctaggaaatcattagganaataaatangcttgctaggtatcgagcaagacgccacggcccacgtcccctgcgctagatcatctaactacaagactaccgaagcccgctcgacgggtactcccgtagcgtctacgtttcncgtacggtccctacgaaccgtcgtacgggaaacaccgaaccgccctacgtctaccggaacctaccgacgaccgggtaccgggaccctagggaccttagtcggagtagacgtctagtaactttattacgtntacggnggtggtaccgancggacagggaacggtagggttcggtacggaggaacgacgcgtacgg

SEQ ID NO: 427781 - DNA, 691 bp, Homo sapiens
  misc_feature: GZ8MTXP02GO3PN.39.20.B09.1.454.CMB.2.raw
  modified_base (557)..(557): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccggtggcctcctatgagctgtctcacgccacgctcagtcgtccgtcgtccccgaggacagacagccagcactccacctgctacgtaggaaaatacgtaagttaggaataataaatagtgtacttacggtcgtaggtactacgacgacgaacggaacgccgaacggtccctaccgttccccgtgtacgcttagtactactacttactacgaactaaacgtaactaaccggaacggtcccggtacccgtacgggtaccgggaccttacccggtagtaccgacgtttactttccgtccgtaccgggtaccctacccgtaacgtcggtaacgggaaaccacaccggaccctaacctcaaccgtaacctacgaccggaccggccggaaccgtggtaccgtagnggatacggactcgtataacgttactttacggtacgtaggtacggtacggtacgggactacggacggtaacggggtaaggggtaacgggggttcggggaaccggggacgggaaacggaccgtaaacggtcccggg

SEQ ID NO: 427782 - DNA, 660 bp, Homo sapiens
  misc_feature: GZ8MTXP02I6GYO.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcactgctctaggaaatactagttaaggagtaataaatatgcttgactggtatcgaagcaagaacgccgaggcccaacgtccccctagtcgtctagactacattctaactacgaaagacctaaccgacggaccggccctacggaacgggtaccttacccccggtaggaacgtaccggtaactttcccgtcgttacgggacccttacccgaacgttcggtaacgggaaacaccgacgtacccactccgtacgaaccactcgaacgggacccggaaccgagtaccgtaaggtaggaacgtagggaactacgttacgtaacgttaatttacggttacggtacggtacggggttggtaacgggacgacggacgaacgggtaacgggtaaagggggttcggttaccgggggacggaacggggaacccgaggttacccgg

SEQ ID NO: 427783 - DNA, 755 bp, Homo sapiens
  misc_feature: GZ8MTXP02FQ42C.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctctatgagctgtcctcagcccacggctcgagtcggtccgtcgtccccgaggacagacgcgccagcactccactgcttacgaggaatcgattaggataataaatatgtcttgacgtggtaactcgaagcgaaggacgaccgaacggcccgtacgttccccgtggtacgtcgttacgaactactaagttaccttaacgtaccgaaaacggtacttaaaccccggaacgggtcccccggtaacccttcccggggaaaacggggtacccttacccggtaagggtaccgtaccggttacgttttacccgtaccggtcggtacccctaacctaaaccgttcggtaacgggaaacctaccgaccgaccctacgtactaccgaacctacgtacggaaccggtccgggaaccgtaccgggtattaaccggaggtacgaaggtaacgtccgtaaggtttaacctttaacgttaaggttcccggtaggtaaggggttacggaacggggacctaaccggaggttaaacgaacgggggttaaacggggttacgggttaccgggggaacggttaaaccggggaaccgtacgggtttaacccgg

SEQ ID NO: 427784 - DNA, 581 bp, Homo sapiens
  misc_feature: GZ8MTXP02JU97Z.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtcgtccccaggacagacagccagcatcacctgctctaggaaatacaattaggataataaatatgcttggctggtatcgagcagaacgccaacggccacgtcccctagtcgctgactcactctactacaagactaccgaagccggcctgacgggtactcccgtgacgcgtattccgtctggtacctacccacgtcgtacggacaccgcgtaccacttcgacgtaccgactaccggacggaccgggcccaacgggtccgttaacggaggtacgttacggaaacgtcgttacgttaactagtttaacgtcgtgtaaacggtggtacggacaggaccgaaggaaccggtaaggggtcggtacgggacggacggacccgaggtccg

SEQ ID NO: 427785 - DNA, 615 bp, Homo sapiens
  misc_feature: GZ8MTXP02FPOI9.39.20.B09.1.454.CMB.2.raw
  modified_base (249)..(249): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatcattagganataaatatgcttgctggtatcagcagaacgccagccagtcccctgtcgctgatcatctatacaaagactaaccgaaggccggacccctcgacgggactccccgtagacgtcgtattccctcgtcggcccttacccgaactcgtacggggaaacaccgaacgccctactacgcgaacccactaccgacgggacccgggaaccccgaggggtaccttaggtcgggtaatacggtaaacgcccgttagtaactttaaggtttatttacggtaggtagggtacgggttagggtaacgacggacgtaaccggaacgggtaaagggggttcggttacgggggacggggaacgggaacccgaaggtacccggg

SEQ ID NO: 427786 - DNA, 684 bp, Homo sapiens
  misc_feature: GZ8MTXP02JLA3M.39.20.B09.1.454.CMB.2.raw
  modified_base (252)..(252): a, c, t, g, unknown or other
  modified_base (262)..(262): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcacgccacgctcagtcgtccgtcgtccccgaggacagacagccagcatcactgctctagaatacagtaaganaataaatatntcgttgcgtaggtactacgagacgaagacgccgacggtaccctacgtcccctggtcgtctagtacttcaacttctaaacctacgaaacgtaactaaccgaacgccgtaccctagggacggtacctccgtagtacgtacttaacgttcctacgtccgtacctaaccgtaacgtacggtaaacggaaacctaccgaccgtaccctacgtaccgtaacgaaccgtacgtaccggaacgggacccggaacccgtagggtaacctaaggtaggaacgtaggaaacgtccgttaagtaactttaaaggtttcctagggtccggtaaaggggttacggtacggaccaacgggacgaaacgggtaacgggggtaaacggggttccgggtaacgggggacgggtaaaccggaccggtaaggttaaccccgg

SEQ ID NO: 427787 - DNA, 606 bp, Homo sapiens
  misc_feature: GZ8MTXP02F5I5M.39.20.B09.1.454.CMB.2.raw
  modified_base (249)..(249): a, c, t, g, unknown or other
  modified_base (258)..(258): a, c, t, g, unknown or other
  modified_base (270)..(270): a, c, t, g, unknown or other
  modified_base (397)..(397): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagcccacgctctagtgtccgtcgtccccaggacagacagccagcatcacctgctcagaaatcataganataaatatnctgctgtatcancaagacgccaggccacgtcccctgtcgctagatcagtctactacgaagactaacgaacgccgcctgacggctaccgtgacgtcgtacttccgtcgtacggtccctacctaacgtcgtaaggaaaccncgaccgacctactcacgacctacgtaccgacgggtaccggacccagggtacctagtaggtaacgtagtaaacgcgttagtaaacttagtttaaagttcggtaaagtaacggggttaggttaaacgggaccaagggcccgtaaagggtaacgggttaaacgggggtcggttaccggggaacggggtaacggaaccggtaaacggtcccgg

SEQ ID NO: 427788 - DNA, 596 bp, Homo sapiens
  misc_feature: GZ8MTXP02FV2WR.39.20.B09.1.454.CMB.2.raw
  modified_base (305)..(305): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtcgtccccaggacagacagccagcatcacctgctctaggaaatacagttaggagtaataaatatgcttgctggtatcagcagagccaggccacgtcccctggtcnctgactcatctactacaacgataaccgaagcccgaccctgagggactcccgtagacgtcttatctcgtcgtcctaccaactcgtacggaaccacgacgacccactctacgaaccagtacgaacgggcccggaaccctagggacctaggtacggtaagtacggaaacgtccgttagtaactttaaagtttacgttacggtaccgtaggggttaggtacggggaaccaggtaacgacgggaacggtaaacgggggttcggtacgggacggggtacggaaccgacggtacccgg

SEQ ID NO: 427789 - DNA, 611 bp, Homo sapiens
  misc_feature: GZ8MTXP02JZJIM.39.20.B09.1.454.CMB.2.raw
  modified_base (251)..(251): a, c, t, g, unknown or other
  modified_base (259)..(259): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtcgtccccaggacagacagccagcatcacctgctcaggaaatacatagganaataaatntgcttgctggtatcagcaagaacgccaggccacgtcccctgtcgctgactcatctactacaagactaaccgacggccggacctcgacgggactcccgagacgcgtacttcgtcgtcggtccctaccgtaacgtcgtacggaactaccgacgaccctacgtcgtacgaccacgtaccgacgggaccggaccgacggtcgtaagtcggaacgtagtaaacgtcgttaagtaacttaagtttacgtagggttacggtacggggtagggttacggaacgtacggaccgtaaggggtaaccggtaaacgggggttccggtacgggggacgggaaccgggtaccgaacggtacccggg

SEQ ID NO: 427790 - DNA, 591 bp, Homo sapiens
  misc_feature: GZ8MTXP02GG0HS.39.20.B09.1.454.CMB.2.raw
  modified_base (251)..(251): a, c, t, g, unknown or other
  modified_base (260)..(260): a, c, t, g, unknown or other
  modified_base (275)..(275): a, c, t, g, unknown or other
  modified_base (444)..(444): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagttcgtccgtcgtccccaggacagacagccagcatccactgctcagaaatcatagganaataaatangtcttgctgtatcancgagaacgcacggcctacggtcccctagtcgcttagactacattctaactacaagaactaacaacggcccgacccgtcgaacgggtactaccccgtagacgtcgtactttctacgtcgtacctaccaacgtcgtacggaaacacgacgcctaactctacgacccgtaanaccgacggccggaacgagactacgagacgtacgacgtcgtaatacttattacgttagtacggtaggtacggacggacgacgacggtaaacgggaaacgggtaacggggtacggtaccgggggaacggaacggtaaccgaacggtcgg

SEQ ID NO: 427791 - DNA, 677 bp, Homo sapiens
  misc_feature: GZ8MTXP02HJB63.39.20.B09.1.454.CMB.2.raw
  modified_base (125)..(125): a, c, t, g, unknown or other
  modified_base (252)..(252): a, c, t, g, unknown or other
  modified_base (260)..(260): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctntcttcctcggcgtccttgcttactgcacaggatccgtggcctcctatcgagctgtcctcgagccacgctcagtcgtccgtgtcccaggacagacagccagcactcactgctctaggaatcagtaganataaatangcttgctaggtactacgacgactaggaaacgcccgaacggacccgtacggttccccctgggtacgtaccgtagacttactaagttaccgtaaatacccgaaagtacctaaaccgtaaggtccccggaccctacgggacggtaaccttcccgtacgaacgtacgttaccttccgtacgtttacggaccccttaccaaacggtttacgtaacggggaaccctacgaccgacctaaccgttctaacgtaccgtaacgtaccgaccgggtacgggaaccccagggacttacggaggttaacaccgggatacggtaacttacgtagtttaatcggtgtaaacgggtggaacggttaccgaagccgttaaacggaacggtaaggggtccggtacgggaaccgggtagaccggtacgttaccgg

SEQ ID NO: 427792 - DNA, 609 bp, Homo sapiens
  misc_feature: GZ8MTXP02FQEKG.39.20.B09.1.454.CMB.2.raw
  modified_base (366)..(366): a, c, t, g, unknown or other
  modified_base (445)..(445): a, c, t, g, unknown or other
  modified_base (477)..(477): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatccacctgctcgtaggaaatacagttaaggagaattaaatatgtcttgcgtggtatcagcaagaacgccgaggccctacggtcccctgtcgactgactacagttacactacaacgtaactaaccgaacggtcccggtcccncggtacgggtacttcccgagacgtcgtattccgtcgtcgacctaccgaacgtcgtacggaacacgacgcctactcgtanaccgactcgacggaccgaccgtaggacctagnggaatcggaactcgtaagtacttagtttagtacgttacggaggttcggtaggacgaacgtccggaaaggtaacgggtaaaacgggggtttcggtaaccgggggacggtaaaccggaaccgtacggtacccgg

SEQ ID NO: 427793 - DNA, 684 bp, Homo sapiens
  misc_feature: GZ8MTXP02FIXHS.39.20.B09.1.454.CMB.2.raw
  modified_base (125)..(125): a, c, t, g, unknown or other
  modified_base (234)..(234): a, c, t, g, unknown or other
  modified_base (254)..(254): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctntattcctcggcgtccttgcttactgcacaggatccgtggcctctatgagctgtctcagccacgctcagtgtccgtcgtccccaggacagacagccagcatcacctgctngaaatcattagagaataatntagcttgcctggtactcgagcagaacgccgaaggccacgtcccctgtcgaccgtgactctactctaactaccgaaagtacgtaccgaacgtcccggcccttcgaacggggcttccccgtagacgtacgtactttcctacgtcggtacccttaccctaacgttaccgttaacggggaaaccaccgtaaccgtaccctacgtaccgtacgttaaccccgacgttacccgaccgggtacccggggtaaccccgtacgggtaccgttaacgtacgggtaacgtaacggtaacggtaccgtacggttaacttacgtttaaacttcggttaaccgtagggttacgttacggggaccgtacggaaccgtacggtaacggtaaacgggggttacggttaccgggggacggtaacgggtacccgtaacggttacccggg

SEQ ID NO: 427794 - DNA, 616 bp, Homo sapiens
  misc_feature: GZ8MTXP02FICEZ.39.20.B09.1.454.CMB.2.raw
  modified_base (246)..(246): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtgcctctatgagctgtctcagccacgctcagtgtccgtcgtccccaggacagacagccagcatcactgctcgagaaatcataganaataaatatgtcttgctggtatcgagacgaagacgaccgacggaccaccgttcccctgacgtcgttaagatactaacgttacctaactaaccgaaaacgtaacctaaacccggaacggtcccccgtacccgtacggaacgggtaccttaccggtacggacgtaccgttacttccgtcgtaccgacctaccgtaacgtcggtaaacgaaccacgtacgacctacgtaccacgtaccagtacgaccggacccggacagtacgtagtacgagacgtacgcttaagtaacttagttctacggtgtaggtggtacgacacggcgtaaaggaacgggtaaggggttcggaccgggaggtaacgacgtacgtacccg

SEQ ID NO: 427795 - DNA, 643 bp, Homo sapiens
  misc_feature: GZ8MTXP02GZWW5.39.20.B09.1.454.CMB.2.raw
  modified_base (257)..(257): a, c, t, g, unknown or other
  modified_base (493)..(493): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcactgctctagaatacattaggaagataaatntagcttagctggtatcagtcaagacgccgtacggcctacgtcccctagtcgctgactcctatcctaataccgaagtaactaccgaaacgcccggtaccctcggaacgggtactaccccgtagaccgtacgtactttccgaccgtcggacccttacccgaacgttacggtacgggaaccaccgtacgaccctacgttacaaccggtaaccacgtaccggaacggcccgggaacccgnggaaccgttaccgaggacgtaacggtaacgtacgtaacgttaccgtaacgtttaagttcggtacggtaacggttgggaacggtacaacggtaccgaaggtaacggtaaaacggggtgtacccgggacggtaaccggaccgaacggtcccg

SEQ ID NO: 427796 - DNA, 598 bp, Homo sapiens
  misc_feature: GZ8MTXP02HWMLP.39.20.B09.1.454.CMB.2.raw
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatccacctgctctaggaaatacagttaggagtaataaatatgcttgactggtatcagacagaacgccaggccctacgtcccctgtcgctagatcatactaactacaaagactaaccgaagccgaccctcgagggacctccgtgacgccgtattcctacgtcggacctaccctaactcgtacggaacaccgacgcccaccgttcgacaacccatccgacgggtaccggacccgtaaggccgtaaggtacggagtacgaacggtcttaggtaacctttattagtttcgacggtaagggtggtacgggacgacgtaccgaagggtaaccggtaaaagggggtcggtaccggggacggggaacggtaccgaaggtccgg

SEQ ID NO: 427797 - DNA, 578 bp, Homo sapiens
  misc_feature: GZ8MTXP02FNQID.39.20.B09.1.454.CMB.2.raw
  modified_base (270)..(270): a, c, t, g, unknown or other
  modified_base (334)..(334): a, c, t, g, unknown or other
  modified_base (376)..(376): a, c, t, g, unknown or other
  modified_base (386)..(386): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaatcattagagataaatatgcttgctgtatcagnagaagccagccacgtcccctgtgctgatcatctactcagatacaagcgcctcaggactcctgancggggatctctggctccactctgggaacacagcccacttacncgtaacctanacacggaccgggacccgaggggtacccttagacggacgttaggaaacgtcctagggtaccgtaatttacgttagttaccgtaaaggggttgttacggggtacccgaaaggtcccgtaaggaacggtaaaaaccgggggttggtttacggggtacccggggtaacggggaacccggaacgggtttaacccggg

SEQ ID NO: 427798 - DNA, 654 bp, Homo sapiens
  misc_feature: GZ8MTXP02FLPWF.39.20.B09.1.454.CMB.2.raw
  modified_base (260)..(260): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctattcctcggcgtccttgcttactgcacaggatccgtggcctcctatgagctgtctcagccacgctcagtcgtccgtgtcccaggacagacagccagcatcacctgctctaggaaatacagttagagaataaatntgtctgcgtgtatcagcaagacgccgaggcctacgtcccctgtcgctagactctaactctaactacaacgactaaccgaacgcccggacccgtcgacggactacccgagacgtcgtacttccgtcgtcgtacctacccgtaacgtcgtacggacctaccgacacccgacttacccgtacgaccctacgaccgggaccggtacccggggacccgaggtactacggtaggtactaaggtaacccgtgttaacgttaacgtttaagtttacggttagggttaaccgggtaggggttaacgggggttacgggaacgttaccggagtaaccggggtaaacggggtacggggttacgggggtaccggggacggggtaaccgggtaacgaacggttcccgg

SEQ ID NO: 427799 - DNA, 628 bp, Homo sapiens
  misc_feature: GZ8MTXP02FZ14R.39.20.B09.1.454.CMB.2.raw
  modified_base (234)..(234): a, c, t, g, unknown or other
  modified_base (248)..(248): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcactgctngaaatcattagganataaatatgcttgctggtatacgagacaagaacgccacggccctacgttccccgtgtcgtcctagatacgactactaatccaaagactaaccgacgcccggaccctcggacggactcccgtagacgtcgtacttccgtcgtagtccctacctaactcggtaagggaaccaccgacgaccctactacgtccgaacccgtcgtacccgacgggaccccggaccgtacgggtactacgtacggtactagaacgtccttaagttaacttaacgttttagttacggtacgttaacggggtggttacgggacgtacggtacgacggtaacggtaaacgggggttcggttacgggggacggggaacggtaccgtaacgggtacccgg

SEQ ID NO: 427800 - DNA, 570 bp, Homo sapiens
  misc_feature: GZ8MTXP02H3D0M.39.20.B09.1.454.CMB.2.raw
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcactgctctaggaaatacagttaggagaataaatatgcttgctaggtatcagcagaacgccaggccacgtcccctgtcgctgatcatctactacaagtactaccagccggcctcgaggtactcccgtagcgtcgacttctacgtcggcctaccacgtcgtacggaacaccgacgcctaccgctacgacctacgtacgacggcccgggaacccagggtcctaaagtcgacgtaggaaacgtccgtagtacttaagtttacgtcgtacgagggttcgtagggtacacggtcgaacggaacgggtaaggggtcgttacggggaccggaacggtaccgaacgtcccgg

SEQ ID NO: 427801 - DNA, 535 bp, Homo sapiens
  misc_feature: GZ8MTXP02J3OKC.39.20.B09.1.454.CMB.2.raw
  modified_base (252)..(252): a, c, t, g, unknown or other
  modified_base (259)..(259): a, c, t, g, unknown or other
  modified_base (350)..(350): a, c, t, g, unknown or other
  modified_base (365)..(365): a, c, t, g, unknown or other
  modified_base (382)..(382): a, c, t, g, unknown or other
  modified_base (407)..(407): a, c, t, g, unknown or other
  modified_base (414)..(414): a, c, t, g, unknown or other
  modified_base (431)..(431): a, c, t, g, unknown or other
  modified_base (474)..(474): a, c, t, g, unknown or other
  modified_base (494)..(494): a, c, t, g, unknown or other
  modified_base (500)..(500): a, c, t, g, unknown or other
  modified_base (509)..(509): a, c, t, g, unknown or other
tcagtcgcactagtcacgaccggtgctcgatttagtgtagtgtgagggttgagaacctatgaacattctgtagggcctcaggaagcagcatcggaggtgcctcagccatggcaatggatccctctcttcctcggcgtccttgcttactgcacaggatccgtgcctcctatgagctgtctcagccacgctcagttcgtccgtgtccccaggaccagacagcctagcatcacctgctctagaatacagttaganataaatntgcttgctagtactcagacagaagccaggcccacgttccccagtcgctagactacctattcgtactacaacgtacaaccgagccgtacccngacgggtacttccgngacgcgtactcgttacncggtcctaccgaacgtcgacggacncgtaacncccaacgttcagaccanccgaagcccggtaacacgggttactgtacggatagacggtacngtactatttcgagtgaggtnaggacngttccaggngtttaacgggcgcggcgacgcagtcg

SEQ ID NO: 427802 - DNA, 609 bp, Homo sapiens
  misc_feature: GZ8MTXP02GVPBB.39.20.B09.1.454.CMB.2.raw
  modified_base (252)..(252): a, c, t, g, unknown or other
  modified_base (302)..(302): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcacgccacgctcgagtcgtccgtcgtcccgaggacagacagccagcatcacctgctctagaatacataganataatatgcttgctagtatcagcaagacgccgacgccacgtccctgtacnctagactcatactactacaaacgactaaccgaacggcccgacctcggacgggtactcccgtagacggtctacgttcctcgtacggtcctaccgtaacgtacggtaacggaaacaccgacgtaccctacgtccgtacgaaccacgtccgaaccggggaccggaacccagggtacctaaggtacgagtacgacgtctacgtaacttagtttagttcgtaggtacggtaggtacggacgtaacggacgtaaacgggtaacgggtaaagggggttcggtacggggacggaaacggtaccgtaacggtccgg

SEQ ID NO: 427803 - DNA, 650 bp, Homo sapiens
  misc_feature: GZ8MTXP02HSXYQ.39.20.B09.1.454.CMB.2.raw
  modified_base (252)..(252): a, c, t, g, unknown or other
  modified_base (259)..(259): a, c, t, g, unknown or other
  modified_base (393)..(393): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcactcacctgctctaggaatacataggaanataaatntagcttgctggtatcgagtacagaacgcctacggcccacgttccccctaggtcgacgtgactactaactcttaacacgtaaacgaacttaaccaacggcccggtacccctcggaagggggtaccttaccccggngtacgtaccgtacctttccgtccgtcgtaccctaccgtaacgtacggtaaccgaaaccaccgtaccgtacccaccgttaccgtacgacccgtacgtccggacgggtacccggaaccgtaggtaccgtaagtcggtaatacggtaacgtacgtagttaacgttatttacgttacggtacggtaagtcgggtacggacgacgacggagggtaacgggtaacgggggtacggtcgggaacggtaccggtacgtacggtcg

SEQ ID NO: 427804 - DNA, 562 bp, Homo sapiens
  misc_feature: GZ8MTXP02FF83D.39.20.B09.1.454.CMB.2.raw
  modified_base (233)..(233): a, c, t, g, unknown or other
  modified_base (244)..(244): a, c, t, g, unknown or other
  modified_base (295)..(295): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcactgctngaatcataganataatatgcttgctggtatcagcagaagcagccagtcccctgtgctgactnatctactacaagactaccaagccgacctcgacgggactccgtgacgtcgtacttctacgtcggtacctacccgaactcgtacgggaacaccgacgaccctctactacgaccactacgacggaccgggaaccagggtactaacgtggaacgttcggaacgtctacggtacttaattacgttcgtacggtagggtcggtacgggacacggacgaaggtaacggtaaacgggggtcggtacgggaccggggaacggaccgtacgtaccgg

SEQ ID NO: 427805 - DNA, 660 bp, Homo sapiens
  misc_feature: GZ8MTXP02F966M.39.20.B09.1.454.CMB.2.raw
  modified_base (451)..(451): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtgcctcctatgagctgtcctcagccacgctcagtcgtccgtcgtccccaggacagacagccagcatcacctgctacgtaggaaactcagttaggaataataaatatgtcttgcgttaggtataccgagtcaagacgaccgacgcctacgtcccctgctctacgtatcgatcgtaactacgaacacgtaacccacggccccgtaccgtacgtaccgggactacccggttagacggtactaccgtttccgttacgtccgtacccgtacctaaccgtcggtaccggaaacccncgtaccgaccgtactaccgaaccaccgtaccgtaccggacccggaccggtacccgaacggtacgtacggtagtaacgtacggtaacgtacgttaacgttacgtttagttaacgtttaggtacggtacgggtaggtacggaacgacggaccgtaaggggtaacgggtacggggtacggtaccgggacgggtaaccggtacgtaacggtcg

SEQ ID NO: 427806 - DNA, 593 bp, Homo sapiens
  misc_feature: GZ8MTXP02HWGFP.39.20.B09.1.454.CMB.2.raw
  modified_base (259)..(259): a, c, t, g, unknown or other
  modified_base (275)..(275): a, c, t, g, unknown or other
  modified_base (316)..(316): a, c, t, g, unknown or other
  modified_base (399)..(399): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtcccccaggacagacagccagcatcacctgctctaggaatacattaggagaataaatntgacttgctaggtatnagacagacgccaggccacgtcccctgtgctagatcatctanacaagactaccgaagccgccctgagggactcccgtagacgccgtattccctacgtcgcctaccgtaacgtccgtgggaaaccncgtaccgacctacttacgcgtaccataccgacgggccgggaacccgacggtaccgtagtacggagttacgaacgtctacgtacgttaatttagtagttacggtacggttaggtacgggtaacgagtacgacggtaacgtaacggggggttacggttacgggggaaccggggtacgggaaccgtaacggtaccgg

SEQ ID NO: 427807 - DNA, 558 bp, Homo sapiens
  misc_feature: GZ8MTXP02JVN1R.39.20.B09.1.454.CMB.2.raw
  modified_base (252)..(252): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctaggaaatacattagganaataaatatgcttgctggtatcagcagacgccaggccacgtcccctgtcgctgatcatctactacaagtactaccgaagccgcctcgagggactcccgtgacgcgtacttctcgtcggcctaccaacgtcgtacgggaacacgacgcccacgtcacgaccagtacgacggccgggacccagggtacctagtaggactagaacgtctagtacttagttacgttcgtacgtagggtacgtacggacgacgacgtaaggaacggtaaacgggggttcggtaccgggacggtacggaaccgacgtaccgg

SEQ ID NO: 427808 - DNA, 677 bp, Homo sapiens
  misc_feature: GZ8MTXP02I0ZY6.39.20.B09.1.454.CMB.2.raw
  modified_base (260)..(260): a, c, t, g, unknown or other
  modified_base (269)..(269): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccagctcagtcgtccgtgtccccaggacagacagccagcatccactgctctaggaaatacattaggagaataaatntgtcttagntggtatcagcagaacgccaaggcctaacgtcccctgtcgctagtactcattacctatacaagtaactaccgaacgcccggaccctcggaacgggtacctcccgtagtaccgtcttacgttcctcgtcggtaccctacccgtaaacgtacgtacggaaaccaccgacgtaccctactctacgaacctacttacccggacggcccgggtaaccccgtagggtacctacggtacggtaacgtggtaaacgtcgttaacgtatttaacgtttaacgtttacggtacggttacggggttaggttacgggtaaccgaaggttaccggaaagggtaaacccggggttaaaagggggttcgggttaaccgggggaacgggggaaccgggttaaacccggaaaacgggtttacccgg

SEQ ID NO: 427809 - DNA, 701 bp, Homo sapiens
  misc_feature: GZ8MTXP02GXGX7.39.20.B09.1.454.CMB.2.raw
  modified_base (384)..(384): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgttccttgcttactgcacaggactccgtggcctcctatgagctgtctcacgccacgctcagtcgtccgtcgtcccgaggacagacagccagcactccactgctacgtaggaaactactaagttaggaagtaattaaagtatgtctttgacgttggtatcgagacgaagaacgccgacggcctaccgtccctggtacgctgactactatactaactacgaaactactaacccgaacggcccggtacccncggacggtacctcccggtagtacgtcgtacgttccgtcgtcgtaccctaccgtaacgtcggtaacggaaacctccgacgtaccctaaccgtaccgtaccgtaaaccgtacgccgggaacccgggaccccggtaccgtacgggtaccgtaaggttaacggaagtaaggtacggtacttaagtttacgtttaacggttagtttaccgggtacggtacggggttaggtacggaacggtcgaaacggtaaacggggtaacggggttaacgggggttaccggggtaccgggacgggaacccggttacggaacggttacccgg

SEQ ID NO: 427810 - DNA, 694 bp, Homo sapiens
  misc_feature: GZ8MTXP02JOZ1A.39.20.B09.1.454.CMB.2.raw
  modified_base (479)..(479): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcgcgtccttgcttactgcacaggatccgtggcctcctatgagtctgtctcacgccacgctcagtcgtccgtcgtccccaggacagacacgccagcactccacctgctacgtagaatacaagttaggataataaatagtgtctgcgttggtactcgagcaaacggacgaccgacggcctaccgttcccgtagcgtctacgacttcctatacttaacctacaaacgtacctaaccgaacggcccggtaccctcggaacgggtccctccgagacggtctacttccgtcgtacgtaccctacaccgtcggtaaccggacacccgtacgacccctactccgtaaccgtaccngttaccgaccgggtacccggactacgggtactacggtggtaactagggtaactgttaaaccggttactttaagtttaccggtaggttaaccggtagggggttacggtacgggaaacgttacggaacccgggaggggttaaaaccgggggtacgggggtttacggggtaaacgggggaccgggttaaaccgggaaccggtacgggttaacccccgg

SEQ ID NO: 427811 - DNA, 560 bp, Homo sapiens
  misc_feature: GZ8MTXP02FL5GS.39.20.B09.1.454.CMB.2.raw
  modified_base (250)..(250): a, c, t, g, unknown or other
  modified_base (258)..(258): a, c, t, g, unknown or other
  modified_base (420)..(420): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtctcagccacgctcagtcgtccgtgtccccaggacagacagccagcatcacctgctctagaaatcatagganaataaatntgtcttgctggtatcagacaagaacgccaggccacgtcccctagtgctagatcattctaatacaaagtactaaccgaacggcccgaccctcggaagggtacctacccgtagacctacgtacttccgtacgtcgtaccctactaaacgtcgtacgggaaaccncgacgacctactactcgaacctagtccgacggaccggaccaggtactagtggatagagtctagtacttattacgtgtagaggtcgtaggactagcgaaggtaaggtaacgggttcggacggaggtaacggacgacgtccg

SEQ ID NO: 427812 - DNA, 652 bp, Homo sapiens
  misc_feature: GZ8MTXP02IQT7L.39.20.B09.1.454.CMB.2.raw
  modified_base (124)..(124): a, c, t, g, unknown or other
  modified_base (597)..(597): a, c, t, g, unknown or other
  modified_base (605)..(605): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatcctntcttcctcgcgtccttgcttactgcacaggatccgtggcctcctatgagctgtctcagccacgctcagtcgtccgtgtccccaggacagacagccaagcatcactgctctagaaatcattaggagtaataaatatgtcttgactggtatcagcaagaacgccaaggccacgtcccctgtgctgactcaatctaactcgaaagtactaacccgaaacggtccggacccttacgacgggtactaccccggtagacgggccttaactttccgtccgtcggtacccttaccctaaaacgtccgttaagggggaaaccctaaccgaaccgaccctaaaccgttccgtaacccggttaaacccaaacgttccgaaaaccggggcccgggaaacccctaacgggtctaaacggtcggtacgtacggtaaactcctaaagtacgttactttaacgtggtacgtaacggtggtaaccggganaccggtanacggaacgggtaaacgggtgtacggggcggaggaaccgttacgacgg

SEQ ID NO: 427813 - DNA, 634 bp, Homo sapiens
  misc_feature: GZ8MTXP02FP3J7.39.20.B09.1.454.CMB.2.raw
  modified_base (235)..(235): a, c, t, g, unknown or other
  modified_base (251)..(251): a, c, t, g, unknown or other
  modified_base (259)..(259): a, c, t, g, unknown or other
  modified_base (319)..(319): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtgcctctatgagctgtctcagccacgctcagtgtcccgtcgtccccaggacagacacgccagcatcactgcctnaggaaatcattagganataaagtntgtcttgactggtactacgagtccgaagaacgccaacggccctacgttcccccgtaggcncgttagaactcacgtctaactacaacgtactaacccgacgcccgacccttgaccggtactcccgtgaacgctagttcctacgtcgtacctaccgtaactccgtagggaacaccgacgtaccctacttacgacgaacctacgaccggaccggaccggacccgtaggaccttacggaggtaacacggtactacggtattaactttagtacggttacggtacggtacgggtaggaaccgtacggaacggtacggtaacgggtaacggggtaacgggttaccgggtacggggaaccggaacggaaccgtacggtaccgg

SEQ ID NO: 427814 - DNA, 642 bp, Homo sapiens
  misc_feature: GZ8MTXP02GOYKH.39.20.B09.1.454.CMB.2.raw
  modified_base (253)..(253): a, c, t, g, unknown or other
  modified_base (258)..(258): a, c, t, g, unknown or other
tcagtcgcactagtcacgaccggtgctcgatttagtgtagtgtgagggttgagaacctatgaacattctgtaggggcctcaggaagcagcatcggaggtgcctcagccatggcatggatccctctcttcctcggcgtccttgcttactgcacaggatccgtgcctctatgagctgtctcagccacgctcagtcgtccgtcgtccccaggacagacacgccagcatcactgctcgagaatcataggatataatntcgtnttgcgtaggtactcgagcgtaaggacgccgacggtcctaaccggttcccctaggttcgtctagtactactacttacgtaactacgaaacgtaaccgtaaccgaacggtccccggtaacccgtcgggtaaccgggacccttaccggacggtacgacgttactttccgtacgtccggtaccctaccgtaaactccggtaacggaaccacgtccgaccctacgtacacgaccgtacgaccggacgggtaccccggaaccgtagggtaccgtagtacggactaggtaaactgtaacgtattacgttacgtagtcggtaggtcggacgacgtacggacgacgggaaggtaacggggttcggaccggggaagacgggtaccacggtccgg

SEQ ID NO: 427815 - DNA, 654 bp, Homo sapiens
  misc_feature: GZ8MTXP02IZ5TF.39.20.B09.1.454.CMB.2.raw
  modified_base (181)..(181): a, c, t, g, unknown or other
  modified_base (237)..(237): a, c, t, g, unknown or other
tcagtcgcactagtcacgaccggtgctcgatttagtgtagtgtgaagggttgagaacctatgaacattctgtaggggcctcaggaagcagcatcggaggtgcctcagccatggcatggatccctctcttcctcggcgtccttgcttactgcacaggatccgtggcctcctatgagctgtcncacgccacgctcgagtcgtccggtcgtaccccgaggacagacacgaccagcactcnctagctacgtaggaaatacgagttaggaataataaatatgtcgttgcgtaggtactcaagacgaagaacgacccgacggcctacggtcccctggtatcgtgtactactatactaactacaaacgtaactaaccgaacggtccgtaccctaggacgtacgtccgtacgaacgtcgtacttcgccgtacgtaccctaccgtaaccgtaggtacccggaaatacccgacgtaccctactacgacgtaacccacggtacgacggggtaccggtacccaagggtcctaaggtcggtaatcgggaaatcgtaacggttattacgtttagtccggttagaccgggtaggtacgaccgtagggaccgtaggggtaaaacccggttagggtaccgggtacgggacggaaccggacgtaacgtcggg

SEQ ID NO: 427816 - DNA, 485 bp, Homo sapiens
  misc_feature: GZ8MTXP01BH8P5.44.3.A03.1.454.CMB.2.raw
  modified_base (196)..(196): a, c, t, g, unknown or other
  modified_base (262)..(262): a, c, t, g, unknown or other
  modified_base (432)..(432): a, c, t, g, unknown or other
  modified_base (451)..(451): a, c, t, g, unknown or other
  modified_base (483)..(483): a, c, t, g, unknown or other
tcagacagtatatacacgaccggtgctcgatttagagagcgtcacagggggaggaactgctcagttaggacccagacggaaccatggaagccccagcgcagcttctcttcctcctgctactctggctcccagacaccactggagaaatagtgatgacgcagtctccagccaccctgtctctgtctccaggggaaangcccaccctctcctgcagggccagtcagagtgttggcagcagcgtagcctggtccagcagaaaccnggccagactcccaggctcctcatctataccacatccacagggccactggtatcccagccagattccagtgcactggtctgggcagagttcactctcaccatcagcagcctgcagtctagagtatttgctagtttatacgtgtcagctagtatagtgactgtcctcgttcncttcggccttgggaccagngtcgatttcaaacgtaactgtggctgctaacntc

SEQ ID NO: 427817 - DNA, 542 bp, Homo sapiens
  misc_feature: GZ8MTXP01DIOCZ.44.3.A03.1.454.CMB.2.raw
  modified_base (198)..(198): a, c, t, g, unknown or other
  modified_base (263)..(263): a, c, t, g, unknown or other
  modified_base (284)..(284): a, c, t, g, unknown or other
  modified_base (417)..(417): a, c, t, g, unknown or other
  modified_base (539)..(539): a, c, t, g, unknown or other
tcagacagtatatacacgaccggtgctcgatttagagagcgtcacaggggggaggaactgctcagttaggacccagacggaaccatggaagccccagcgcagcttctcttcctcctgctactctggctcccagacaccactggagaaatagtgatgacgcagtctccagccaccctgtctctgtctccgaggggaaangccaccctctcctgcagggccagtcagagtgttggcagcagcgtagcctggttccagcagaaccnggccagactccaggcctcctnatctataccacactcccaccgagggcccacgttcggactccccagccagacttcccgaggttcggcacgtggggtacctaggggcagtagttccactcctcaccatcagcacgcctgacagttctagtaagtntttgcttagtttattactgtcagtctagttatagtgacgttcggtccttccgttctacgtttcggcccgttggggacccagtacgttcgttactttcaaacgtaactgtcgctgctaacttntcg

SEQ ID NO: 427818 - DNA, 553 bp, Homo sapiens
  misc_feature: GZ8MTXP01ANVJZ.44.3.A03.1.454.CMB.2.raw
  modified_base (197)..(197): a, c, t, g, unknown or other
  modified_base (261)..(261): a, c, t, g, unknown or other
  modified_base (283)..(283): a, c, t, g, unknown or other
  modified_base (289)..(289): a, c, t, g, unknown or other
  modified_base (294)..(294): a, c, t, g, unknown or other
  modified_base (401)..(401): a, c, t, g, unknown or other
tcagacagtatatacacgaccggtgctcgatttagagagcgtcacagggggaggaactgctcagttaggacccagacggaaccatggaagccccagcgcagcttctcttcctcctgctactctggctcccagacaccactggagaaatagtgatgacgcagtctccagccaccctgtctctgtctccgaggggaaangccaccctctcctgcagggccagtcagagtgttggcagcagcgtagcctggtccagcagaaccnggccagacctcccaggctcctnatctanaccanactccaccagggccagtggtactcccagccagtcttccaggtggcacgtggggtactggggaacagacgttcactctcaccatcagcagcctgcagtctagaacgtntttgctagttttatacgtgtcagctagtatagtgtacgtcggtcccttcggttctaccgtttccggcccgttgggaacccttacgtacgttcgttaacgttttccgaaaacggtaactggttaacggcctacggacctaaccgttaattccg

SEQ ID NO: 427819 - DNA, 588 bp, Homo sapiens
  misc_feature: GZ8MTXP01AF9L6.44.3.A03.1.454.CMB.2.raw
  modified_base (199)..(199): a, c, t, g, unknown or other
  modified_base (263)..(263): a, c, t, g, unknown or other
  modified_base (573)..(573): a, c, t, g, unknown or other
  modified_base (582)..(582): a, c, t, g, unknown or other
tcagacagtatatacacgaccggtgctcgatttagagagcgtcacaggggggaggaactgctcagttaggacccagacggaaccatggaagccccagcgcagcttctcttcctcctgctactctggctcccagacaccactggagaaatagtgatgacgcagtctccagcccaccctgtctctgtctccgaggggaaancgccaccctctcctgcgagggccagtcagagtgtggcagcagcgtagcctggtccagcagaacnggacagacctccgaggctcctcatctactaccacactcccaaccgacgggcctacgtcggtacctcccgagcccagtacttccgaggtcggctacggtgggtcgtagggaactaggtacgttcactctacactatcagcacgtcctgctacgtctagtaagtcgtttgacttaagttttactacggttcgtacgagtacgtaggttataggtcgtaccgttcggtaccctttccggttcctaccggtttcccgggacccgttggggacccttacgtacgttacgttacgtttacgaaacgtctggcgtcngacctaacncgttcg

SEQ ID NO: 427820 - DNA, 582 bp, Homo sapiens
  misc_feature: GZ8MTXP01EOI80.44.3.A03.1.454.CMB.2.raw
  modified_base (197)..(197): a, c, t, g, unknown or other
  modified_base (262)..(262): a, c, t, g, unknown or other
tcagacagtatatacacgaccggtgctcgatttagagagcgtcacagggggaggaactgctcagttaggacccagacggaaccatggaagccccagcgcagcttctcttcctcctgctactctggctcccagacaccactggagaaatagtgatgacgcagtctccagccaccctgtctctgtctccgaggggaaangcccaccctctcctgcagggccagtcagagtgttggcagcagcgtagcctggtccagcagaaccnggccagacctccaggcctcctcatctactaccacactcccaaccagggcccacgtggtacctccccgaagcccagtacttccgaggtcgacctacggtggggtactaggggaactaggtacgttccacttccacgacctatcagcagcctgctagtctagtacgtatttgcttaagtttattacggtgtcagtcgtaagtacgtagttcgacgttcggtccttccgttctcgtttccgggcccgttgggacccttacgtcgttcgttaacgtttcgaaacgttcgtacggttcgaccgtcgacctaaccttaagtttccg

SEQ ID NO: 427821 - DNA, 563 bp, Homo sapiens
  misc_feature: GZ8MTXP01A3GCR.44.3.A03.1.454.CMB.2.raw
  modified_base (196)..(196): a, c, t, g, unknown or other
  modified_base (260)..(260): a, c, t, g, unknown or other
tcagacagtatatacacgaccggtgctcgatttagagagcgtcacagggggaggaactgctcagttaggacccagacggaaccatggaagccccagcgcagcttctcttcctcctgctactctggctcccagacaccactggagaaatagtgatgacgcagtctccagccaccctgtctctgtctccaggggaaangccacctctcctgcagggccagtcagagtgttggcagcagcgtagcctggtccagcagaaaccnggccagactcccaggctcctcatctactaccacatcccacgagggccactggtactcacagccagtacttcgagtggcacgtgggtctgggacagacgttcactctcaccatcagcagcctgaccagtctagtaagtcttttgacttagtttattacgtgttcagtctagtatagtgacttcggcctttccgttcgtaaccgttttccgggccccgttaggggaccctacgtaacggttcccgttaattttaccgaaaaccggtaaccttcgggtgggtccttcggtaaccttcccgttaacg

SEQ ID NO: 427822 - DNA, 565 bp, Homo sapiens
  misc_feature: GZ8MTXP01DIZRB.44.3.A03.1.454.CMB.2.raw
  modified_base (199)..(199): a, c, t, g, unknown or other
  modified_base (263)..(263): a, c, t, g, unknown or other
  modified_base (272)..(272): a, c, t, g, unknown or other
  modified_base (281)..(281): a, c, t, g, unknown or other
  modified_base (287)..(287): a, c, t, g, unknown or other
  modified_base (293)..(293): a, c, t, g, unknown or other
  modified_base (393)..(393): a, c, t, g, unknown or other
  modified_base (395)..(395): a, c, t, g, unknown or other
  modified_base (400)..(400): a, c, t, g, unknown or other
  modified_base (411)..(411): a, c, t, g, unknown or other
  modified_base (428)..(428): a, c, t, g, unknown or other
tcagacagtatatacacgaccggtgctcgatttagagagcgtcacaggggggaggaactgctcagttaggacccagacggaaccatggaagccccagcgcagcttctcttcctcctgctactctggctcccagacaccactggagaaatagtgatgacgcagtctccagccaccctgtctctgtctccgagggggaaancgccaccctctcctgcagggccagtcagagtgtgcagcagcgtagctggtccagcaagaaaccnggccagacnccagctccnatctanacccanactccacgagggccaacgtggtaactcccagcccagtacttcccaggtggctaccggtgggtactgggaacagtagttcactctacaccatcagcagtcngnacgtntagagtatttntatatttattacttgtntagatagtatagtagtactcgtccgttccgttaccgttccgtttccggtcccgttacggtaccgacctaacgttacgttactttacgttaaacgtaaccgtagtcgggttcgtacgttacaaccgttaaccgtttcg

SEQ ID NO: 427823 - DNA, 615 bp, Homo sapiens
  misc_feature: GZ8MTXP01AK6XQ.44.3.A03.1.454.CMB.2.raw
  modified_base (196)..(196): a, c, t, g, unknown or other
  modified_base (261)..(261): a, c, t, g, unknown or other
  modified_base (419)..(419): a, c, t, g, unknown or other
  modified_base (466)..(466): a, c, t, g, unknown or other
tcagacagtatatacacgaccggtgctcgatttagagagcgtcacagggggaggaactgctcagttaggacccagacggaaccatggaagccccagcgcagcttctcttcctcctgctactctggctcccagacaccactggagaaatagtgatgacgcagtctccagccacctgtctctgtctccgaggggaaanagccaccctctcctgcagggccagtcagagtgttggcagcagcgtagcctggtccagcagaaccnggccagacctcccaggcctcctcactcctactacccacactcccaccgagggccactcggtactcccgagccagtacttccgagtggctacgtggggtactgggcaggtacgtcacgtctacacctatcagtcacgcctgctacgtcgtagtaagttntttacgcttaagttttactacgttggttaccgagtccgtaaaggttntacggtactaccgttcgggtcccctttccggttccttacccgggttttcccgggcccgttcgggggaaaccccttccggtaggttacccgttaacgtttaccgaaaccgtaacgttggtcgggtactcggaccctaaccgttctttccg

SEQ ID NO: 427824 - DNA, 577 bp, Homo sapiens
  misc_feature: GZ8MTXP01DRX4E.44.3.A03.1.454.CMB.2.raw
  modified_base (197)..(197): a, c, t, g, unknown or other
  modified_base (258)..(258): a, c, t, g, unknown or other
tcagacagtatatacacgaccggtgctcgatttagagagcgtcacagggggaggaactgctcagttaggacccagacggaaccatggaagccccagcgcagcttctcttcctcctgctactctggctcccagacaccactggagaaatagtgatgacgcagtctccagccaccctgtctctgtctccgaggggaaangccaccctctcctgcagggccagtcagagtgttgcagcagcgtagcctggtcagcagaacnggcagactccaggctctcatctataccacactcccaccacgggccacgtggtactccccagccagacttccaggtgcacgtgggtcgtgggaacagtacgttccactcctcacatcagcagcctgctagtctagaagtactttgacttagtttattacgtgtacagtactagttactaggtagtaccgttcggtccctttcccggtttcctaccggttttcccggcccgttcggggaacccttacgtaacgtccggttaattttaccgaaaaccgtaacgttacggtcgggtcttacggacctaaccgttaactttccg

SEQ ID NO: 427825 - DNA, 547 bp, Homo sapiens
  misc_feature: GZ8MTXP01ADJC2.44.3.A03.1.454.CMB.2.raw
  modified_base (199)..(199): a, c, t, g, unknown or other
  modified_base (261)..(261): a, c, t, g, unknown or other
  modified_base (275)..(275): a, c, t, g, unknown or other
  modified_base (402)..(402): a, c, t, g, unknown or other
tcagacagtatatacacgaccggtgctcgatttagagagcgtcacaggggggaggaactgctcagttaggacccagacggaaccatggaagccccagcgcagcttctcttcctcctgctactctggctcccagacaccactggagaaatagtgatgacgcagtctccagccaccctgtctctgtctccgaaggggaaancgccaccctctcctgcagggccagtcagagtgtggcagcagcgtagcctggtcagcagaacngcagctccagctcnatcataccacactccacgagggccactggtactcccagccagtacttccaggtcggctacgtggggtacctggggcagtacgtttccactctcaacctatcagcagcctgactagtctagtaagttntttgacttagtttattcggtgtacagtacgtagttatagtcgtacgtcggtccttccgttctccgtttccggcccgttagggaccttacgtacgttacgttactttaccgaaacgtaatcggtcggctagccctaacttgttccg

SEQ ID NO: 427826 - DNA, 600 bp, Homo sapiens
  misc_feature: GZ8MTXP01BVP6M.44.3.A03.1.454.CMB.2.raw
  modified_base (197)..(197): a, c, t, g, unknown or other
  modified_base (260)..(260): a, c, t, g, unknown or other
  modified_base (277)..(277): a, c, t, g, unknown or other
  modified_base (419)..(419): a, c, t, g, unknown or other
tcagacagtatatacacgaccggtgctcgatttagagagcgtcacagggggaggaactgctcagttaggacccagacggaaccatggaagccccagcgcagcttctcttcctcctgctactctggctcccagacaccactggagaaatagtgatgacgcagtctccagccaccctgtctctgtctccgaggggaaancgcccaccctctcctgcagggccagtcagagtgtggcagcagcgtagcctggtcagcagaacngcagactccaggctccnatctataccacactcccaccgacgggcccacgtcggtactccccgagccagtacttccaggtcggactacgtggggtactgggaaccaggtacgttccgactcgtacaccatccagcacgtcctgctagtctagtaacgttntttgacttagtttattacgttgtacgtagtctaagttataggtcgtaacgttcggtacccgttccgttccttaccggtttccggccccgttggggacccttacgttacggttccgttaacgtttaccgaaaccggtaacgtcgggttcggtactcggttaccctaaccgttaagtttcccg

SEQ ID NO: 427827 - DNA, 540 bp, Homo sapiens
  misc_feature: GZ8MTXP02HDABA.44.3.A03.1.454.CMB.2.raw
  modified_base (196)..(196): a, c, t, g, unknown or other
tcagacagtatatacacgaccggtgctcgatttagagagcgtcacagggggaggaactgctcagttaggacccagacggaaccatggaagccccagcgcagcttctcttcctcctgctactctggctcccagacaccactggagaaatagtgatgacgcagtctccagccaccctgtctctgtctccaggggaaangccaccctctcctgcagggccagtcagagtgttggcagcagcgtagcctggtccagcagaacctggccagacctcccaggcctcctcatctatacccacatcccaccagggccacgtggtactccccagcccagattccagtggcacgtgggtcctggggcagtacgttccactctcaccatcagccagcctgcagtctgaagtatttgcttagtttattactgtactagctagtatagtgacgtggccttccgttctaccgtttccggccctgggtaccctacgtacggtccgtactttacgaaaaccgtaacgtcggtacggctacgacctaccgtattccg

SEQ ID NO: 427828 - DNA, 536 bp, Homo sapiens
  misc_feature: GZ8MTXP02I09VF.44.3.A03.1.454.CMB.2.raw
  modified_base (196)..(196): a, c, t, g, unknown or other
  modified_base (280)..(280): a, c, t, g, unknown or other
  modified_base (291)..(291): a, c, t, g, unknown or other
  modified_base (324)..(324): a, c, t, g, unknown or other
tcagacagtatatacacgaccggtgctcgatttagagagcgtcacagggggaggaactgctcagttaggacccagacggaaccatggaagccccagcgcagcttctcttcctcctgctactctggctcccagacaccactggagaaatagtgatgacgcagtctccagccaccctgtctctgtctccaggggaaangccaccctctcctgcagggccagtcagagtgttggcagcagcgtagcctggttccagcagaacctggccagactccaggctccncatcataccanactccacagggccactggtactccccagccagnttccagtgcacgtgggtcctgggcagacgttcacttctcaccatcagcagctgcagtctagaatatttgctagtttattactgttcagtctagtattagtgacgtcggccttccgtttcaccgttttcgggcccgttaggggacccctagtacggttccgtaagtttccaaaacggtaacgtcggttacggcttaggacctaccctattccg

SEQ ID NO: 427829 - DNA, 538 bp, Homo sapiens
  misc_feature: GZ8MTXP02JLRRL.44.3.A03.1.454.CMB.2.raw
  modified_base (197)..(197): a, c, t, g, unknown or other
  modified_base (266)..(266): a, c, t, g, unknown or other
  modified_base (275)..(275): a, c, t, g, unknown or other
  modified_base (397)..(397): a, c, t, g, unknown or other
tcagacagtatatacacgaccggtgctcgatttagagagcgtcacagggggaggaactgctcagttaggacccagacggaaccatggaagccccagcgcagcttctcttcctcctgctactctggctcccagacaccactggagaaatagtgatgacgcagtctccagccaccctgtctctgtctccgaggggaaangccacctctcctgcagggccagtcagagtgttggcagcagcgtagctggtccagcagaactggcagacnccagctccncatctataccacactccaccgacgggccacgtggtactcacagccagacttcgagtcgctagtgggtctggggacaggtacgttccacgtctcaccagtcagcacgcctgcagtctgtaatntttgacttagtttattactgtactagtactagtatagtgtactggtcccttcgtcttaccgtttccggcccgtcgggacctacgtacgtaccgtaacgtttacgaaaccgtaacgtcggtacggtctacgactaccgtacg

SEQ ID NO: 427830 - DNA, 525 bp, Homo sapiens
  misc_feature: GZ8MTXP02GV5LG.44.3.A03.1.454.CMB.2.raw
  modified_base (197)..(197): a, c, t, g, unknown or other
  modified_base (278)..(278): a, c, t, g, unknown or other
  modified_base (288)..(288): a, c, t, g, unknown or other
  modified_base (392)..(392): a, c, t, g, unknown or other
tcagacagtatatacacgaccggtgctcgatttagagagcgtcacagggggaggaactgctcagttaggacccagacggaaccatggaagccccagcgcagcttctcttcctcctgctactctggctcccagacaccactggagaaatagtgatgacgcagtctccagccaccctgtctctgtctccgaggggaaangccacctctcctgcagggccagtcagagtgttggcagcagcgtagcctggtccagcagaacctggccagactccagctccnatcataccanactccacaggccacgtggtactcccagccagattcccagtcgctacgtggggtctggggacagacgttcacgtctcaccatcagcagcctgcagtctagaagtntttgcttagtttattactgtacagtctagtatagtgtactggtccttcgttacaccgtttcggcccgttgggacccagtacgtcgtactttaccgaaacgtaacgtggtacggtactcggacctactacttcg

SEQ ID NO: 427831 - DNA, 513 bp, Homo sapiens
  misc_feature: GZ8MTXP02IQ79M.44.3.A03.1.454.CMB.2.raw
  modified_base (194)..(194): a, c, t, g, unknown or other
  modified_base (342)..(342): a, c, t, g, unknown or other
  modified_base (353)..(353): a, c, t, g, unknown or other
  modified_base (357)..(358): a, c, t, g, unknown or other
  modified_base (360)..(360): a, c, t, g, unknown or other
  modified_base (365)..(365): a, c, t, g, unknown or other
  modified_base (367)..(367): a, c, t, g, unknown or other
  modified_base (370)..(370): a, c, t, g, unknown or other
  modified_base (404)..(404): a, c, t, g, unknown or other
tcagacagtatatacacgaccggtgctcgatttagagagcgtcacagggggaggaactgctcagttaggacccagacggaaccatggaagcccagcgcagcttctcttcctcctgctactctggctccagacaccactggagaaatagtgatgacgcagtctccagccaccctgtctctgtctccgaggggaanagccaccctctcctgcaggccagtcagagtgttggcagcagcgtagcctggtccagcagaacctggccagctccagctcctcatctataccacactccacaggccacgtggtatccccagccagcttcagtgcacgtgggtctgggcnggtctcactcncacnncngcacncngcngtcagtattattgacttatttattgtgtcacgtnaagtatagtcgtacgtcggtccttcgttctacgttccggccgtacggacctacgtacgttacgtacttaacgaaacgtaacgtgtacgtcgtagacctacgtactttcg

SEQ ID NO: 427832 - DNA, 620 bp, Homo sapiens
  misc_feature: GZ8MTXP02IT3LH.44.3.A03.1.454.CMB.2.raw
  modified_base (197)..(197): a, c, t, g, unknown or other
tcagacagtatatacacgaccggtgctcgatttagagagcgtcacagggggaggaactgctcagttaggacccagacggaaccatggaagccccagcgcagcttctcttcctcctgctactctggctcccagacaccactggagaaatagtgatgacgcagtctccagccaccctgtctctgtctccgaggggaaangccaccctctcctgcagggccagtcagagtgttggcagcagcgtagcctggtccagcagaacctggccagacctcccaggcctcctcatctactaccacactacccaccgagggccacgtggtactcccagccagtacttccagtgcacgtggggtcctggggacagtacgttcaccgttctacacctatacagccacgcctcgacgtacgtcctagtaaagttacttttacggactttaaaggtttactttaacgtcggttacaaggtcgtaaggttattacggtacggttacgtcgggtaccctttccggtttacctaccggttttccggtacccggttacgggtaccctaacgtacggttacgtacgtttaaccgaaacgttaaccgtggtacgtccgttacgacctacctacgttaccg

SEQ ID NO: 427833 - DNA, 606 bp, Homo sapiens
  misc_feature: GZ8MTXP02FLWVV.44.3.A03.1.454.CMB.2.raw
  modified_base (197)..(197): a, c, t, g, unknown or other
  modified_base (286)..(286): a, c, t, g, unknown or other
tcagacagtatatacacgaccggtgctcgatttagagagcgtcacagggggaggaactgctcagttaggacccagacggaaccatggaagccccagcgcagcttctcttcctcctgctactctggctcccagacaccactggagaaatagtgatgacgcagtctccagccaccctgtctctgtctccgaggggaaangccaccctctcctgcagggccagtcagagtgttggcagcagcgtagcctggttccagcaagaaacctggccagactcccaggcctcctnatctataccacactccaccgagggcccacgtggtactcccagccaagtacttcccgagtggcacgtgggtcgtggggacaggtacgttcactctacaccatcagccagcctgctagtcgtagtaaagttattttgactttaagtttacttacgtcgtacacggtactaagttagtaggtagtacgttcgggtaccctttccgtttacgtaacccgttttccgggaccccgtttacggggaaccctaaccggtaggttaccgttaaactttaaccgaaaaccgtaacgttggtacggtacttacgacctacctactttccg

SEQ ID NO: 427834 - DNA, 600 bp, Homo sapiens
  misc_feature: GZ8MTXP02I0W5N.44.3.A03.1.454.CMB.2.raw
  modified_base (197)..(197): a, c, t, g, unknown or other
  modified_base (473)..(473): a, c, t, g, unknown or other
tcagacagtatatacacgaccggtgctcgatttagagagcgtcacagggggaggaactgctcagttaggacccagacggaaccatggaagccccagcgcagcttctcttcctcctgctactctggctcccagacaccactggagaaatagtgatgacgcagtctccagccaccctgtctctgtctccgaggggaaangccaccctctcctgcagggccagtcagagtgttggcagcagcgtagcctggtccagcagaacctggccagactccgaggctcctcatctataccacactcccgaccgagggccctacgtcggtactccccgaagcccaagtacttcccgaggtcggcctaacggttcggggtccgtggggaccgtagtacggtttccaaccttcctaccacctatcgagccacgcctggctagtcctagtaagttacttttgacttaagtttattacgtgtcagtntagtatgtcgtacgtcggcccttccggttctaccgtttccgggcccttcggggaccctaacgtacgtaccgttaactttaaccgaaaacgtaacgtggttacggtctacggtaccacctagtttccg

SEQ ID NO: 427835 - DNA, 596 bp, Homo sapiens
  misc_feature: GZ8MTXP02HJ6TW.44.3.A03.1.454.CMB.2.raw
  modified_base (197)..(197): a, c, t, g, unknown or other
tcagacagtatatacacgaccggtgctcgatttagagagcgtcacagggggaggaactgctcagttaggacccagacggaaccatggaagccccagcgcagcttctcttcctcctgctactctggctcccagacaccactggagaaatagtgatgacgcagtctccagccaccctgtctctgtctccgaggggaaancgccaccctctcctgcagggccagtcagagtgttggcagcagcgtagcctggtccagcagaacctggaccagacctcccaggcctcctacatctactaccacactcccacgacggccacgtcggtactcccagacccagtacttccaggtcgctacggttgggtcgtaggggactagtacgttaccaccttcctacacctatcgagccacgcctgcctaggtctagtaagttatttgacgtttagtttattaccgtgttacagtactagttagtacggttacgacgttcggtacccttccgttcttaccgtttccggtacccgttcgggaccctacgtacgttacgtaactttaccgaaacgtaaccgttggaccgtactacgtccaccgttatttccg

SEQ ID NO: 427836 - DNA, 544 bp, Homo sapiens
  misc_feature: GZ8MTXP02FLFZQ.44.3.A03.1.454.CMB.2.raw
  modified_base (199)..(199): a, c, t, g, unknown or other
  modified_base (266)..(266): a, c, t, g, unknown or other
  modified_base (284)..(284): a, c, t, g, unknown or other
  modified_base (290)..(290): a, c, t, g, unknown or other
  modified_base (397)..(397): a, c, t, g, unknown or other
  modified_base (402)..(402): a, c, t, g, unknown or other
  modified_base (417)..(417): a, c, t, g, unknown or other
  modified_base (443)..(443): a, c, t, g, unknown or other
  modified_base (460)..(460): a, c, t, g, unknown or other
tcagacagtatatacacgaccggtgctcgatttagagagcgtcacagggggaggaactgctcagttaggacccagacggaaccatggaagccccagcgcagcttctcttcctcctgctactctggctcccagacaccactggagaaatagtgatgacgcagtctccagcccaccctgtctctgtctccgaaggggaaanacgcccaccctctcctgcagggccagtcagaggtgttggcagcagcgtagcctggtccagcagaacnggcagacctccagctccnatctanaccacactccgacgacggccatcggactcccagccagtctccgagtcgactaggtcggggtacctggggacctagtacgtttcaccttcacccaacatccaagccanccgtnctagtctagaagttntttcgactttagtttactagtgtacngtacgtagtatagggtntacgttcgtccttcgtctaccgttcgcgacggacacgtagtctaacttacgaaacgtcgtcggacgtccgatacctacgtctcg

SEQ ID NO: 427837 - DNA, 499 bp, Homo sapiens
  misc_feature: GZ8MTXP01DH08W.9.50.E06.1.454.CMB.2.raw
  modified_base (203)..(203): a, c, t, g, unknown or other
tcagtgatacgtctcacgaccggtgctcgatttagatctactgacaacacacaaggggaggaactgctcagttaggacccagagggaaccatggaagccccagctcagcttctcttcctcctgctactctggctcccagattccaccggagaagttgtgttgacacagtctccagccaccctgtctttgtctccaggggaaangccacctctcctgcagggccagtcagagtctaggagctccttagcctggtatcaacagaaacctggccaggctcccaggctcctcatctatgatgcatccaacagggccatggcatcccagccaggttccagtggcagtgggtctgggcagacttcactctcaccatcagcagactagagcctgaagtatttgctagtttattactgggtctagcagcgtagcaactggcctcggacgttcggccgaagggaccaaagtggacatcaagcgaactgtaggctgcactaattcgtcg

SEQ ID NO: 427838 - DNA, 580 bp, Homo sapiens
  misc_feature: GZ8MTXP01AOSS4.9.50.E06.1.454.CMB.2.raw
  modified_base (205)..(205): a, c, t, g, unknown or other
  modified_base (410)..(410): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaangcccaccctctcctgcagggccagtcagagtcttaggagctccttagcctggtatcaacagaacctggccaggcctcccaggctcctcatctatgatgcatcccaaagcgggcccacgtggcatccccagcccaggttccaggtggcaggtgggtctggggaacagacttcactctcacatcagcagactagagtcctagaagtntttgactagtttattactggtcagcaggtcgtagctaacgtcggtcctcggggaccgttccgggaccgaaacggggaacccgttaaaggtacgggaaaccgtaagtaccgaaaggccgttaaaccgttgggtacgggccgttacggaccaacccgtaagttcccgttcgg

SEQ ID NO: 427839 - DNA, 516 bp, Homo sapiens
  misc_feature: GZ8MTXP01D3BUH.9.50.E06.1.454.CMB.2.raw
  modified_base (204)..(204): a, c, t, g, unknown or other
  modified_base (397)..(397): a, c, t, g, unknown or other
  modified_base (505)..(505): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccacctctcctgcagggcccagtcagagtcttaggagctccttagccctggtatcaacagaaacctggccaggctccagctcctcatctatgatgcatacccaaacacgggccaacgtggcatccccagcccaggttccaggtggcaggtggtctgggcagacttcactctcacatcagcagactagacgntgaagtatttgctagtttatactggtctaaggctagcgtagcaacgtcggcctcggacgttcggcgaacgggaacgttaaagcggaagagtacagcgacgtgtgcgcncactgttcgtg

SEQ ID NO: 427840 - DNA, 546 bp, Homo sapiens
  misc_feature: GZ8MTXP01ER65A.9.50.E06.1.454.CMB.2.raw
  modified_base (204)..(204): a, c, t, g, unknown or other
  modified_base (241)..(241): a, c, t, g, unknown or other
  modified_base (310)..(310): a, c, t, g, unknown or other
  modified_base (401)..(401): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgctccgaggggaaangccacctctcctgcagggccagtcagagtcttagganctccttagcctggtatcaacagaaacctggccaggctcccaggctcctcatctatgatgcatccaaacngggccacgtggccatcccagccaggttccaggtgcagtgggtactgggcagacttcactctcacatcagcagactagacgtactagaagtntttgacttagtttattactgggtactagcagcgtagctaacgtcggccgtacgggtaccgttcggaacccgaaagggaaacccgaaaggtcggaaaccagtaacgaaaggcgaaacgtggtcgaacgtcgaccactaattcgtcg

SEQ ID NO: 427841 - DNA, 511 bp, Homo sapiens
  misc_feature: GZ8MTXP01DVN2V.9.50.E06.1.454.CMB.2.raw
  modified_base (204)..(204): a, c, t, g, unknown or other
  modified_base (242)..(242): a, c, t, g, unknown or other
  modified_base (290)..(290): a, c, t, g, unknown or other
  modified_base (310)..(310): a, c, t, g, unknown or other
  modified_base (352)..(352): a, c, t, g, unknown or other
  modified_base (357)..(357): a, c, t, g, unknown or other
  modified_base (369)..(369): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgctccgaggggaaangccaccctctcctgcagggccagtcagagtcttagganctccttagcctggtatcaacagaacctggccaggctcccaggctcctnatctatgatgcatccaaacngggccacgtggcatcccagccaggttccaggtgcagtggtcngggcngtacttcactcncacatcagcagactagagacctagaagtatttgactagtttattactggtcagcagcgtagcaacgtggcctcgggacgttcggccgaaagggacaaaggtggacagtcaagttcgaacgtgtaggctgcactaattcgtcg

SEQ ID NO: 427842 - DNA, 497 bp, Homo sapiens
  misc_feature: GZ8MTXP01B67SK.9.50.E06.1.454.CMB.2.raw
  modified_base (203)..(203): a, c, t, g, unknown or other
  modified_base (241)..(241): a, c, t, g, unknown or other
  modified_base (289)..(289): a, c, t, g, unknown or other
  modified_base (308)..(308): a, c, t, g, unknown or other
  modified_base (393)..(393): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccacctgtctttgtctccaggggaaanagccaccctctcctgcagggccagtcagagtcttaggngctccttagcctggtatcaacagaaacctggccaggctccagctcctnatctatgatgcatccaaangggccatggcatcccagccaggttccagtggcagtgggtctgggcagacttcactctcacatcagcagactagagcctagaagtntttgctagtttattactggtcagcagctagcaatcggcctcggacgttcggcaaggggacaaaggtcggactagcaagcaacgtgtggctgcacctaattcctg

SEQ ID NO: 427843 - DNA, 645 bp, Homo sapiens
  misc_feature: GZ8MTXP01AVA72.9.50.E06.1.454.CMB.2.raw
  modified_base (205)..(205): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaangccaccctctcctgcagggccagtcagagtcttaggagctcttagcctggtatcaacagaaacctggccaggcctcccgaggcctcctcatctatgatgacactacccaacgcggggcccacgtggaccactccccgaaggcccgtaagggtttccccgaggttgggacgtaggggttcggggtaccgtagggggaacctaggtaccctttccaaccttcctaccacctatccagacaagactaggacgtaccgtagtaagttattttgacttaagttttacttacgtggtacgaggtacacggtcgtagaccgtaacggtcgggtccccgtacggggtaccggttccgggaacccggtaaacggggaacccttaaagggtcggaacacgtaacgaacggcgttaaccgtggtcggcctacggccacctaacttcgttcg

SEQ ID NO: 427844 - DNA, 535 bp, Homo sapiens
  misc_feature: GZ8MTXP01BO91B.9.50.E06.1.454.CMB.2.raw
  modified_base (202)..(202): a, c, t, g, unknown or other
  modified_base (239)..(239): a, c, t, g, unknown or other
  modified_base (284)..(284): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgctccaggggaanagccacctctcctgcagggccagtcagagtcttaggnctcttagcctggtatcaacagaactggcaggctcccaggctcctnatctatgatcgcatccaaagcgggccacgtggccactccccgagccctaggttccaggtggcaggtgggtctggggcagtaccttcactctcaccatcagcagactagacgtacctagtaagttatttgactaagtttattacgtgggtcagcctaggcgtagcaacgttggcctcggtacgttcggcgaacgggccaaaggtcgacagtacgaagcgaacgtgtggtctagccttaccgtaattcgttcg

SEQ ID NO: 427845 - DNA, 502 bp, Homo sapiens
  misc_feature: GZ8MTXP01AO55V.9.50.E06.1.454.CMB.2.raw
  modified_base (203)..(203): a, c, t, g, unknown or other
  modified_base (325)..(325): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgctccaggggaaangccacctctcctgcagggccagtcagagtcttaggagctccttagcctggtatcaacagaaacctggccaggctcccaggctcctcatctatgatgcatccaacagggccatggcatcccanccaggttccagtggcagtgggtctgggcagacttcactctcacatcagcagactagagcctagaagtatttgctagtttattactgggtcagcagcgtagcaacgtggcctggacgttcggccgaagggaccaaaggtgacatcgaacgcgaactggtcggcgcgcactcgttcgtg

SEQ ID NO: 427846 - DNA, 546 bp, Homo sapiens
  misc_feature: GZ8MTXP01CE160.9.50.E06.1.454.CMB.2.raw
  modified_base (204)..(204): a, c, t, g, unknown or other
  modified_base (241)..(241): a, c, t, g, unknown or other
  modified_base (307)..(307): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttaggnctcttagcctggtatcaacagaaacctggccaggctcccaggctcctcatctatgatgcatccaancgggccactggcatcccagccaggttccaggtgcagtgggtctgggaacagtacttcactctcacatcagcagactagagcctagaagtattttgctaagtttattacctggttcagcgagtcgtacgactaacgtcggccgtcgggtaccgttccggaaccgaaacgggaaaccgaaggtacggaactacgtaccgaaggccgaacgtgggtcgcgtgaccactaacgttccgttaag

SEQ ID NO: 427847 - DNA, 501 bp, Homo sapiens
  misc_feature: GZ8MTXP01CKT4Y.9.50.E06.1.454.CMB.2.raw
  modified_base (204)..(204): a, c, t, g, unknown or other
  modified_base (486)..(486): a, c, t, g, unknown or other
  modified_base (496)..(496): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttaggagctccttagcctggtatcaacagaaacctggccaggctcccaggctcctcatctatgatgcatcccaacagggcccatggcatcccagccaggttccaggtgcagtgggtctgggcagacttcactctacaccatcagcagactagagcctagaagtattttgctaagtttattactggtacagtcagcgtagcaacgtggcctcggacttcggcaaagggccaaaggtgacatcaagcaactgnggctgcactnttctg

SEQ ID NO: 427848 - DNA, 535 bp, Homo sapiens
  misc_feature: GZ8MTXP01EOGAY.9.50.E06.1.454.CMB.2.raw
  modified_base (204)..(204): a, c, t, g, unknown or other
  modified_base (240)..(240): a, c, t, g, unknown or other
  modified_base (310)..(310): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgctccgaggggaaangccacctctcctgcagggccagtcagagtcttaggnctccttagcctggtatcaacagaaacctggccaggctcccaggctcctcatctatgatgcactccaaacngggccacgtggcatccccagccctaggttcccaggtggcgaggtcggggtactaggggaacagtaccttcacttcacacctatcagcagactagagtacctagtagtatttgctagtttattactggtcagcagcgtagcaagtcgccgtcggacgttcggcgaagggaccaaaggtacggactagtcaacgcgaacgtggtagcgtgcttacctaagttcttcg

SEQ ID NO: 427849 - DNA, 550 bp, Homo sapiens
  misc_feature: GZ8MTXP01DDPFE.9.50.E06.1.454.CMB.2.raw
  modified_base (202)..(202): a, c, t, g, unknown or other
  modified_base (240)..(240): a, c, t, g, unknown or other
  modified_base (308)..(308): a, c, t, g, unknown or other
  modified_base (370)..(370): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccacctgtctttgctccaggggaaangccaccctctcctgcagggccagtcagagtcttagganctccttagcctggtatcaacagaaacctggccaggctcccaggcctcctcatctatgatgcatccaangggccacgtggcactcccagccaggttccagtggcaggtgggtctgggcagtacttcactcncacatcagcagactagagcctagaagttattttgtaagtttattacgtgttacagtctagcgtaagcctaagtcggtaccctcggggtaccgttccggaccgaaacggggaaccaaaggttcgggaaccttagtacgaagacgttaacgttggtcggattcgacctacagtccttgttcc

SEQ ID NO: 427850 - DNA, 517 bp, Homo sapiens
  misc_feature: GZ8MTXP01EESVG.9.50.E06.1.454.CMB.2.raw
  modified_base (311)..(311): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaagagccaccctctcctgcagggccagtcagagtcttaggagctccttagcctggtatcaacagaaacctggccaggctcccaggctcctcatctatgatgcatccaangggccactggcatccccagccaggttccaggtggcaggtgggtctgggcagacttcactctcaccatcagcagactagagcctagaagtattttgctagtttattactggtctagcagcgtagcaacgtcggcctcgggacgttcggaccgaaagggaccaaaggtcggacagtacaagcgaactggtgctgcacctaattcgtcg

SEQ ID NO: 427851 - DNA, 597 bp, Homo sapiens
  misc_feature: GZ8MTXP01CUN7G.9.50.E06.1.454.CMB.2.raw
  modified_base (203)..(203): a, c, t, g, unknown or other
  modified_base (260)..(260): a, c, t, g, unknown or other
  modified_base (350)..(350): a, c, t, g, unknown or other
  modified_base (362)..(362): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacggtctccagccaccctgtctttgtctccagggaagngccaccctctcctgcagggccagtcagagtcttaggagctcctagcctggtatcaanagaacctggccaggctcccaggctcctcatctatgatgcatccaacaggccactggcactccagccagttcagtgcagtggtctgggacngacttcactctnaccatcagcagactagacgcctagtaagtattttggacttagtttaattacgtgtacctagtcgacgcggttaagaccgtaacgttgggaccccttcgggtaacccggtttcgggacccaaagggggaacccgtaaaaggttcgggaaaccagttaaccgaaacggttaccgaaaccgttggttaacggggaccttcggacccgaacccgttaacgttccgttcgtttaaccccg

SEQ ID NO: 427852 - DNA, 572 bp, Homo sapiens
  misc_feature: GZ8MTXP01A2NOB.9.50.E06.1.454.CMB.2.raw
  modified_base (205)..(205): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaangcccaccctctcctgcagggccagtcagagtcttaggagctccttagcctggtatcaacagaaacctggtcaggcctcccgaggcctcctcatctatgatgacatcccaagcgggccacgtggaccactccccgagccgagggtttccaggtggctagggtcggggtactggggaactagtacctttccaccttctaccacctatacagacaaggactagacgtcctagtaagttatttgacttaagtttattactggtacaggtcagtcgtagcctaacgtcggcctcgggacgttcggaccgaagggaaccaaggtcgacgagtacgaagcgaacgtggtcggctcgaccgacctgttccgttcg

SEQ ID NO: 427853 - DNA, 547 bp, Homo sapiens
  misc_feature: GZ8MTXP01B3XYH.9.50.E06.1.454.CMB.2.raw
  modified_base (203)..(203): a, c, t, g, unknown or other
  modified_base (257)..(257): a, c, t, g, unknown or other
  modified_base (307)..(307): a, c, t, g, unknown or other
  modified_base (341)..(341): a, c, t, g, unknown or other
  modified_base (398)..(398): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaangccaccctctcctgcagggccagtcagagtcttaggagctccttagcctggtancaacagaacctggccaggctcccaggctcctcatctatgatgcatccaangggccactggcatcccagccaggttccaggtgcnggtgggtctgggcagtaccttcactctcaccatcagcagactagagcctagaacgtnttttgcttagtttattacgtggtcagcaggcgtagctaacgtcggccctgggtaccgttcgggaccgaaacgggaccgaaaggtcgggaactagtaccgaaaggccgttaacgtggtgggccttcggaccttaccgtaacttccgttcg

SEQ ID NO: 427854 - DNA, 541 bp, Homo sapiens
  misc_feature: GZ8MTXP01ARQCO.9.50.E06.1.454.CMB.2.raw
  modified_base (243)..(243): a, c, t, g, unknown or other
  modified_base (362)..(362): a, c, t, g, unknown or other
  modified_base (405)..(405): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacggtctccagccaccctgtctttgtctccgaggggaaagagccaccctctcctgcagggccagtcagagtcttaggngctccttagcctggtatcaacagaaacctggccaggctcccaggctcctcatctatgatgcatccaacgagggccactggcatccccagccaggttcagtggcaggtggtctggggacngtacttcactctcaccatcagcagactagagcctagaaagttntttgacttagtttatacgtgtacgagtacgagtacgtagaccgtacgtcggaccgtcgggtaccgtccggaccgaacgggaaccaagttggacagtacgaacgacgacgttggtcgcgtcgccacattcgttcgtc

SEQ ID NO: 427855 - DNA, 749 bp, Homo sapiens
  misc_feature: GZ8MTXP01CN74X.9.50.E06.1.454.CMB.2.raw
  modified_base (204)..(204): a, c, t, g, unknown or other
  modified_base (241)..(241): a, c, t, g, unknown or other
  modified_base (291)..(291): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaangccaccctctcctgcagggccagtcagagtctagganctcttagcctggtatcaacagaacctggccaggcctcccgaggcctcctnatctatgatgcatacccaaacgacggggcccaacgtcggacctacgtcccccaaggtcccgtaaggggtttccccaagggttcgggcgtaggggttcgggggtacctacgggggaaccaggtaccctttccgaaccttccgtacccaaacccctatacccgaacggtaccaaacggtaaccgttaacggaaccggtacccgtttaagggtaaaacgttacgttttttacgggacctttaaaggttttttaacgtttaaaccgttcggggtttacgaacggttaccgaacgggtacccggtttaacgacccgtaaaccggttccggggtaccccgttaccggggtacccggtttaccggggaacccgtaaacggggtaacccgaaaggttacgggactaaacgtacgaaacggttcgaacgttggtacggtcgtacgtccaacctaacgttcgttaacg

SEQ ID NO: 427856 - DNA, 550 bp, Homo sapiens
  misc_feature: GZ8MTXP01C2CPU.9.50.E06.1.454.CMB.2.raw
  modified_base (204)..(204): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttaggagctccttagcctggtatcaacagaaacctggccaggctcccaggctcctcatctatgatgcatcccaaacgagggccaacgtggcactccccaagccaggttccaggtggcgaggtgggtcgtgggcagtacttcactctacacatcagcagactagagctagaagtatttgctagtttattactggtcagtcagcgtagcaacgttcggcctcgggacgttcggccgtaaacgggaacaaaggtacgggaacaagtccgaaaagccgttaaacgtggtacggcgtcggaccaccgtaacgttcctttg

SEQ ID NO: 427857 - DNA, 533 bp, Homo sapiens
  misc_feature: GZ8MTXP01ESQYH.9.50.E06.1.454.CMB.2.raw
  modified_base (203)..(203): a, c, t, g, unknown or other
  modified_base (239)..(239): a, c, t, g, unknown or other
  modified_base (374)..(374): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgctccgaggggaangccacctctcctgcagggccagtcagagtcttaggnctccttagcctggtatcaacagaaacctggccaggctcccaggctcctcatctatgatgcatccaacagggccacgtggcatcccagccaggttcccaggtggcaggtgggtctgggcagccttcactctcaccntcagcagactagagcctagaagtatttgacttagtttattactgggtacagcaggcgtagcgtaacgtcggcctcgggtacgttccggaccgaacgggaaccaaaggtcggacagtacgaagttcgaacgtggtcggctcgaccacgtaacgttcttcg

SEQ ID NO: 427858 - DNA, 527 bp, Homo sapiens
  misc_feature: GZ8MTXP01D0ISJ.9.50.E06.1.454.CMB.2.raw
  modified_base (202)..(202): a, c, t, g, unknown or other
  modified_base (239)..(239): a, c, t, g, unknown or other
  modified_base (294)..(294): a, c, t, g, unknown or other
  modified_base (404)..(404): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgctccaggggaangccacctctcctgcagggccagtcagagtcttagganctccttagcctggtatcaacagaaacctggccaggctcccaggctcctcatctangatgcataccaacagggccacgtggacactccccagccaggttcccaggtgcaggtgggtctggggcagtacttcactctcacatcagcagactagatacctgaaagttnttagacttaagtttattactggtactagcagtcgtagcgacgtcggccgtcgggtacgtcggacgaacggaacgaagtagacgacgtacgacgcgacgtgcggctcgacactaacgttcgtcg

SEQ ID NO: 427859 - DNA, 575 bp, Homo sapiens
  misc_feature: GZ8MTXP01EBHI5.9.50.E06.1.454.CMB.2.raw
  modified_base (202)..(202): a, c, t, g, unknown or other
  modified_base (212)..(212): a, c, t, g, unknown or other
  modified_base (230)..(230): a, c, t, g, unknown or other
  modified_base (240)..(240): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgctccaggggaanagccacctcncctgcagggccagtcagngtcttagganctccttagcctggtatcaacagaaacctggcccaggcctcccaggctcctcatctatgatgcatcccaacgacggggccaacgtggacactcccgagccctaggtttcccaggttggactagggtcgggtctaggggaacaggtacttcactctacacatcagcagactagacgacctagaaagtattttgacttagtttactactgggtcaagcaggcgtagctaacgtcgggtaccctgggaccgtcggtaccggaaacggtaacgaaacggtacgacgtacgaacgacgacgacgtaacggcggtaacgcgtacgacctaacgttcgttccg

SEQ ID NO: 427860 - DNA, 636 bp, Homo sapiens
  misc_feature: GZ8MTXP01B3123.9.50.E06.1.454.CMB.2.raw
  modified_base (205)..(205): a, c, t, g, unknown or other
  modified_base (242)..(242): a, c, t, g, unknown or other
  modified_base (418)..(418): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaangccaccctctcctgcagggccagtcagagtcttaggngtctctagcctggtatcaacagaaacctggccaggctcccgaggcctcctcatctatgatcgcatacccaaagcgggcccagtcggaccactccccagcccgaggttcccagggtggcaggtgggtacagggcagtccttcactcacaccatcagcagactagagactagtaattntttcggacttagtttaattacgtcgggtactacgtacgtacggacgttaacgacccgtaaacgttccggggacccgttacggggtaacccggttaccgggaaacccggtaaacggggaaaccgaaacgggttacggaaacgtaaacgtacgaaacggttacggttaaacgttcggggtacgtaaccgtacggaccgttaccgtaacgtttcggttccg

SEQ ID NO: 427861 - DNA, 547 bp, Homo sapiens
  misc_feature: GZ8MTXP01AWQI3.9.50.E06.1.454.CMB.2.raw
  modified_base (204)..(204): a, c, t, g, unknown or other
  modified_base (241)..(241): a, c, t, g, unknown or other
  modified_base (284)..(284): a, c, t, g, unknown or other
  modified_base (291)..(291): a, c, t, g, unknown or other
  modified_base (410)..(410): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccacctctcctgcagggccagtcagagtcttagganctccttagcctggtatcaacagaacctgccaggctccagctcncatctangatgcactccaaacgagggccactggccactcccagccaggttccaggtggctaggtcggtctggggaactaggtacctttccgactctacacctatacagcagactagcgctagagtntttgctagtttatactggtacagtcagtcgtagctaacgtcggaccgtcgggaacgttccgggaccgaaagggtaccaaagggtcgaccgaagtacgaagccgaagtggtaggcctggaccttaccgtaattccgtg

SEQ ID NO: 427862 - DNA, 608 bp, Homo sapiens
  misc_feature: GZ8MTXP01DXGIY.9.50.E06.1.454.CMB.2.raw
  modified_base (205)..(205): a, c, t, g, unknown or other
  modified_base (241)..(241): a, c, t, g, unknown or other
  modified_base (287)..(287): a, c, t, g, unknown or other
  modified_base (293)..(293): a, c, t, g, unknown or other
  modified_base (416)..(416): a, c, t, g, unknown or other
tcagtgatacgtctcacgaccggtgctcgatttagatctactgacaacacacaaggggggaggaactgctcagttaggacccagagggaaccatggaagccccagctcagcttctcttcctcctgctactctggctcccagattccaccggagaagttgtgttgacacagtctccagccaccctgtctttgctccgaggggaaangccacctctcctgcagggccagtcagagtcttaggngctccttagcctggtatcaacagaaacctggccaggctccagctcnatctangatgcataccaagcgggccacgtggaccactccccagcctaggttccaggtggctagggtcggggtactgggaacagtaccttcactctacacatcagctagactagacgtctagaaagtttntttagactttaagtttaacttacgtcgggtaacaggtccgtaaggtacgtacgaccgtaacggtccgggaccgttaccggggtaccggttccgggaaccggaaacgggaaacggttaaagggtacggaacgtaacgtaacgaacgggacgttaacgtgggtcggtaacgtcgaccttaccttgttccgttcg

SEQ ID NO: 427863 - DNA, 539 bp, Homo sapiens
  misc_feature: GZ8MTXP01C3567.9.50.E06.1.454.CMB.2.raw
  modified_base (204)..(204): a, c, t, g, unknown or other
  modified_base (307)..(307): a, c, t, g, unknown or other
  modified_base (319)..(319): a, c, t, g, unknown or other
  modified_base (329)..(329): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccacctctcctgcagggccagtcagagtcttaggagctccttagcctggtatcaacagaaacctggccaggctccagctcctcatctatgatgcatccaagngggcccagtggnaccccccctnacgcaggttccaggtggcaggtggtcgtgggaactagacttcactctacaccatcagcagactagaacgctagaattatttgacttagtttatactggttcaagtccagctagctaacgtgccgttcggacgttccggacgaaagggtacaaaggtcgaactacgtcgaaagttcgaaactggtacgctcgaccacgtaacttcgttaac

SEQ ID NO: 427864 - DNA, 588 bp, Homo sapiens
  misc_feature: GZ8MTXP01BITBH.9.50.E06.1.454.CMB.2.raw
  modified_base (204)..(204): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgctccgaggggaaangcccacctctcctgcagggccagtcagagtctaggagctcctagcctggtatcaacagaaacctggccaggctcccgaggcctcctcatctatgatgcatcccaaagcgggccacgtggcactcccagccaggttcccaggtgcgtaggtggtctgggcagtacttcactctacacatcagcagactagagcctagaagtactttgactaagtttattactggtcaggtcaggtcgtacgacaacgtcgggcccgtcgggtaaccgttccgggaaccggtaaaacggggtaacccttaaaagggtcggaaacctaacgtaacgaaacgggccgaaaccgttgggtacggaacgttcggaccttacccggtaatttccggttccg

SEQ ID NO: 427865 - DNA, 648 bp, Homo sapiens
  misc_feature: GZ8MTXP01AEWGK.9.50.E06.1.454.CMB.2.raw
  modified_base (205)..(205): a, c, t, g, unknown or other
  modified_base (304)..(304): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaancgcccaccctctcctgcgagggccagtcagagtcttaggagtcctccttagcctaggtactcaacagaaaccgtggaccaggcctcccgaggcctcctnatctatgatcgacatacccaacgacgggccacgtcggacacctaccccgagcccgtaaggttcccaggtggccgtagggtcgggtaactgggaactaggtaccttcaccttctacaccgtatcgagaccaagactaggacgtaccgtagtaaggttattttcggacttaaggttttacttacgtgggttaccaaggtccaacggtcgtaacgaccgtaacgttccgggacccgttacgggtacccggttaccgggaccgtaaacggggaccttaaagggtcggaaacctaacgtaacgaaggacccgttaagtggtacggctacgaccttacctaacttcgttc

SEQ ID NO: 427866 - DNA, 666 bp, Homo sapiens
  misc_feature: GZ8MTXP01EGWIF.9.50.E06.1.454.CMB.2.raw
  modified_base (210)..(210): a, c, t, g, unknown or other
  modified_base (449)..(449): a, c, t, g, unknown or other
  modified_base (471)..(471): a, c, t, g, unknown or other
tcagtgatacgtctcacgaccggtgctcgatttagatctactgacaacacacaaggggggaggaactgctcagttaggacccagagggaaccatggaagccccagctcagcttctcttcctcctgctactctggctcccagattccacggagaagttgtgttgacacagtctccagccacccttgttctttgtcctccgaaggggaaacngcccaccctctcctgcagggccagtcagtagtcgttaggagtctccttagcctggtatacaacagaacctggaccaggcctcccgaggcctcctcattctatagatcgactactacccgaaacggtcgggacctacgtcggacaccgttcccgagccgtaggttccaggttggagtaggtcggggtacgtagggaacctagttaccctacgactcctacacatcagctaacgataacgngtaccgtagtaacgttagtttntacgttagtttaacttcgttacgggtaagtcgtaacgacggttacgtaacgccgtaaacgttccggtcccgttacgggtacccggtttacggaaccggaaacgggtaaacgaaacgggttacggaaacccttaaggaacccgttaaagggccgttaaggtcgttacggcgtcgaccttacgtaacttcgtttccg

SEQ ID NO: 427867 - DNA, 571 bp, Homo sapiens
  misc_feature: GZ8MTXP01DUL94.9.50.E06.1.454.CMB.2.raw
  modified_base (205)..(205): a, c, t, g, unknown or other
  modified_base (362)..(362): a, c, t, g, unknown or other
  modified_base (410)..(410): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaagngccaccctctcctgcagggccagtcagagtcttaggagctccttagcctggtatcaacagaaacctggccaggcctcccaggctcctcatctatgatgcatccaaacgcgggccacgtggcactccccagcctaggttcaggtggctaggtggtacngggcagtacttcactctacacatcagcagactagacgtctagaagttntttgacttagtttattacgttggtacaggacaggtacgtagacctaacggtcgggtcccgtacgggtacgttccggggaaccgtaaaagggaacccgttaaaggtcggaactagtaccgaaaggcgttaaacgtggtagcctggcccttacctgttcttcg

SEQ ID NO: 427868 - DNA, 623 bp, Homo sapiens
  misc_feature: GZ8MTXP01AZFLD.9.50.E06.1.454.CMB.2.raw
  modified_base (206)..(206): a, c, t, g, unknown or other
  modified_base (242)..(242): a, c, t, g, unknown or other
  modified_base (289)..(289): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaagngcccacctctcctgcagggccagtcagagtctaggnctctagcctggtatcaacagaacctggtcaggcctccaggcctcctnatctatgatcgacacgtaccaacgacgggtcccaagtcggccaccgttccccgaggtcccgtagggtttcccagggttcggacgtagggtcggggtactggggaacacgtacttccaccttctacaacctagtaccagacgagactaggacgtacctagtaagttgtttgactttaagtttattaccgtggtacgagacgacgtcgtagaccgtacggtcggtccgtaccgggtaccggttccgggaaccgaacggggaaccgttaaaggtaccgggaactaacgtacggaacgcgttaaacgtggtcggaactcgaccttacgtcttcgttcg

SEQ ID NO: 427869 - DNA, 590 bp, Homo sapiens
  misc_feature: GZ8MTXP01D2LT1.9.50.E06.1.454.CMB.2.raw
  modified_base (205)..(205): a, c, t, g, unknown or other
  modified_base (290)..(290): a, c, t, g, unknown or other
  modified_base (396)..(396): a, c, t, g, unknown or other
  modified_base (421)..(421): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgttctttgctccgaggggaaangccacctctcctgcagggccagtcagtagtcttaggagtctccttagcctggtatcaacagaacctggccaggctcccgagctcncatctatgatcgcactaccaaacgcgggccacgtggcactccccagcctaggttccaggttggactagggtcgggtacgtggggaacagtaccttcactctacacntcagcagactagacgactagaattntttgacttagtttactacgtggactagcagtcgtacgctaacgtcggtacccgtcggggtacgttccgggaaccgtaaaaggggaccttaaagggtcggaactaggtaacgaacgggttcgttaaaccgtgggtacggtctacggaccttaccgtaagttccctttcgg

SEQ ID NO: 427870 - DNA, 590 bp, Homo sapiens
  misc_feature: GZ8MTXP01A0H88.9.50.E06.1.454.CMB.2.raw
  modified_base (204)..(204): a, c, t, g, unknown or other
  modified_base (293)..(293): a, c, t, g, unknown or other
  modified_base (299)..(299): a, c, t, g, unknown or other
tcagtgatacgtctcacgaccggtgctcgatttagatctactgacaacacacaaggggggaggaactgctcagttaggacccagagggaaccatggaagccccagctcagcttctcttcctcctgctactctggctcccagattccaccggagaagttgtgttgacacagtctccagccaccctgtctttgctccgaggggaangccacctctcctgcagggccagtcagtagtcttaggagctccttagcctggtatcaacagaacctggccaggcctcccgaggcctcctnatctanggatgacactccaagcgggccacgtggcactcccagcccgtaggttccaggtggactagggtcggggtctaggggcacgtaccttcacctctacactatccagcagactagacgtacctagtaagtacttttagacttaagtttattaacgtgggtacagtcaggtcgtaagccgtaacgtcgggcccgtacggggtaccttacggggacctaaacggggaacccttaaaggacggacagtaccgaaaggcgttaacgttggacggctcggaccttacctaagttcgttcg

SEQ ID NO: 427871 - DNA, 502 bp, Homo sapiens
  misc_feature: GZ8MTXP01A3QMT.9.50.E06.1.454.CMB.2.raw
  modified_base (201)..(201): a, c, t, g, unknown or other
  modified_base (237)..(237): a, c, t, g, unknown or other
  modified_base (251)..(251): a, c, t, g, unknown or other
  modified_base (255)..(255): a, c, t, g, unknown or other
  modified_base (275)..(275): a, c, t, g, unknown or other
  modified_base (295)..(295): a, c, t, g, unknown or other
  modified_base (309)..(309): a, c, t, g, unknown or other
  modified_base (341)..(341): a, c, t, g, unknown or other
  modified_base (383)..(383): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctcagccacctgtctttgctcgaggggaaangccacctctcctgcagggccagtcagagtcttaggnctccttagcctgancaanagaactgcagctccagctcnatctatgatgcatccaaagnggccatgcatccancaggtccagtggcagtggctgggcagaccttnactcacacatacagacagatagagacgtagtaagtattagtntagttattatgtcgagagagagtagacgacgtacgtcgtcgtacgtcgacgaacggaacgaaaggagacgtacgacgaacgacgacgtaagtacgtcgtcgtacgactaacgttcgtcg

SEQ ID NO: 427872 - DNA, 504 bp, Homo sapiens
  misc_feature: GZ8MTXP02HA5UC.9.50.E06.1.454.CMB.2.raw
  modified_base (204)..(204): a, c, t, g, unknown or other
  modified_base (242)..(242): a, c, t, g, unknown or other
  modified_base (309)..(309): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagtgccagtcagagtcttagganctccttagcctggtatcaacagaacctggccaggctcccaggctcctcatctatgatgcatccaacngggcccactggcatcccagccaggttcagtgcagtggctggggacagacttcactctcaccatcagcagactagagcctgaagtatttgctagtttattactgtacagtcagcgtagcaactcggcctggacgttcggaccgaagggaccaaagtggacacgtacgaagcgaacgtgtacggctgaccacactcg

SEQ ID NO: 427873 - DNA, 523 bp, Homo sapiens
  misc_feature: GZ8MTXP02IMGWN.9.50.E06.1.454.CMB.2.raw
  modified_base (203)..(203): a, c, t, g, unknown or other
  modified_base (241)..(241): a, c, t, g, unknown or other
tcagtgatacgtctcacgaccggtgctcgatttagatctactgacaacacacaaggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcaggccagtcagagtcttagganctcttagcctggtatcaacagaaacctggccaggctcccaggctcctcatctatgatgcatccaacagggccactggcatcccagccaggttccagtgcagtggtctgggcagacttcactctcacatcagcagactagacgctagaatatttgactagtttattactgtctagcagcgtagcaacgtggcctcgggacgttcggaccgtaaacggaaccgaaaggtcggaaacacgttacgaaacggactaacgtggtacggcgtcgacaccatttctacg

SEQ ID NO: 427874 - DNA, 548 bp, Homo sapiens
  misc_feature: GZ8MTXP02HI6WR.9.50.E06.1.454.CMB.2.raw
  modified_base (204)..(204): a, c, t, g, unknown or other
  modified_base (404)..(404): a, c, t, g, unknown or other
  modified_base (529)..(529): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttaggagctcttagcctggtatcaacagaaacctggccaggcctcccaggcctcctcatctatgatgcatccaaacgagggccacgtggcactcccagccaggttcccaggtgcaggtgggtctggggacagtacttcactctcaccatcagcagactagagctgaatntttgactagtttatacttgtctagcagtacgtagactaacgtcgggcctacgggtaccgttcggaccgtaaacggggaacccaaaggtacggaacaacgtaccgaaagacgaaacttggaggacncggaccacctactcgttcg

SEQ ID NO: 427875 - DNA, 525 bp, Homo sapiens
  misc_feature: GZ8MTXP02G3DZ7.9.50.E06.1.454.CMB.2.raw
  modified_base (204)..(204): a, c, t, g, unknown or other
  modified_base (243)..(243): a, c, t, g, unknown or other
  modified_base (312)..(312): a, c, t, g, unknown or other
  modified_base (356)..(356): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttagganctccttagcctggtatcaacagaaacctggccaggctcccaggcctcctcatctatgatgcatccaacngggccacgtggcactccccagccaggttccagtgcaggtggtcngggcagacttcactctcaccatcagcagactagagcctagaagtattttgactagtttattactgtcagcagcgtagcaacgtggacctcggacgttcggaccgaacgggaccaaaggtacggacaacgtacgaacgacgaactgtacggctcggacaccactacttcg

SEQ ID NO: 427876 - DNA, 515 bp, Homo sapiens
  misc_feature: GZ8MTXP02JXHOL.9.50.E06.1.454.CMB.2.raw
  modified_base (312)..(312): a, c, t, g, unknown or other
  modified_base (359)..(359): a, c, t, g, unknown or other
  modified_base (374)..(374): a, c, t, g, unknown or other
tcagtgatacgtctcacgaccggtgctcgatttagatctactgacaacacacaagggggaggaactgctcagttgggacccagagggaaccatggaagccccagctcagcttctcttcctcctgctactctggctcccagattccaccggagaagttgtgttgacacagtctccagccaccctgtctttgtctccaggggaaagagccacccctctcctgcagggccagtcagagtcttaggagctccttagcctggtatcaacagaaacctggccaggctcccaggctcctcatctatgatgcatccaacngggccactggcatcccagccaggttccagtgcaggtggtctggggcngacttcactctcacntcagcagactagagcctagaagtattttgctagtttatactgtcagcagcgtagcaactcggcctcggacgttcggaccgaacgggaccgaaaggtcggaaccagtacgaacgacgaacgtgtacggctgaccaccatctg

SEQ ID NO: 427877 - DNA, 545 bp, Homo sapiens
  misc_feature: GZ8MTXP02I5PJP.9.50.E06.1.454.CMB.2.raw
  modified_base (204)..(204): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttaggagctccttagcctggtatcaacagaacctggccaggctcccaggctcctcatctatgatgcatccaagagggcccatggcactcccgagcctaggttccagtcggcaggtggtctggggacagtacttcgactctacaccatcagcagactagagctagaagtacttttgacttagtttattacgtgtactagtcagaccgtagctaacgtcggcctacggacgttcggaccgaaacggggaaccgaaaggtacggaacacgtacgaaacggacgtaactggtacggctacgaccacctatctcg

SEQ ID NO: 427878 - DNA, 535 bp, Homo sapiens
  misc_feature: GZ8MTXP02I6Y0B.9.50.E06.1.454.CMB.2.raw
  modified_base (204)..(204): a, c, t, g, unknown or other
  modified_base (309)..(309): a, c, t, g, unknown or other
  modified_base (354)..(354): a, c, t, g, unknown or other
  modified_base (359)..(359): a, c, t, g, unknown or other
  modified_base (368)..(368): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccacctctcctgcagggccagtcagagtcttaggagctccttagcctggtatcaacagaaacctggccaggctcccaggctcctcatctatgatgcatccaanagggccacgtggcatcccagcaggtccagtgcagtggtctgggcngactnactctcacntcagcagactagagctgaagtatttgactagtttatacttgtcagtcagtacgtagcaactcggcctcggtacgttccgggaccgaaacggggacccaaaaggttcgggaaaccagttaccgaaacgcgtaaaacgtcggtacgggctacgacaccctatactttcg

SEQ ID NO: 427879 - DNA, 530 bp, Homo sapiens
  misc_feature: GZ8MTXP02H0WPS.9.50.E06.1.454.CMB.2.raw
  modified_base (204)..(204): a, c, t, g, unknown or other
  modified_base (310)..(310): a, c, t, g, unknown or other
  modified_base (368)..(368): a, c, t, g, unknown or other
  modified_base (413)..(413): a, c, t, g, unknown or other
  modified_base (421)..(421): a, c, t, g, unknown or other
  modified_base (425)..(425): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctcccaggctcctcatctatgatgcatccaangggccactggcatcccagccagttccagtgcaggtggtctgggacagacttcacttcncacatcagcagacagagctagaagtatttgctagtttattacgtntcagcagngtanacaacgtcgccgtaggaccgttcggaacccgaaggggaaacctaaaggaggaacaactacgaaacgacgaaacttggtacggacctacgactacctacttcgtcg

SEQ ID NO: 427880 - DNA, 543 bp, Homo sapiens
  misc_feature: GZ8MTXP02IR1L0.9.50.E06.1.454.CMB.2.raw
  modified_base (203)..(203): a, c, t, g, unknown or other
  modified_base (240)..(240): a, c, t, g, unknown or other
  modified_base (308)..(308): a, c, t, g, unknown or other
  modified_base (353)..(353): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaangccacctctcctgcagggccagtcagagtcttagganctccttagcctggtatcaacagaaacctggccaggctcccaggcctcctcatctatgatgcatccaanaggccactggcactccagccaggttccagtgcagtggtctgggcngacttcactctcaccatcagcagactagacgcctagaagtattttgactagtttattactgtacagtcagtcgtagcaacgtggcctcgggacgttcgggaccctaaaggggacccaaaaggtcggaaaccagttacgaaacggccgtaaacgtggtacgggactcggacctaacccgtattccgtttcg

SEQ ID NO: 427881 - DNA, 503 bp, Homo sapiens
  misc_feature: GZ8MTXP02F9G7P.9.50.E06.1.454.CMB.2.raw
  modified_base (204)..(204): a, c, t, g, unknown or other
  modified_base (243)..(243): a, c, t, g, unknown or other
  modified_base (309)..(309): a, c, t, g, unknown or other
  modified_base (415)..(415): a, c, t, g, unknown or other
  modified_base (486)..(486): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttagganctccttagcctggtatcaacagaaacctggccaggctcccagctcctcatctatgatgcatccaanggccactggcatcccagccaggttccagtgcaggtgggtctggggacagacttcactctcaccatcagcagactagagcctagaagtatttgactagtttatactntcagtcagcgtagcaactggcctggacgttcggaccaagggaccaaaggtcggaacatccaaagcgtaacngtagctacgcacatctg

SEQ ID NO: 427882 - DNA, 534 bp, Homo sapiens
  misc_feature: GZ8MTXP02F30WL.9.50.E06.1.454.CMB.2.raw
  modified_base (204)..(204): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggcctcccaggcctcctcatctatgatgcatccaacagggccacgtggcatccccagccaggttccagtgcaggtgggtctggggcagcttcactctacaccatcagcagactagagcctagaagtatttgactagtttatactgtcagtcagcgtagcaacgtggacctcgggacgttcggaccgaaacgggaccaaaaggtcggaaacacgtacgaaacgcgaaacgtggtacggcgtacgacaccgactcgttcg

SEQ ID NO: 427883 - DNA, 724 bp, Homo sapiens
  misc_feature: GZ8MTXP02GNQZQ.9.50.E06.1.454.CMB.2.raw
  modified_base (203)..(203): a, c, t, g, unknown or other
  modified_base (243)..(243): a, c, t, g, unknown or other
  modified_base (266)..(266): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgagggaancgccaccctctcctgcgagggccagtcagagtcttagganctctagcctgtatcaacagaacnggcaggctccgagctcctcatctatgatcgacactaccaacgcgggccacgtcgctacgtcccgagcccgtaggttcccgaggtcggacgtaggttcggggtacgtaggggacctacggtaccttcaccttcctaccaacctactacccgagtacccgaacgaacgtaacggacccggtacttaaggtaaacgtttacgtttttacgacgttttaaagtttttacgttaaccgttcgggttaccgtaacggtacgttaacgggtaccggttaaccgtaacccggttaaccgggtccgggtaaccccgggtttaccggggtaaaccgggttacccgggaaaaccgggaaaacgggtaaaacccggtaaaggggtaccggaaaccgtaaagtaccgaaaacggtcgttaaaccggtggtacggtaccgtacgacccggtaacgttctttaccgtttaccg

SEQ ID NO: 427884 - DNA, 498 bp, Homo sapiens
  misc_feature: GZ8MTXP02HJE05.9.50.E06.1.454.CMB.2.raw
  modified_base (204)..(204): a, c, t, g, unknown or other
  modified_base (243)..(243): a, c, t, g, unknown or other
  modified_base (467)..(467): a, c, t, g, unknown or other
  modified_base (482)..(482): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttagganctcttagcctggtatcaacagaaacctggccaggctcccaggctcctcatctatgatgcatccaaacagggccactggcatcccagccaggttccagtggcagtggctggggcagacttcactctcaccatcagcagactagagcctgaagatttgcagtttatactgtcagcagcgtagcaacgtgcctcggacgttcgccaaggggaccaaagtaggacaanacacgacgacgaagngcgcgcacactactcg

SEQ ID NO: 427885 - DNA, 525 bp, Homo sapiens
  misc_feature: GZ8MTXP02I343O.9.50.E06.1.454.CMB.2.raw
  modified_base (203)..(203): a, c, t, g, unknown or other
  modified_base (242)..(242): a, c, t, g, unknown or other
  modified_base (310)..(310): a, c, t, g, unknown or other
  modified_base (370)..(370): a, c, t, g, unknown or other
  modified_base (396)..(396): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaanagccaccctctcctgcagggccagtcagagtcttagganctccttagcctggtatcaacagaaacctggccaggctcccaggctcctcatctatgatgcatccaacngggccacgtggcatcccagccaggttccagtggcaggtggtctggggcagacttcactcncaccatcagcagactagagctgaatntttgactagtttattactgtcagtcaggtcgtagctaagtcggaccttcggacgttcggaccgtaaacgggaccgaaaagtggaactagtacgaacgcgaactggtacgctcgaccaccgtattcgtcg

SEQ ID NO: 427886 - DNA, 548 bp, Homo sapiens
  misc_feature: GZ8MTXP02JRMC7.9.50.E06.1.454.CMB.2.raw
  modified_base (204)..(204): a, c, t, g, unknown or other
  modified_base (310)..(310): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttaggagctcctagcctggtatcaacagaaacctggccaggcctcccaggcctcctcatctatgatgcatccaangggcccactggcatcccagccaggttccagtggcaggtggtctgggacagacttcactctcaccatcagcagactagagcctagaacgtattttgactagtttattactgtcagtcagcgtagcaacgtcggcgtcggacgttcggaccgtaaacgggaccgaaaggtcgggaaacacgtacgaaacggccgtaaaccgtggttacggacgttacggacctaccgtaactctttaccg

SEQ ID NO: 427887 - DNA, 550 bp, Homo sapiens
  misc_feature: GZ8MTXP02F4UR8.9.50.E06.1.454.CMB.2.raw
  modified_base (204)..(204): a, c, t, g, unknown or other
  modified_base (314)..(314): a, c, t, g, unknown or other
  modified_base (544)..(544): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggcctcccaggcctcctcatctatgatgcatccaacgngggccatggcactcccagccaggtccagtgcaggtggctgggcagacttcactctcaccatcagcagactagagactagaagttatttcgacttagtttattacgtgtacagcagtcgtacgctaacgtcggaccgttcgggaccggttccgggaaccgtaaacggggaacctaaagggtacggaacaacgtaccgaaagccgtaaacgtggtacgcgtacgctaacctntcgtcg

SEQ ID NO: 427888 - DNA, 593 bp, Homo sapiens
  misc_feature: GZ8MTXP02JA923.9.50.E06.1.454.CMB.2.raw
  modified_base (203)..(203): a, c, t, g, unknown or other
  modified_base (231)..(231): a, c, t, g, unknown or other
  modified_base (289)..(289): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaangccaccctctcctgcagggccagtcagngtcttaggagctccttagcctggtatcaacagaaacctggccaggctcccaggctccnatctatgatgcatccaagcgggccacgtggccactcccgagccaggttccccaggtcggactaggtggggtctggggacaggtacttcgacctctacaccatacagcagactagagcctagagttattttgacttaagttttatacgttgtacgtagacgtaggtacgtacgactaaccgtcgggtacccgtacgggtaccggttaccgggacccgtaaaacgggggaacccttaaaaggtcggtaaaccagtaacgaaacggaccggtaaacgtggtcggactcggaccacctatccgtttcg

SEQ ID NO: 427889 - DNA, 626 bp, Homo sapiens
  misc_feature: GZ8MTXP02F2NDN.9.50.E06.1.454.CMB.2.raw
  modified_base (205)..(205): a, c, t, g, unknown or other
  modified_base (316)..(316): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaanagccaccctctcctgcagggccagtcagagtcttaggagctccttagcctggtatacaacagaaacctggccaggcctcccaggcctcctcatctatgatgcatccaacgngggcccacgtggcactcccgagccctaggttcccaggtcggctagggttggggtctaggggacaggtaccttcacctctaccaccatcagacagaacctaggacgtaccctagtaaagttagttttagacgttaagtttttaacttaccgttggttaccaaggtcaacgggtacgttaacgaccgtaacgtcgggacccgttccggggtaccggttccgggaaccggtaaaacgggaaccgaaaagggtcggaaacacgtacgaaacggcgtaaacgtcggtacggactcgacgtacctagttcgttacg

SEQ ID NO: 427890 - DNA, 555 bp, Homo sapiens
  misc_feature: GZ8MTXP02HHBL2.9.50.E06.1.454.CMB.2.raw
  modified_base (205)..(205): a, c, t, g, unknown or other
  modified_base (393)..(393): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaangccaccctctcctgcagtgccagtcagagtcttaggagctccttagcctggtatcaacagaaacctggccaggcctcccgaggcctcctcatctatgatgcatccaaacgacgggcccacgtggccacgtcccagccagggttccaggtcggctaggtgggtcgtggggactaggtaccttcacttcncacatcacgcagactagacgccgtagaagttatttgacttagtttacttacgtgtcagcagcgtagctacgtcggccgtcggtacgttccggaccgaaacgggacctaaacggtcgaactacgtacgaaggacgaacgtgacggctacgacctacgtactcg

SEQ ID NO: 427891 - DNA, 543 bp, Homo sapiens
  misc_feature: GZ8MTXP02I33N0.9.50.E06.1.454.CMB.2.raw
  modified_base (203)..(203): a, c, t, g, unknown or other
  modified_base (212)..(212): a, c, t, g, unknown or other
  modified_base (239)..(239): a, c, t, g, unknown or other
  modified_base (381)..(381): a, c, t, g, unknown or other
  modified_base (429)..(429): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccacggagaagttgtgttgacacagtctccagccaccctgtctttgctccgaggggaaangccaccctntcctgcagggccagtcagagtctaggnctctagcctggatcaacagaaacctgccagctccagctccccatctatgatgcatccaaacagggccatggcatcccagccaggttcagtgcagtgggtctgggacagacttcaacttcacaccagtcagtcaagaacagancctagaaagtattttcgatagtttattactgtacaagcagacggtaanactaacgtcggccgtacggacgtacggaccgaaacgggaaaccgaaaagtacggaacaagtaacgaacgaacgtaacgtacgtaacggtacgtacgacgaccactactacgtcg

SEQ ID NO: 427892 - DNA, 542 bp, Homo sapiens
  misc_feature: GZ8MTXP02GZPK9.9.50.E06.1.454.CMB.2.raw
  modified_base (204)..(204): a, c, t, g, unknown or other
  modified_base (308)..(308): a, c, t, g, unknown or other
  modified_base (363)..(363): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttaggagctccttagcctggtatcaacagaaacctggccaggctcccaggctcctcatcatgatgcatccaangggccatggcatcccagccaggttccagtgcagtgggtctgggcagacttcactntcaccatcagcagactagagcctaggaagtattttgactagtttaattacttgtctagctaggcgtaagcctaactcggcctggaccgttcggacccgaaaacggggaaccgaaaaggttcgggaaaccaagtcgaaaacggcggaaaactggtacggcgtacgacacccgatcttcgg

SEQ ID NO: 427893 - DNA, 532 bp, Homo sapiens
  misc_feature: GZ8MTXP02FJ3OY.9.50.E06.1.454.CMB.2.raw
  modified_base (204)..(204): a, c, t, g, unknown or other
  modified_base (241)..(241): a, c, t, g, unknown or other
  modified_base (312)..(312): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttaggnctccttagcctggtatcaacagaaacctggccaggcctcccaggcctcctcatctatgatgcatccaacgngggccagtggcactcccagccaggttccagtgcaggtgggtctggggacagacttcactctcaccatcagcagactagagcctagaagtatttgactagtttatactgtcagcagcgtagctaacgtcggcctcggacgttcggaccgtaaacgggaccgaaaggtacggaacacgtacgaaacgacgtaaacgtgtacggctcggaccactactcttcg

SEQ ID NO: 427894 - DNA, 674 bp, Homo sapiens
  misc_feature: GZ8MTXP02GHFUC.9.50.E06.1.454.CMB.2.raw
  modified_base (206)..(206): a, c, t, g, unknown or other
  modified_base (244)..(244): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaagngccaccctctcctgcagggccagtcagagtcttagganctccttagcctggtatcaacagaaacctggccaggcctcccaggcctcctcatctatgatcgccactacccaaacgacgggcccacgtcggaccactccccgagcccgtaggtttcccagggttggaccgtagggttcggggtaccgtacgggggacctacggtacctttaccaccttcctaccaacccagttaccgaagaccgaagtaaccgtaaggacgtacccgtaggtaaagttagtttttacgacgttaagttttaacttacgttgtacagcgtacggtacgtaacgaccgtaacgtcgggacccgttacgggtaccggttccggaaccggaaaacggggaaccgtaaagggtacggaaacgtaacgtaccgaaacggtacgtaaacgtggtacggacgtacggaccaccgtactcggtttaccg

SEQ ID NO: 427895 - DNA, 567 bp, Homo sapiens
  misc_feature: GZ8MTXP02IR881.9.50.E06.1.454.CMB.2.raw
  modified_base (202)..(202): a, c, t, g, unknown or other
  modified_base (239)..(239): a, c, t, g, unknown or other
  modified_base (259)..(259): a, c, t, g, unknown or other
  modified_base (312)..(312): a, c, t, g, unknown or other
  modified_base (375)..(375): a, c, t, g, unknown or other
  modified_base (380)..(380): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgctccaggggaangccaccctctcctgcagggccagtcagagtcttaggnctccttagcctggtatcaanagaaacctggaccaggcctcccgaggctcctcatctatgatgcatacccaagngggccagtggccactcccagccaggttccagtgcaggtgggtctgggcagtcttcgaccttcncaccntcagcagctagcgctagaagtattttgactaagttttatacgttgtactagccgagtgtaacgctaaacgtcgggtcccgtacgggtacgttcgggaccgaaaacggggaccctaaaaggtaccgggaatacgacgaaacggtacccgaagtttggaacggtcgacgcgtaacctcgtttaccgtcg

SEQ ID NO: 427896 - DNA, 757 bp, Homo sapiens
  misc_feature: GZ8MTXP02FLPQ2.9.50.E06.1.454.CMB.2.raw
  modified_base (205)..(205): a, c, t, g, unknown or other
  modified_base (261)..(261): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaangcccaccctctcctgccagggccagtcagagtcttaggagctccttagcctggtancaacagaaacctggaccaggcctcccaggcctcctcatctatgatgcatccaacgcgggcccacgtggaccactccccagcctaggttcccaggtcggctaggtcgggtacgtggggaccaggtacctttcaccgttcctaccaaccctattaccgagtacccgaaaggtaaccttaagggaacgtacccgttaaggaaaacgtttacgtttttaggaccgttaaggtttttttaaacttaccgttaggttacccgaaggtacccgttaaagggacccgtttaaacggcccgtaaaccggttccggggtaccccgtttacccgggggtaaacccggggtttcccggggaaacccccggtaaaacgggggtaaaacccccgtaaaagggggttaccggggaaaacctaacgttaaccggaaaaccggtacgtaaaaccgggttgggtaccggggtaccttaccgggaaccgttaaccccgtatttcccggtttaccg

SEQ ID NO: 427897 - DNA, 743 bp, Homo sapiens
  misc_feature: GZ8MTXP02GITJQ.9.50.E06.1.454.CMB.2.raw
  modified_base (205)..(205): a, c, t, g, unknown or other
  modified_base (214)..(214): a, c, t, g, unknown or other
  modified_base (242)..(242): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaangccaccctntcctgcagggccagtcagagtctagganctccttagcctggtatcaacagaaacctggccaggcctcccgaggcctcctcatctatgatgacatacccaaacgcgggaccctacgtcggcctacctaccccgagccccgtaagggtttccccagggttcgggactacggggtttcggggttaccgtggggacctacgggtaaccctttccgaaccttcccgtaccaaaccctattaccgacggaccaaaggtaaccgtaagggacgtacccttaagggtaaacgttaggtttttacgacgttaaaggtttttacttacgttacggttaccgaaggtaccgtaacgggtccgtaaacggtacccgtaaacgggttccgggtacccccgtacggggttacccgggtttaccgggaacccgggtaaaacggggaacccgttaaaagggtcgggaaaacctagtaaccgaaacgggtaccgtaaaccggttggtaccggtacgtaccggacacccgttactttcggtttaccg

SEQ ID NO: 427898 - DNA, 653 bp, Homo sapiens
  misc_feature: GZ8MTXP02I0FPI.9.50.E06.1.454.CMB.2.raw
  modified_base (203)..(203): a, c, t, g, unknown or other
  modified_base (241)..(241): a, c, t, g, unknown or other
  modified_base (288)..(288): a, c, t, g, unknown or other
  modified_base (308)..(308): a, c, t, g, unknown or other
  modified_base (418)..(418): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgctccgaggggaangccacctctcctgcagggccagtcagtagtcttagganctcttagcctggtatcaacagaacctggccaggcctccgaggctccnatctatgatgcatccaacgngggccacgtggacactcccagtccaggttcccaggtcggctagggtggtacgtggggacagtaccttcgactctacaccatcgacgcagactagacgcctagtaacgttnttttagacgttaagttttaacttacgttgtacgtaagcgtacgggtacgtaacgaccgtaaaccggtccggggtacccgttaccgggggtaaccgtttacccgggggaacccggtaaaacgggggaaaccccgtaaaaggggtccgggaaaactaacgttacggaaaacgcccggtaaaacgtggttaacggggccttacgggaccctaaacccggtttacgtttaccgtttacg

SEQ ID NO: 427899 - DNA, 647 bp, Homo sapiens
  misc_feature: GZ8MTXP02FQJHP.9.50.E06.1.454.CMB.2.raw
  modified_base (205)..(205): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaanagccaccctctcctgcagggccagtcagagtcttaggagctcctagcctggtatcaacagaaacctggccaggcctcccgaggcctcctcatctatgatgacatacccaagacgggccacgtggaccactccccgagccctagggtttcccaggttcggacgtaggggttcggggtaccgttagggggaccaaggtacctttaccgaccttcctaccaccctatccaagccaaagtacctaaggacgtaccctaggtaaagttagttttgaccttagttttaattacgttggtacacgtcaggtacgtagacgtaacgtcgggtacccgtcgggtaaccgttccgggaacccgtaaacggggaaccgtaaaggtacggaacaacgtaccgaaaggacgtaaacgtggttaacggcgttacggacctaccgatttccgttacg

SEQ ID NO: 427900 - DNA, 602 bp, Homo sapiens
  misc_feature: GZ8MTXP02F6WDX.9.50.E06.1.454.CMB.2.raw
  modified_base (206)..(206): a, c, t, g, unknown or other
  modified_base (244)..(244): a, c, t, g, unknown or other
  modified_base (294)..(294): a, c, t, g, unknown or other
tcagtgatacgtctcacgaccggtgctcgatttagatctactgacaacacacaagggggaggaactgctcagttaggacccagagggaaccatggaagcccccagctcagcttctcttcctcctgctactctggctcccagattccaccggagaagttgtgttgacacagtctccagccaccctgtctttgtctccgaggggaaangcccaccctctcctgcagggccagtcagagtcttaggnctcttagcctggtatcaacagaaacctggccaggcctacccgagcctccncatctatgatgcatccaacgcgggcccacgtggcactccccgagcccgtaggttacccaggtggacagggttcggggtctaggggacaggtaccttcaaccttctaccaccatacagccaaggaacctagacgaccgtagtaaacgttattttgacttaaggttttacttactggtacagcaacggtcgtaagctaacgtcggtaccggccggtaccggtacgggaccaaaacgggggtaccaaaggtcggaaacacgtaacaaacgtcgaaacgtggtaccggcgtaccgactacgtacttcgtacg

SEQ ID NO: 427901 - DNA, 636 bp, Homo sapiens
  misc_feature: GZ8MTXP02JQ9DZ.9.50.E06.1.454.CMB.2.raw
  modified_base (139)..(139): a, c, t, g, unknown or other
  modified_base (202)..(202): a, c, t, g, unknown or other
  modified_base (297)..(297): a, c, t, g, unknown or other
  modified_base (303)..(303): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccngattccaccggagaagttgtgttgacacagtctccagccaccctgtcttgtctccgagggaancgccaccctctcctgcagggccagtcagagtcttaggacgctccttagccttggtactcaacagaaacctggccaggcctcccaggcctccctantactgngatcgactactaccacggacgccagtcgactaccgacgcgacgtacgtacgtaggcgtagtcggggtcggtccggagggtacctacgttacgtacctacgtcctacaaaccgttctacgacgtacgacgtaacgtacgactacgggggggtaactaaggtttagttacgttacgtttaacgtttacgttacgttcgtacgacgtacgacgtacgtacgtaccgtacggtaccggtccggtaccggtaccggtacggaaccggtaacggaaacgtacggaaacgtacgacgacgacgaacgtacgtgacgtcgacgacctacacttcgaaaccg

SEQ ID NO: 427902 - DNA, 565 bp, Homo sapiens
  misc_feature: GZ8MTXP02JOMY5.9.50.E06.1.454.CMB.2.raw
  modified_base (204)..(204): a, c, t, g, unknown or other
  modified_base (213)..(213): a, c, t, g, unknown or other
  modified_base (290)..(290): a, c, t, g, unknown or other
  modified_base (307)..(307): a, c, t, g, unknown or other
  modified_base (346)..(346): a, c, t, g, unknown or other
  modified_base (352)..(352): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccacctntcctgcagggccagtcagagtcttaggagctcttagcctggtatcaacagaaacctggccaggctcccaggctcctnatcatgatgcatccaangggccatggcatccagccaggttccagtgcaggtggtcngggacngacttcatctcacatcagcagactagacgtctagaagttatttgacttaagtttacttacgtgtcagacagtacgagaccgtaacgtcggtccacgggtaccgtaccggaacccgtaaaggggtaaacccgaaaggtcgggaaaactacgtaacggaaaaccggaccgtaaaacgttggacgggttactacgtaccacccgtaagttcttacg

SEQ ID NO: 427903 - DNA, 568 bp, Homo sapiens
  misc_feature: GZ8MTXP02FJH1B.9.50.E06.1.454.CMB.2.raw
  modified_base (204)..(204): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggcctcccgaggcctcctcatctatgatcgcatccaaacgacgggccacgtggccactccccagccctaggttcccagtcggcgaggtggggctggggacaggtacttcgacctctcaaccatcagacagactagacgcctagaagtatttgacttatttaagtactgtcagtcagtcgtacgctaacgtcggtacctcggtacgttccggaccgaaaacggggacccgaaaggtacggaactaatacgaaacgacgaaacgtggtaggaccgtcgacctacgacgtctacg

SEQ ID NO: 427904 - DNA, 603 bp, Homo sapiens
  misc_feature: GZ8MTXP02G5ASS.9.50.E06.1.454.CMB.2.raw
  modified_base (205)..(205): a, c, t, g, unknown or other
  modified_base (382)..(382): a, c, t, g, unknown or other
  modified_base (407)..(407): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaancgccaccctctcctgcagggccagtcagagtcttaggagtctccttagccttggtactcaaacacgaaacctgggccaggcctcccgaggcctcctcatctatgatcgacactacccaaagcgggtaccacgtgctacgtccagcctaggtccaggtgcagggtcggtctcgggacncgtacttcgacttcgtaccacctanacacgacaacgacgtagacgtacgtaggtaagttcgtttacgacgtttagtttactacgtacgtacgacgtacggtacgtaccgaacgtacctacggtccggtccggtacggtaccggtacggaaccggtaaacggaacgtaggacgaagtacgtaacgacgacgtagtggtcgtcgacacctacgtcgttactcg

SEQ ID NO: 427905 - DNA, 706 bp, Homo sapiens
  misc_feature: GZ8MTXP02HU38I.9.50.E06.1.454.CMB.2.raw
  modified_base (297)..(297): a, c, t, g, unknown or other
  modified_base (372)..(372): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgctccgaggggaaagagcccaccctctcctgcagggccagtcagagtcttaggagctcttagcctggtatcaacagaaacctggccaggctccaggctcctcatctangatgcatcccaacgacgggccagtcggcatccccgagcctaggttccccaggttcggactagggttggggttccnggggacctaggtacctttccaccttacctccaaaccctataccgacggccaaacggtactaacggacgtcccgttaagggtaaagtttacgtttttagaccgttaaagggttttttaaattttacccgttaggtttaccagggtaccctagggtacccgttagaccgtaaacgtttcggggcccttaccgggggaacgtttccggggaacccgaaaacgggggtaaccccgtaaaagggtacggaaccggtaaattcgtaaaacgggaccgtaaacggtttcgggacggtaaccggttcgggaacccgtaaccctaagttttacccgtttaccg

SEQ ID NO: 427906 - DNA, 546 bp, Homo sapiens
  misc_feature: GZ8MTXP02HAKR9.9.50.E06.1.454.CMB.2.raw
  modified_base (203)..(203): a, c, t, g, unknown or other
  modified_base (260)..(260): a, c, t, g, unknown or other
  modified_base (293)..(293): a, c, t, g, unknown or other
  modified_base (306)..(306): a, c, t, g, unknown or other
  modified_base (356)..(356): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctccagattccaccggagaagttgtgttgacacagtctccagccaccctgtctttgtctccaggggaaangccaccctctcctgcagggccagtcagagtcttaggagctcttagcctggtatcaanagaacctggccaggctccaggctcctcatctangatgcatccaagngggccacgtggcagtcccagcctagtcccagtgacaggtgggctagggcngtactcgactctcaccatccagcagtacagacgacctagaagtatttgactagtttatactgtcagtcagcgtaagctaagtcggcctcggacgttcggaccgaaacgggaccctaaaggtcgaacgaacgtacgaaacgtaccggtaaacgttcggacggttaacgtcggacgaccctacgttacttcg

SEQ ID NO: 427907 - DNA, 515 bp, Homo sapiens
  misc_feature: GZ8MTXP02HZ7J4.9.50.E06.1.454.CMB.2.raw
  modified_base (313)..(313): a, c, t, g, unknown or other
  modified_base (369)..(369): a, c, t, g, unknown or other
tcagtgatacgtctcacgaccggtgctcgatttagatctactgacaacacacaagggggaggaactgctcagttaggacccagagggaaccatggaagcccccagctcagcttctcttcctcctgctactctggctcccagattccaccggagaagttgtgttgacacagtctccagccaccctgtctttgtctccaggggaaagagcccaccctctcctgcagggccagtcagatcttaggagctccttagcctggtatcaacagaaacctggccaggcctcccaggctcctcatctatgatgacatccaangggccatggcatccagcaggttccagtggcaggtggtctgggcagacttcacttcncactatcagcagactagacgctagaagtatttgcttagttattactgtcagtcagtctagcaacgtgctacggacgtcgacgaacggaccgaaagtcggaacactacgaaaacgcgaacgtggtacggctcgactaccacttcgtg

SEQ ID NO: 427908 - DNA, 619 bp, Homo sapiens
  misc_feature: GZ8MTXP02FUZGS.9.50.E06.1.454.CMB.2.raw
  modified_base (206)..(206): a, c, t, g, unknown or other
  modified_base (488)..(488): a, c, t, g, unknown or other
tcagtgatacgtctcacgaccggtgctcgatttagatctactgacaacacacaaggggggaggaactgctcagttaggacccagagggaaccatggaagccccagctcagcttctcttcctcctgctactctggctcccagattccaccggagaagttgtgttgacacagtctccagccaccctgtctttgtctccgaggggaaangccacctctcctgcagggccagtcagagtcttaggagctccttagcctggtatcaacagaaacctggccaggcctcccaggcctcctcatctatgatgacatccaacgcgggcccacgtggccactccccgaagtccccgtaggtttccaaggtgggacgtaaggggttcggggtcgtaggggacaggtaccttcaacccttctaccacctatccgaagccaaggaacctaaggacgtaccgtaggtaaagttattttcgacttagttttactacgtgtacngtactaggcgtaacgcgtaacgtcggtccgtacgggtacggtccggaaccggtaaagggaaccctaaagggtacgaacacgtacgaacgtaccggtaagtggtacggctacggacctacgtacttcgttcg

SEQ ID NO: 427909 - DNA, 611 bp, Homo sapiens
  misc_feature: GZ8MTXP02HOUL5.9.50.E06.1.454.CMB.2.raw
  modified_base (207)..(207): a, c, t, g, unknown or other
  modified_base (236)..(236): a, c, t, g, unknown or other
  modified_base (245)..(245): a, c, t, g, unknown or other
  modified_base (271)..(271): a, c, t, g, unknown or other
  modified_base (290)..(290): a, c, t, g, unknown or other
tcagtgatacgtctcacgaccggtgctcgatttagatctactgacaacacacaagggggaggaactgctcagttaggacccagaggggaaccatggaagccccagctcagcttctcttcctcctgctactctggctcccagattccaccgggagaagttgtgttgacacagtctccagccaccctgtctttgtctccgaggggaaangcccaccctctcctgcagggccagtcagngtcttaggnctcttagcctggtatcaacagaaccngccaggctcccagcctccnatctatgatgcactaccaacgcgggccaacgtggcactcccgagcctaggttcccaggtcggactggtcggggtctaggggactacgacttcgaccttcctcaaccgtatcaagcaagaccagaccgcctagaacgttatttcgacttagtttattactcgagttagaccgttaaggacccgagtacccgtaaacgggtcggtccccgtaggggtaacccgggttcggaaccggtaacgggaaaacccgtaaaaggccggaaacaagttaccgaacgaacgttaaccgtgggcggtactacgacgacctacgtcgtttacg

SEQ ID NO: 427910 - DNA, 479 bp, Homo sapiens
  misc_feature: GZ8MTXP02JGS4A.9.50.E06.1.454.CMB.2.raw
  modified_base (203)..(203): a, c, t, g, unknown or other
  modified_base (240)..(240): a, c, t, g, unknown or other
  modified_base (308)..(308): a, c, t, g, unknown or other
  modified_base (371)..(372): a, c, t, g, unknown or other
  modified_base (374)..(375): a, c, t, g, unknown or other
  modified_base (377)..(377): a, c, t, g, unknown or other
  modified_base (379)..(379): a, c, t, g, unknown or other
  modified_base (386)..(386): a, c, t, g, unknown or other
  modified_base (393)..(393): a, c, t, g, unknown or other
  modified_base (403)..(403): a, c, t, g, unknown or other
  modified_base (405)..(405): a, c, t, g, unknown or other
  modified_base (407)..(407): a, c, t, g, unknown or other
  modified_base (409)..(409): a, c, t, g, unknown or other
  modified_base (452)..(452): a, c, t, g, unknown or other
  modified_base (462)..(462): a, c, t, g, unknown or other
  modified_base (464)..(464): a, c, t, g, unknown or other
  modified_base (469)..(469): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgctccaggggaaangccacctctcctgcagggccagtcagagtcttagganctccttagcctggtatcaacagaaacctggccaggctcccaggctcctcatctatgatgacatccaanagggccactggcatcccagccaggtccccagtgcagtggtctgggcagtcttcactcgcacannannananagagcanagtattnctattatatntnananagagtagacacgtgcgcgacgtcgacgacgacgaagacgacanacacgagagngngcgcncacacactcg

SEQ ID NO: 427911 - DNA, 617 bp, Homo sapiens
  misc_feature: GZ8MTXP02JUXE3.9.50.E06.1.454.CMB.2.raw
  modified_base (204)..(204): a, c, t, g, unknown or other
  modified_base (241)..(241): a, c, t, g, unknown or other
  modified_base (313)..(313): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttaggngctcttagcctggtatcaacagaacctggcccaggcctcccgaggcctcctcatctatgatgcatccaaacncgggcccacgtggacactccccagccaggttcccagtcggctaggtgggtctggggacaggtacctttcgacttcacacctatcagcagtactagacgtactagaagttactttagacttaagttttatacgttgtacgagacgacggtacgtacgacctaacggtcggtaccgtcgggtaccgtaccgggaaccgtaaacgggaacccgtaaagggtacggaaccgaacgtaaacccggaacggtaacccgtaaggttcgggtacggtaccgtacggaccctaccggttaactccgtttaccg

SEQ ID NO: 427912 - DNA, 654 bp, Homo sapiens
  misc_feature: GZ8MTXP02GP2W5.9.50.E06.1.454.CMB.2.raw
  modified_base (245)..(245): a, c, t, g, unknown or other
  modified_base (289)..(289): a, c, t, g, unknown or other
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaagacgccaccctctcctgcagggccagtcagagtcttagganctcctagcctggtatcaacagaactggccaggctccagctcctnatctatgatgacatacccaaagcgggaccacgtcggacactccccagacctaggttccaggtcggacgtagggtcgggtaccgaggggacctaggactttccaaccttcgaccaaccatcgaagacaacggtaaacctaggacgtaccgtagtaaaggttatttggacttaaggttttacttaacgtgtaccagccgaaggtcgtaacgacctaacgtcgggtacccgtacgggtaccggttacggaacccggtaaaacggggtaaacccaaaggggttacgggaaacttacggtaaccgaaacggtaacccgaaaacgttgggttacggacctacggaccctaaccgtaaggtttcccttaacg

SEQ ID NO: 427913 - DNA, 521 bp, Homo sapiens
  misc_feature: GZ8MTXP01D4NT6.22.25.C03.1.454.CMB.2.raw
  modified_base (200)..(200): a, c, t, g, unknown or other
tcagacatacgcgtcacgaccggtgctcgatttagtagtgtagatttgggtttggggcaggagtcagacccagtcaggacacagcatggacatgagggtccccgctcagctcctggggctcctgctgctctggctcccaggtgccaaatgtgacatccagatgacccagtctccttccaccctgtctgcatctgtagganacagagttaccatcacttgccggcagtcagagtattagtgtctgggtggcctggtatcagcagaaaccagggaaagcccctaaggtcctgatctatgaggcagtctactttaaaaactggtagtcccatcaaggtttccagcgcagtggaatctgggacagaattcactctcgcatcagcagctgcagcctgactgattctgacgtaacttattactgaccaactagttattacgtagttagtcgggggtacttcggaacaaagggaccaaagggttgaaattcgaaacgacgttgtggcttggcacgatcgttgttaacc

SEQ ID NO: 427914 - DNA, 529 bp, Homo sapiens
  misc_feature: GZ8MTXP01B9CX5.22.25.C03.1.454.CMB.2.raw
  modified_base (319)..(319): a, c, t, g, unknown or other
  modified_base (402)..(402): a, c, t, g, unknown or other
  modified_base (414)..(414): a, c, t, g, unknown or other
  modified_base (429)..(429): a, c, t, g, unknown or other
tcagacatacgcgtcacgaccggtgctcgatttagtagtgtagatttgggtttggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggcagtcagagtattagtgtctgggtggcctggtatcagcagaaaccagggaaacgcccctaaggtcctgatctatgaggcatctaactttaaaacngtgtcccatcaaggttccagcggcagtggaatcgtgggacagaattcactctcgccatcagcagcctgcagcctgatgattcngactaaactttnttactgaccctaaanagttattataggttagtacgggggactttcgggaacctaaagggaccgaaaggttggaaatcgaaacgttattggtgggactgcaccttatcgttgttcc

SEQ ID NO: 427915 - DNA, 624 bp, Homo sapiens
  misc_feature: GZ8MTXP01BZYI1.22.25.C03.1.454.CMB.2.raw
  modified_base (261)..(261): a, c, t, g, unknown or other
  modified_base (471)..(471): a, c, t, g, unknown or other
tcagacatacgcgtcacgaccggtgctcgatttagtagtgtagatttgggtttgggggcaggagtcagacccagtcaggacacagcatggacatgagggtcccgctcagctcctggggctcctgctgctctggctcccaggtgccaaatgtgacatccagatgacccagtctccttccaccctgtctgcatctgtaggagacagagttaccatcacttgccgggccagtcagagtattagtgtctggggtggccctggtancagcaagaaaccgagggaaacaccccgtaaggtcctagatctatggaggactacttacttaaactttaaaacgtggttacgtacccatacgtaacggttccaggcggacgtaggtaggaattcggtgggaacaagtaacttcactctccgaccatcagcacgcctgacacgtcctggactgtacttcgtagaccttaaactttatttacncgaaccctaaagtagttaattagttaggttacggggtacgggggttacggttccggaacggaaacggggaaccgtaagggttaacgtaaaacttaacgaaaaccgttacgttggtaacggcgtggacccacttacgttccgttcgtttaaccc

SEQ ID NO: 427916 - DNA, 685 bp, Homo sapiens
  misc_feature: GZ8MTXP01DHAR9.22.25.C03.1.454.CMB.2.raw
  modified_base (201)..(201): a, c, t, g, unknown or other
  modified_base (257)..(257): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtagganacagagttaccatcacttgccggcagtcagagtattagtgtcgtgggtgctggtancagcaagaaaccgagggaaacgcccctaaggtcctgatctatgaggactattacttaaactttaaaaactggtacgtaccctaatacgtaaacggttccaggcggacgtaggtaggaaagttcgtggggaactaaggtaaactttccaaccttctaccgaccctaataccaacggccaacggcccttggaccacggtccctaggacttgtaactttctacgtaccttaaactttaactttaccacgtaacccctaaagtagttaatttaagttaaggttaacgggtaccgggggttaacgttacccgggaaccggtaaacgggggttaacccgtaaaaggggttaacggaaaaacgttaaccgaaaaacgttaacgttagggttcgggaccttaacggtacccaaccttacttccgttcgtttaaccc

SEQ ID NO: 427917 - DNA, 513 bp, Homo sapiens
  misc_feature: GZ8MTXP01EDFDJ.22.25.C03.1.454.CMB.2.raw
  modified_base (239)..(239): a, c, t, g, unknown or other
  modified_base (385)..(385): a, c, t, g, unknown or other
  modified_base (387)..(387): a, c, t, g, unknown or other
  modified_base (390)..(390): a, c, t, g, unknown or other
  modified_base (396)..(396): a, c, t, g, unknown or other
  modified_base (402)..(402): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagattacaatcacttgccggcagtcagagtattagngtctgggtggcctggtatcagcagaaaccagggaaagcccctaaggtcctgatctatgaggcatactactttaaaaactggtagtcccatcaaggttccagcgcagtggaatctgggacagaatcactctcgccatcagcagtccngnacnctgatntatctnacgtacttatactacacactatattatagtagtacgggtacgtcggaacgaacggacgtaaggttaagtaaagtaacgaacgacgttagtgtcgtcgcacactcgttcgtc

SEQ ID NO: 427918 - DNA, 562 bp, Homo sapiens
  misc_feature: GZ8MTXP01DVTOO.22.25.C03.1.454.CMB.2.raw
  modified_base (260)..(260): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggcagtcagagtattagtgtcgtgggtggcctggtancagcagaaacagggaaacgccccgtaagtcctgatctatgaggcatactaactttaaaactggtgtccatcaaggttccagcggcagtggaatctggggacagtaattcactctcgccatcagcagcctgacagcctgatgattctagactaaactttattacctacgacctaaacagttaattaagttagttaggtacgggggtacgttccggaaccggtaagggaaccgtaaagggttacggaaaatacgaaaacgttacgttacggtaaggactcggacaccttactcttcggttaacc

SEQ ID NO: 427919 - DNA, 528 bp, Homo sapiens
  misc_feature: GZ8MTXP01CN9WS.22.25.C03.1.454.CMB.2.raw
  modified_base (258)..(258): a, c, t, g, unknown or other
  modified_base (431)..(431): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccggcagtcagagtattagtgtctgggtggcctggtancagcagaaacagggaaagcccctaaaggtcctgatctatgaggcatactaactttaaaaactgtgtcccatcaagttccagcgcagtggaatcgtgggacagaaattcacgtctcgccatcagcagcctgcagcctgatgattctagactaaactttattactagacctaaanagttattatagttagtcggggacgttcggaacgtaaagggacgtaaaggttaggaaaatcgaaaacgttacgttgtggactgcaccatcgttgttcc

SEQ ID NO: 427920 - DNA, 536 bp, Homo sapiens
  misc_feature: GZ8MTXP01BQ5ZQ.22.25.C03.1.454.CMB.2.raw
  modified_base (415)..(415): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccggcagtcagtagtattagtgtctgggtggcctggtatcagcagaaaccagggaaacgcccctaaaggtcctgatctatgaggcatctaactttaaaaactggtgtcccatcaaggttcagcgcagtgaatctgggacagaatcactctcgcatcagcagctgcagcctgatgattctgctaaacttatttacncgaccaaactagtattatagttagtcgggggtacgttcggaaccgaaagggaccgaaagggttggaaaacgtacgaaaacgaacgttggtaaggcttaacgctaccatccgttgtttaacc

SEQ ID NO: 427921 - DNA, 526 bp, Homo sapiens
  misc_feature: GZ8MTXP01AS5XP.22.25.C03.1.454.CMB.2.raw
  modified_base (428)..(428): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcaagaaaccagggaaagccccctaaaggtcctgatctatgaggcatactaactttaaaaactggtagtcccatcaaaggttccaagcggcagtggaaatcgtgggacagaattcactctcgccatcagcagcctgcagcctgatgattctgcctaaattatactnaccaatagtattatagttagtacgggggtacttcgggaaccaaagggaccaaaggttaggaaatacaaaacgattggtggctgacaccatccgttgtc

SEQ ID NO: 427922 - DNA, 551 bp, Homo sapiens
  misc_feature: GZ8MTXP01B6TYT.22.25.C03.1.454.CMB.2.raw
  modified_base (278)..(278): a, c, t, g, unknown or other
  modified_base (416)..(416): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagttaccatcacttgccggcagtcagagtatagtgtctgggtggcctggtatcagcagaaaccagggaaacncccctaaggtcctgatctatgaggcatctactttaaaaactggtgtccatcaaggttcaggcggcagtggaatcgtgggacagattcactctcgcatcagcagcctgcagctgatgattcagtctaaactttattacngaccaactagttacttaagtgttaggtcgggggacgtttcggaaccgtaaggggaacccaaagggttaggaaaactcgaaaacggaaccttgggttcggacttcggaccaccgttacttccgttcgtttaacccg

SEQ ID NO: 427923 - DNA, 531 bp, Homo sapiens
  misc_feature: GZ8MTXP01DW3HZ.22.25.C03.1.454.CMB.2.raw
  modified_base (261)..(261): a, c, t, g, unknown or other
  modified_base (404)..(404): a, c, t, g, unknown or other
  modified_base (421)..(421): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccggccagtcagtagtattagtgtcgtgggtggcctggtancagcagaaaccagggaaacgcccctaaggtcctgatctatgaggacatactaactttaaaaactggtacgtacccatcgaaggttccaggcggcgaggtggaatcgtgggacagtaaacttcactctcgccatcagcagtccngacagcctgatgattcngactaacttatactgaccaatagtattagtagttagtacggggtacgtcggaacgtaaagggaccaagggttagaaatacaaacgacttgtggctgacacatcgttgtcc

SEQ ID NO: 427924 - DNA, 571 bp, Homo sapiens
  misc_feature: GZ8MTXP01CE90E.22.25.C03.1.454.CMB.2.raw
  modified_base (201)..(201): a, c, t, g, unknown or other
  modified_base (320)..(320): a, c, t, g, unknown or other
  modified_base (404)..(404): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtagganacagagttaccatcacttgccggcagtcagagtattagtgtcgtgggtggcctggtatcagcagaaaccagggaaacgcccctaaggtcctgatctatgaggcatctaactttaaaacnggtgtcccatcaaggttcagcggcagtggaatcgtgggacagaacttcactctcgccatcagcagcctgcagcctgatgattcngtactaactttattacctgaccctaaactagttaatttaagtacggtttaaggtaccggggggtacgtttacgggaacccggtaaaggggaccgtaaagggttaggaaaactccgaaaaacgttaccgttggtaacggtactggaccacttatccgttcgttaaccc

SEQ ID NO: 427925 - DNA, 516 bp, Homo sapiens
  misc_feature: GZ8MTXP01EJ1S4.22.25.C03.1.454.CMB.2.raw
  modified_base (259)..(259): a, c, t, g, unknown or other
  modified_base (497)..(497): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggcagtcagagtattagtgtctgggtggcctggtancagcagaaaccagggaaacgcccctaaggtcctgatctatgaggcatactaactttaaaatggtagtcccatcaaggttccaggcggcagtggaatcgtgggacagtaatcactctcgccatcagcagcctgcagcctgatgattctgtccccctaatttattactcgaccaactagttattattagtagtcggggtacgttcggaacgaaggacgaaggttgaaatacaacgattgnggctgcacgatcgttgttc

SEQ ID NO: 427926 - DNA, 596 bp, Homo sapiens
  misc_feature: GZ8MTXP01BMJEC.22.25.C03.1.454.CMB.2.raw
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttcgccgggccagtcagagtattagtgtcgtgggtggctggtatcagcaagaaaccagggaaacgccccgtaaggtcctgatctatgaggcatacttaactttaaaaacgtggtacgtacctatacgaaggttccaggcggcaggtggaatcgtgggacagtacttcactctcgcatcagcagcctgacagtcctgatgtaacttcgtgtactaaactttacttaacctgaaccctaagtaagttatttaagttacggttagggtacgggggtaccgttcgggaaccggtaaacggggaaccgtaaaggggttaacgaaaacgttacgaaaacggttacgttggtaacggcttcgacctacttattccttaacgtttcc

SEQ ID NO: 427927 - DNA, 562 bp, Homo sapiens
  misc_feature: GZ8MTXP01EOEFU.22.25.C03.1.454.CMB.2.raw
  modified_base (202)..(202): a, c, t, g, unknown or other
  modified_base (243)..(243): a, c, t, g, unknown or other
  modified_base (260)..(260): a, c, t, g, unknown or other
  modified_base (401)..(401): a, c, t, g, unknown or other
  modified_base (414)..(414): a, c, t, g, unknown or other
  modified_base (416)..(416): a, c, t, g, unknown or other
  modified_base (421)..(421): a, c, t, g, unknown or other
  modified_base (424)..(424): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtcctccttccaccctgtctgcatctgtagganacagagttaccatcacttgccggcagtcagtagtatttagngtcgtgggtgctggtancgagacaagaaaccgagggaaacgcccctaaggtcctagatctagtgagactattacttaaactttaaaaacgtggtacgtaccctatacgaaaggttcccaggcggagtagtggaatcgtgggacaagtaattcacttcncgacatcagcacncnacacnctnatatatactatactaacttatactactactaatatattagtagtaggtacgggtacggtacggaacggtaacggaacgaaggttaagaaacgtaacgaaacgttacgttacgtgtcgtcgactacttactcgttcgtc

SEQ ID NO: 427928 - DNA, 543 bp, Homo sapiens
  misc_feature: GZ8MTXP01AF0C8.22.25.C03.1.454.CMB.2.raw
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcaagaaaccagggaaacgcccctaaggtcctgatctatgaggcatactaactttaaaactggtagtccatcaaggttccagcggcagtggaatcgtgggacagattcactctcgccatcagcagcctgcagcctgatgattctgactaaactttattactcgaccaactagttaattagtaggttacggtcgggggtacgttcgggaaccgaaggggaccgaaagggttaggaaaactacgaaacgaacgttggtggctggccaccgttatcgttgttcc

SEQ ID NO: 427929 - DNA, 758 bp, Homo sapiens
  misc_feature: GZ8MTXP01BNPS5.22.25.C03.1.454.CMB.2.raw
  modified_base (200)..(200): a, c, t, g, unknown or other
  modified_base (254)..(254): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccacctgtctgcatctgtagganacagagttacatcacttgccggcagtcagagtattagtgtcgtgggtgctgtancagacagaaacgagggaaacgccccgtaaggtcctgatcgtatgagactattacttaactttaaaacgtggtacgtaccctagtacgtaacggttccacggtcggacgtaggtaggtaaacgttacggttaacggggaaactaaaggtaaccgtttacctaccgttacccgtaccggaccctaacgtacccgaaggtacccgaacggtccccgttacggacccgaaccgtcccgttaagtacgttacgtaactttaccgtacgttaaccgttaaaacgttttacgttaacctacggtaacccctaaaacgttaaggtttaaactttaaaggtttaacgggtttaacggggttacccggggggttaaaccggtttacccggggaaaccgggtaaacgggggaaaccggttaaaggggttaaacggtaaaacgttaaccgaaaaacggttacggttaggtaacggtcgttaacggacctaaccgttcgtttccgttcgtttaaccc

SEQ ID NO: 427930 - DNA, 641 bp, Homo sapiens
  misc_feature: GZ8MTXP01BGS4X.22.25.C03.1.454.CMB.2.raw
  modified_base (264)..(264): a, c, t, g, unknown or other
  modified_base (393)..(393): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagttaccatcacgttcgccgggcagtcagtagtattagtgtcgtgggtggcctggtancagacaagaaaccgagggaaacgccccgtaaggtcctgatctagtgagactatactaaactttaaaacgtggtactaccatacgaaggttccaggcgcgaggtgaactcgtgggactaagtatcactcncgacactcgacgcacgcctgaccgacgtcctaggatacgtacttactcgtaacttaaactttacttacgtactaccctaaagttagttaagtttacgttacggttacgggggtacgggggtacccgggtttaccggggaaccggtaaaacgggggttaaccgtaaaagggggttacgaaaacgtaacccgaaaacggttaccgttagggaacgtcgtaacggacctacgttacttcttcggtttaacc

SEQ ID NO: 427931 - DNA, 578 bp, Homo sapiens
  misc_feature: GZ8MTXP01CCUC3.22.25.C03.1.454.CMB.2.raw
  modified_base (402)..(402): a, c, t, g, unknown or other
tcagacatacgcgtcacgaccggtgctcgatttagtagtgtagatttgggtttggggcaggagtcagacccagtcaggacacagcatggacatgagggtcccgctcagctcctggggctcctgctgctctggctcccaggtgccaaatgtgacatccagatgacccagtctccttccaccctgtctgcatctgtaggagacagagttaccatcacttgccgggcagtcagagtattagtgtctgggtgcctggtatcagcaagaaaccagggaaacgcccctaaggtcctgatctatgaggcatctaactttaaaactggtagtccatcaaggttccaggcgcagtggaatcgtgggacagaattcactctcgccatcagcagcctgcacgctgatgattcngactaaactttactactagaccctaaagtagttattaagtagttaggtaccgggggtacgtttacgggaacccgtaaaggggacccgtaaaggggttacgaaaaacgttccgaaaacggttacgttaggttaagggacttaacggacctaccgttaacgttccttcggtttaaccc

SEQ ID NO: 427932 - DNA, 600 bp, Homo sapiens
  misc_feature: GZ8MTXP01BN3Q7.22.25.C03.1.454.CMB.2.raw
  modified_base (375)..(375): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagttaccatcacttgccgggcagtcagagtattagtgtcgtgggtgcctggtatcagcaagaaaccagggaaacgcccctaaggtcctgatctatgaggcattactaactttaaaactggtcgtaccatcaaggttccaggcgcagtgaatcgtgggacagatcactcncgcatcagcagcctgacagcctgactgtattctgactaaactttattactgaccctaagtagttatttaagttaggttacggttaccgggggtacgtttccggggaaccgtaaacggggaccgtaaagggttacggaaaacgttaaccgaaaaacgggttaaccttgggttaacggccgttaacggaccctaacccggttaactttccgttaacggttttccccg

SEQ ID NO: 427933 - DNA, 544 bp, Homo sapiens
  misc_feature: GZ8MTXP01AH06W.22.25.C03.1.454.CMB.2.raw
  modified_base (260)..(260): a, c, t, g, unknown or other
  modified_base (523)..(523): a, c, t, g, unknown or other
  modified_base (535)..(535): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagttaccatcacttgccgggcagtcagatattagtgtcgtgggtggcctggtancagcaagaaaccgagggaaacgccccgtaaggtcctagatctagtgaggactatacttaaactttaaaacgtggtactacccatacgaaggttccaggcggcgagtggaatcgtgggacagtattcactctcgaccatcgagcacgcctgccagcctaggactgtattctacgactaactttatactacgacctaactagtattagtagttaggtcggggtacggtcgaacggaagggacgaaggagaaatacgaagttacgngtggctgctacntcgttgtcc

SEQ ID NO: 427934 - DNA, 612 bp, Homo sapiens
  misc_feature: GZ8MTXP01ADF7B.22.25.C03.1.454.CMB.2.raw
  modified_base (257)..(257): a, c, t, g, unknown or other
  modified_base (367)..(367): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccggcagtcagagtattagtgtgtgggtggctggtancagcaagaaaccgaagggaaacgcccctaaggtcctgatctatgagactatacttaactttaaaacgtggtacgtaccatacgaaggttccaggcggcgagtggaatcgngggacagtatcactctcgacatcagcagcctgcacgctgattgtacttctagtaccttaaacgtttacttacctacgtaacctaaacgttagtttaagtttaagttacggtttacggggtaccgggggttaacggttccgggtaaccggaaacggggttaaaccggtaaacggggttaaacggaaactaacggaaaacgttacggttggtcggtctcgacctaccgttacttcgttgtttaaccc

SEQ ID NO: 427935 - DNA, 569 bp, Homo sapiens
  misc_feature: GZ8MTXP01D4E75.22.25.C03.1.454.CMB.2.raw
  modified_base (280)..(280): a, c, t, g, unknown or other
  modified_base (534)..(534): a, c, t, g, unknown or other
  modified_base (545)..(545): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtcctccttccaccctgtctgcatctgtagagacagattaccatcacttgccggcagtcagagtattagtgtcgtgggtggctggtatcagacaagaaaccgagggaaacnccccgtaaggtcctgatctatgagctattacttaactttaaaactggtacgtcccatactaaggttcaggcggcgagtggaatcgtgggacagaattcactctcgccatcagcagcctgacacgtctagattcgatttctacgtactaaactttattacctcgaccctaaatagttaattaagttaggttagggtaccgggggtacgttcggaacggtaacgggaccgtaaagggttagaaactacgaaaacgngttaggtcggntaacgacaccttatccgttgttcc

SEQ ID NO: 427936 - DNA, 527 bp, Homo sapiens
  misc_feature: GZ8MTXP01AYTBI.22.25.C03.1.454.CMB.2.raw
  modified_base (201)..(201): a, c, t, g, unknown or other
  modified_base (393)..(393): a, c, t, g, unknown or other
  modified_base (505)..(505): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtagganacagagttaccatcacttgccgggcagtcagagtattagtgtctgggtggcctggtatcagcagaaaaccagggaaagcccctaaggtcctgatctatgaggcatactaactttaaaaactggtgtccatcaaggttccagcggcagtgaatctgggacagattcactctcgccatcagcagcctgcagccngatgaattctagactaactttattactgtacccaaatagttattatagttagtcggggtacgttcggaacgtaagggaccaaaggttgaaatacgaaacgacgttggtggcnggtacacttactccgttgttcc

SEQ ID NO: 427937 - DNA, 637 bp, Homo sapiens
  misc_feature: GZ8MTXP01BKEB1.22.25.C03.1.454.CMB.2.raw
  modified_base (202)..(202): a, c, t, g, unknown or other
  modified_base (257)..(257): a, c, t, g, unknown or other
  modified_base (277)..(277): a, c, t, g, unknown or other
  modified_base (290)..(290): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtcctccttccaccctgtctgcatctgtagganacagagttaccatcacttgccggcagtcagatattagtgtcgtgggtgctggtancagcaagaaacagggaaacnccccgtaagtccngatctatgagactatacttaaactttaaaagtggtactacccatacgtaacggttccaggcggacgagtggaacgtcgtggggacaagtaattccgactctcgaccatcgagcagcctgcgacgtctgattgtacttcgtacgtacttaaactttattaaccgtcgaacctaaacgttagttaagtttaagttaggtttaacggttaccgggggtaccgtttacgggaaccggaaaacggggttaacccgtaaaggggttaacggaaaacgtaccgttaaaaacggttaccggttaggttaacgggaccttaacgacctaaccttacgttcccgtttgtttaacccg

SEQ ID NO: 427938 - DNA, 731 bp, Homo sapiens
  misc_feature: GZ8MTXP01DBKDQ.22.25.C03.1.454.CMB.2.raw
  modified_base (261)..(261): a, c, t, g, unknown or other
  modified_base (338)..(338): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctccaggtgccaaatgtgacatccagatgacccagtcctccttccaccctgtctgcatcgtgtaggagacagagttacatcacgttgccggcagtcagagttattagtgtcgtgggtgtcctggtancagcaacgaaaccgagggaaacgccccgtaaaggtcctgatactagtgaggtctatacttaaaccttttaaaaacgnggttacgtaccctaatcgtaaacgggtttccaggtcggaccgtaggtggaacgttcgtaagggggaactaacgggtaaactttccgaaccttcgttaccggacccctatttaccgaacggtaccgacgggtcccttacggggacctaacgggtcccgttagggtaacttacggttaactttaccgttacggtaaccgttaaacttttaactttaaccggtacgtaaccctaaaccgttaagtttaacgtttaagttacggtttaacggggtcgggggttaccgtttacggggaaaccggtaaacgggaaccggtaaagggttaacggtaaaactacggaaaaccgttgttacggtgggactaacggctaccggttacttcgttcgtttaaccc

SEQ ID NO: 427939 - DNA, 822 bp, Homo sapiens
  misc_feature: GZ8MTXP01A4Y4O.22.25.C03.1.454.CMB.2.raw
  modified_base (257)..(257): a, c, t, g, unknown or other
  modified_base (277)..(277): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagtagttaccatcacttgccggcagtcagagtatagtgtcgtgggtgctggtancagcaagaaacgagggaacnccccgtaaggtcctagatctagtgaggactacttacttaaacctttaaaacgtcggttacgtacccctaagtacgtaaaggtttcccgaacgggcggtacgtagggtacggtaaacgttccgggtaacgggggtaaactaaacgggttaaactttccctaaccgttcccgttaccggaccctaacgttaccgaacgggccctaaccggcccgttcggacccgtaacgggtcccctttaagggactttacgtaccttttacgtaccgtaaacgttttaaaccgttttaactttaaccgtacccgggtaaaccccttaaacgttaaaggtttaaaccgttttaaagggttaacggggttttaaaccccgggggtaccgggggggggtttaaccccgtttaacccggggggaaacccgggtaaaacgggggttaaacccgggtaaagggggttaaacgggaaaaacctttaaccgggaaaacccggttagttacggggtaacgggtccttaacgggaaccctacggttacttccgtttcgttaacccc

SEQ ID NO: 427940 - DNA, 578 bp, Homo sapiens
  misc_feature: GZ8MTXP01EWCFB.22.25.C03.1.454.CMB.2.raw
  modified_base (279)..(279): a, c, t, g, unknown or other
  modified_base (323)..(323): a, c, t, g, unknown or other
  modified_base (344)..(344): a, c, t, g, unknown or other
  modified_base (359)..(359): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccggcagtcagagtattagtgtcgtgggtgcctggtatcagcagaaaaccagggaaacncccctaaggtcctgactctatgagcatctaactttaaaatggtntccatcaaggttccaggtcgnagtgaatcgtggganagatcactctcgcatcagcagcctgacacgcctagatgtaattctagaccttaactttattacctagacctaaactagttaattaagttaggttacgtacgggggtacgttccgggaaccgaacggggttaaaccgaagggttaggaaaacttaccgaaaacggttccgttagggtcgggacttaacggaccctaccagttcccggttttcgttaaccg

SEQ ID NO: 427941 - DNA, 553 bp, Homo sapiens
  misc_feature: GZ8MTXP01DX1EA.22.25.C03.1.454.CMB.2.raw
  modified_base (307)..(307): a, c, t, g, unknown or other
  modified_base (324)..(324): a, c, t, g, unknown or other
  modified_base (382)..(382): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagttaccatcacttgccggcagtcagagtattagtgtctgggtggctggtatcagcaagaaaaccgagggaaacgcccctaaggtcctagatctatgaggnatactaactttaaaacnggtgtaccatcaagttcagcggacagtgaatcgtgggacagtaatcgactctcgcatnagcagcctgacagcctagatgattctgacttaaactttattactacgacctaaacgtagttaattaagtagttaggtacgggggtacgttcggggaactaacgggaaccgaagggttaaggaaacttacgaaaacgttcttaggtggctgacacttactcttcgtttaacc

SEQ ID NO: 427942 - DNA, 535 bp, Homo sapiens
  misc_feature: GZ8MTXP01BRRYF.22.25.C03.1.454.CMB.2.raw
  modified_base (259)..(259): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggcagtcagagtattagtgtctgggtggcctggtancagcaagaaaccagggaaacgcccctaaggtcctgatctatgaggcatactaactttaaaactggtatccatcaaggtccaggcgcagtgaatcgtgggacagatcactctcgcatcagcagcctgcagctgatgatctgactaactttattactagaccaactagtattaagtagttagtcgggggacgttcgggaacgtaaagggaccgaaagggttagtaaaacgtacgaaaacgacgttaggtggctcggctaaccttactcgttgttaacc

SEQ ID NO: 427943 - DNA, 493 bp, Homo sapiens
  misc_feature: GZ8MTXP01CJDOH.22.25.C03.1.454.CMB.2.raw
  modified_base (344)..(344): a, c, t, g, unknown or other
  modified_base (402)..(402): a, c, t, g, unknown or other
  modified_base (421)..(421): a, c, t, g, unknown or other
  modified_base (459)..(459): a, c, t, g, unknown or other
  modified_base (473)..(473): a, c, t, g, unknown or other
  modified_base (489)..(489): a, c, t, g, unknown or other
tcagacatacgcgtcacgaccggtgctcgatttagtagtgtagatttgggtttgggggcaggagtcagacccagtcaggacacagcatggacatgagggtcccgctcagctcctggggctcctgctgctctggctcccaggtgccaaatgtgacatccagatgacccagtctccttccaccctgtctgcatctgtaggagacagagttaccatcacttgccgggcagtcagagtattagtgtctgggtggcctggtatcagcagaaaccagggaaagcccctaaggtcctgatctatgaggcatctaactttaaaaaactggtagtcccatctaaggttccagnggacagtgaatctgggacagaattcactctcgcatcagcagctgacagctgatgatcngcaacttatactgaccaanagtattatatagtcggggattcggcaagggaccaaggngaaatcaaacgacngtaaggctgcacatcngttc

SEQ ID NO: 427944 - DNA, 585 bp, Homo sapiens
  misc_feature: GZ8MTXP01D595R.22.25.C03.1.454.CMB.2.raw
  modified_base (202)..(202): a, c, t, g, unknown or other
  modified_base (259)..(259): a, c, t, g, unknown or other
  modified_base (423)..(423): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtcctccttccaccctgtctgcatctgtagganacagagttaccatcacttgccggccagtcagagtattagtgtcgtgggtgctggtancagcaagaaaccgagggaaacgcccctaaggtcctgatctatgaggctatactaaactttaaaactggtacgtacccatacgaaggttccaggcggacagtggaactcgtgggacagtaattcactctcgacatcagcagcctgacagcctgatgtattcgtanactaaactttactaactcgaacctaaagtagttatttaaagttaggttacggtaccgggggtacgttaccggggaacgtaaacggggaaccgtaaagggttaagaaacttaacgaaaacgttacgttggtggacctaagacctaccttattcgttcgttccc

SEQ ID NO: 427945 - DNA, 715 bp, Homo sapiens
  misc_feature: GZ8MTXP01BSRU3.22.25.C03.1.454.CMB.2.raw
  modified_base (202)..(202): a, c, t, g, unknown or other
  modified_base (262)..(262): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatcgacccagtcctccttccacctgtctgcatctgtagganacagacgttaccatcacttcgccgggcagtcagtagtattagtgtcgtgggtgctggtancagcaagaaaccgagggaaacgccccgtaaggtcctgatctagtgaggactacttacttaaacgttttaaaaacgtgggttactaccccgtaattaccgtaaacgggtttaccacggggtaccgggtacgtaggggttacgggtaacttacggtaacgggggaaactaaagggttaactttaccctaccgttaccgtaccgacccaacgttcaacgggacccaacggtcccgtggacccgtacggtacccgttaggtaacttcgttaactttcgtacgtaactttaaacgtttactttaaccgacttaacccggtaataagtttaattaacggtttacgggttacgggtaccgggggttaccgttcggggaaaccggtaacgggacggtaaagggttacgaaacgtacgaaaacggttcgttaggtcgcgtcgacaccgttatcgttcgttcc

SEQ ID NO: 427946 - DNA, 619 bp, Homo sapiens
  misc_feature: GZ8MTXP01ELZFY.22.25.C03.1.454.CMB.2.raw
  modified_base (203)..(203): a, c, t, g, unknown or other
  modified_base (260)..(260): a, c, t, g, unknown or other
  modified_base (404)..(404): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatcgacccagtcctccttccaccctgtctgcatctgtagganacagtattaccatcacttcgccggcagtcagagtattagtgtcgtgggtgctggtancagacaagaaaccgagggaaacgccccgtaaggtcctagatctagtgagactattacttaactttaaaacgtggtacgtacccatacgtaaggttccaggcgagtaggtggaatcgtgggactaagtactcactctcgacctancacgcacgcgtgactacgtctagtatgtacttactacgtaacgttaactttacgttactacgtaactaagttagtttaagtttacggttacggttacggggtaccggggtaaccggtacgggaaccggtaaacgggttaacggtaaacgggttaagtaaacgtaacgaaacggttcgttacggtcggtctcgacctacttacttccgttcgttcc

SEQ ID NO: 427947 - DNA, 535 bp, Homo sapiens
  misc_feature: GZ8MTXP01BLTWZ.22.25.C03.1.454.CMB.2.raw
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccggcagtcagagtattagtgtctgggtggcctggtatcagcagaaaccagggaaagcccctaaggtcctgatctatgaggcatctactttaaaactggtagtcccatcaaggttcagtcggcagtgaatctgggacagattcactctcgccatcagcagcctgcagcctgatgattctgactaaactttattactgacctaaacaggttattaatagttagtacgggggtacgttcgggaacctaaaggggaccaaagggttgggaaaacttcgaaaaccgattagtgggcctggccacatcgttgtttaaccc

SEQ ID NO: 427948 - DNA, 536 bp, Homo sapiens
  misc_feature: GZ8MTXP01E1ID8.22.25.C03.1.454.CMB.2.raw
  modified_base (371)..(371): a, c, t, g, unknown or other
  modified_base (393)..(393): a, c, t, g, unknown or other
  modified_base (403)..(403): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccggcagtcagtagtattagtgtctgggtgcctggtatcagcagaaaccagggaaacgcccctaaggtcctgatctatgagcatactactttaaaactggtactccatcaaggttcaggtcgcagtgaatcgtgggacagaattcacttcncgcatcagcagcctgacagtcngatgtattcngactaactttatactgacaactagtattagtacggttaagcgggggtactcgggaacaacgggaccgtaaggttggaaaactacgaaaacgttccgttggcggcttaacggactaccacttcttcgtttaacc

SEQ ID NO: 427949 - DNA, 661 bp, Homo sapiens
  misc_feature: GZ8MTXP01CZZKN.22.25.C03.1.454.CMB.2.raw
  modified_base (106)..(106): a, c, t, g, unknown or other
  modified_base (338)..(338): a, c, t, g, unknown or other
tcagacatacgcgtcacgaccggtgctcgatttagtagtgtagatttgggtttgggggcaggagtcagacccagtcaggacacagcatggacatgagggtccccgntcagctcctggggctcctgctgctctggctcccaggtgccaaatgtgacatccagatgacccagtcctccttccacctgtctgcatctgtaggagacagtacgttacatcacttcggccgggaccagtcagtagttattaggtgttcgtggggtggcctggtatcagcaagaaacgagggaaacgccccgtaagtccctgatctagtgaggcatacttaaactttaaaacgnggtactaccatcgtaggttccaggcggcaggtggaacttcgtcggggacaggtaacttcgaactctcgaccctatcacgcagcccgtgaccgaacgtccgtaggtacttacgtaactttcgtacgttaccgttaaacttttacttaaaccgtttaccggaacccttaaaacgtagtttaaacgttttaagtaacggggtttaacgggttccggggggtaacgtttccggggaaaccgtaacggggttaaaccgtaaaggggttacgtaaaatcgaaaacgttcttagggttcggatcgactacgttacttcgttgtttaaccc

SEQ ID NO: 427950 - DNA, 756 bp, Homo sapiens
  misc_feature: GZ8MTXP01DKFSE.22.25.C03.1.454.CMB.2.raw
  modified_base (202)..(202): a, c, t, g, unknown or other
  modified_base (268)..(268): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctccaggtgccaaatgtgacatccagatcgacccagtcctccttccaccctgtctgcatctgtagganactagacgttacatcacgttcggccggcagtcaagtagttattagtgtcgtgggtcggtctggtancagacaacgaaaaccgagggaaaccgaccccgttaaggtcctagtacttctaagtggaacggtactaacttaactttaaaaccgttttaaaaacgtcgggttacttacccctaagttacgtaaacgggtttaccgacgggtacggagtacggtcggaaacgttacggtaagggggaaacctaaagggttaaacctttaccaaccgttccgttaccgaccctaacgtacgaaacgccgtaaccggtcctagaaccgtaccggtccttaggtacttgtaactttcgtaccgtaactttaaacttttacgttactaccgtaaacctaaagttcgtttaagtttaggttaacgggttacggggtaccgggggttaaccgttccggggaaaccggtaacggggaacggtaaagggttaagtaaaaccgtacgaaaaaccggttgttcggttcggacctaacggtacccctagttacttccttcggtttaaccc

SEQ ID NO: 427951 - DNA, 535 bp, Homo sapiens
  misc_feature: GZ8MTXP01AIL1P.22.25.C03.1.454.CMB.2.raw
  modified_base (202)..(202): a, c, t, g, unknown or other
  modified_base (361)..(361): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtcctccttccaccctgtctgcatctgtagganacagagttaccatcacttgccgggcagtcagagtattagtgtctgggtggcctggtatcagcaagaaaccagggaaacgcccctaaggtccctagatctatgaggctatactaactttaaaacgtggtcgtccatcaaggttccagcgcagtgaatcgnggacagattcactctcgcatcagcagcctgacagcctgatgattctgactaacttatactcgacctaactagttattataggttacgcggggtacgttcggaaccgaaagggttaccaagggttaggtaaactacgaaaacgcttaggtgctcgcacgttatcgttgtttaacc

SEQ ID NO: 427952 - DNA, 673 bp, Homo sapiens
  misc_feature: GZ8MTXP01DT47H.22.25.C03.1.454.CMB.2.raw
  modified_base (258)..(258): a, c, t, g, unknown or other
  modified_base (280)..(280): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccggcagtcagagtattagtgtcgtgggtggctggtancagcaagaaaccgagggaaacnccccgtaaggtcctgatctatgagtcagttacttaactttaaaacgtggtactacccaatacgtaaggttccaggcggacgtaggtagtaacgttcgtggggaaacaaggtaacttcaaccttcgtacgacccatccgaagccaggccctggaaccgtacgtactagtacgtacgtacttacgtaacgttaaccttaaactttacttaaccgtaacgtaacctaaagttaagtttaagtttaaggttaacgggtttacgggtaccgggggttaccggttaccgggaaaccgggtaaacggggttaaaccggtaaagggttaaacggtaaacgtaacgttaaaacggttacgttacgggtcgacgtaacgacctacgttacgttcgttcgttcc

SEQ ID NO: 427953 - DNA, 590 bp, Homo sapiens
  misc_feature: GZ8MTXP01BJ80R.22.25.C03.1.454.CMB.2.raw
  modified_base (303)..(303): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtcctccttccaccctgtctgcatctgtagagacagagttaccatcacgttcgccggcagtcagtatattagtgtcgtgggtgcctggtatcagcaagaaaccgagggaaacgccccgtaaggtcctgatctangaggctagttactaactttaaaactggtacgtcccatacgaaggttccagcggcagtggaattcgtgggacagtaattccaacttctcgccatcaacgcacgcctgacacgtcctagattgattcgtacacgtaactttattactacaccaactagtattaagtagttagggtcggggtacgttcgggaacgaaaggggaccgtaaagggttagtaaacgtaacgaaaacggttcgttacgggtcgggaacttcgggacctaacccggttacgttccgtttcgttcc

SEQ ID NO: 427954 - DNA, 681 bp, Homo sapiens
  misc_feature: GZ8MTXP01ESNL7.22.25.C03.1.454.CMB.2.raw
  modified_base (202)..(202): a, c, t, g, unknown or other
  modified_base (257)..(257): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtcctccttccaccctgtctgcatctgtagganacagattaccatcacttgccggcagtcagtatattagtgtcgtgggtgctggtancagacagaaaccgagggaaaccgacccgtaaggtcctgatctagtgagactattacttaaactttaaaacgtggtacgtaccatacgtaacggttccaggcgacgtaggtgaacgtcgtgggaactaagtaacttcctacgtctcgactactcgacgcacgcctgacacgtcctagtatcgtacttacgtacgttaaccgttaaacttttacttaaccgtacgtaacccgtaaagttacgtttaacgtttaacggtttaacgggttaacggggttacccgggggttaaccggttacccgggggaaaccgtaaacgggggttaaaccggtaaaggggttaaacgtaaaacgtaaccgaaaacggttacgttacgggtaacggtaccgttaacggacctaccgttacgttccgtttcgtttaaccc

SEQ ID NO: 427955 - DNA, 778 bp, Homo sapiens
  misc_feature: GZ8MTXP01BJWXL.22.25.C03.1.454.CMB.2.raw
  modified_base (266)..(266): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatcgacccagtcctccttcccaccctgtctgcatctgtaggagacagtagttaccatcacttggccggccagtcagtagttattagtgtcgtgggtgcgtggtancgagacaagaaccgtaagggaaaccgtaccccgtaaggtccagtacgttctaagtggaaggtacctacttaacgtttaaaaccgttttaaaacgtcgggttaccttaccccgtaagtacgtaaacggtttcccgaacggtcggtacgtaggtacggtaacgttaccggtaaggggaacctaaggttaaacttccccgtaacttccctacggtacccctagtaccgaacgtccgaacggtcccgttgaaccggtacgtcccgtagaacgttgtacttaccggttacgtaaaccgttaaaccgttttattaacccggtaccgtaaacctaaacgttagtttaaaccgtttaaggtttaccgggtttaacgggggtcccgggggtaaaccggttccggaaacgggggtaaacggggttaacccgtaaaggggttaaaggaaaacttaacggaaacggttaccgttagggtaacggtaccggtaagtaccctacttacggttccgtttcgttcccg

SEQ ID NO: 427956 - DNA, 630 bp, Homo sapiens
  misc_feature: GZ8MTXP01D2VJR.22.25.C03.1.454.CMB.2.raw
  modified_base (200)..(200): a, c, t, g, unknown or other
  modified_base (260)..(260): a, c, t, g, unknown or other
  modified_base (465)..(465): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctccaggtgccaaatgtgacatccagatgacccagtctccttccaccctgtctgcatctgtagganacagagttaccatcacttgccggccagtcagtagtattaggtgtcgtgggtgctaggtancagcaagaaaacgaggaaacgcccctaaggtcctagatctagtgaaggactattacttaaactttaaaaaacgtggttactaccccgtaatacgtaaacggtttccacggacggacgtaaggttggaaacgtcgttggggaaactaaaggtaaactttcgaacctctacgccatcaagcaagctagacagcctgatgtaactctntaactaaacttagttaactcgtaacaactaagtttaattaaagttggttaacgtcggggtaaccggtttcgggaaacgtaaaggggttaccgaaaggggttaaagaaacgtaacgttaaaaccgattacgggtgtacgtaacgacacccttattcgttcgtttcc

SEQ ID NO: 427957 - DNA, 536 bp, Homo sapiens
  misc_feature: GZ8MTXP02ID143.22.25.C03.1.454.CMB.2.raw
  modified_base (321)..(321): a, c, t, g, unknown or other
  modified_base (436)..(436): a, c, t, g, unknown or other
tcagacatacgcgtcacgaccggtgctcgatttagtagtgtagatttgggtttggggcaggagtcagacccagtcaggacacagcatggacatgagggtcccgctcagctcctggggctcctgctgctctggctcccaggtgccaaatgtgacatccagatgacccagtctccttccacctgtctgcatctgtaggagacagagttaccatcacttgccgggcagtcagagtattagtgtctgggtggcctggtatcagcagaaaccagggaaagcccctaaaggtcctgatctatgaggcatctaactttaaaactggtntccatcaagttccagcgcagtggatctggggacagaattcactctcgccatcagcagcctgcagcctgatgattactgcaaactttattactgaccaacagttattatagtttancgggggtacgtttcggaccaaaggggtaccaaagggttagggaaaattacgaaaacgtacgtagttaacgggcttacggcaaccgtacttctacggttcc

SEQ ID NO: 427958 - DNA, 517 bp, Homo sapiens
  misc_feature: GZ8MTXP02JHCLL.22.25.C03.1.454.CMB.2.raw
  modified_base (386)..(387): a, c, t, g, unknown or other
  modified_base (389)..(390): a, c, t, g, unknown or other
  modified_base (392)..(395): a, c, t, g, unknown or other
  modified_base (397)..(397): a, c, t, g, unknown or other
  modified_base (399)..(399): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccggcagtcagagtattagtgtctgggtggcctggatcagcagaaaccagggaaagccgtaaggtcctgatctatgaggcatctaactttaaaactgtagtcccatcaagttcagcggcagtggatcgtggggacagaaacttcacttcacgccaatcagcagccnncnncnnnntntntactactatactacacacatatatagtagtacggtacgtacgtacgacggacgtaacggtaacgtaacgtaacgtaaacgtaacgtagtaacgtacgtacgacactactacgtactcg

SEQ ID NO: 427959 - DNA, 519 bp, Homo sapiens
  misc_feature: GZ8MTXP02GR73M.22.25.C03.1.454.CMB.2.raw
tcagacatacgcgtcacgaccggtgctcgatttagtagtgtagatttgggtttggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaaactggtgtcccatcaaggttccagcgcagtggatctggggacagaattcactctcgccatcagcagcctgcagcctgatgattctgcaacttattactgaccaacagtattatagttagtcgggggacgttcggaccgtaaggggaccaaagggttacggaaacttacgaaaacgaactgtggctaggcaccatctagtttcc

SEQ ID NO: 427960 - DNA, 536 bp, Homo sapiens
  misc_feature: GZ8MTXP02IOA7O.22.25.C03.1.454.CMB.2.raw
  modified_base (371)..(371): a, c, t, g, unknown or other
tcagacatacgcgtcacgaccggtgctcgatttagtagtgtagatttgggtttggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaaggtcctgatctatgaggcatctactttaaaaactggtgtccatcaaggttccagcgcagtggatctggggacagaaattcactcncgccatcagcagctgcagcctgatgattctgctaactttatactgaccaacagtaattatagttagtcgggggtacgttcggaccaaaggggaccgaaggttacgggaaaattacgaaaacgaacgtagtaaggtctaggaccaaccgtactacgttacgtttcc

SEQ ID NO: 427961 - DNA, 537 bp, Homo sapiens
  misc_feature: GZ8MTXP02FX9DV.22.25.C03.1.454.CMB.2.raw
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcaagaaaccagggaaacgcccctaaggtcctgatctatgaggcatctaactttaaaactggtgtcccatcaaggttccagcgcagtgatcgtgggacagattcactctcgccatcagcagcctgcagctgatgattctgactaactttattactacgaccaaactagttattagttaggttaggtcgggggtacgttacggacgaaaggggacctaaagggtagaaacgtacgaaaacgtacgtagtaaggctacgaccactactcgtatttcc

SEQ ID NO: 427962 - DNA, 551 bp, Homo sapiens
  misc_feature: GZ8MTXP02JGIJO.22.25.C03.1.454.CMB.2.raw
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaacctgtctgcatctgtaggagacagagttaccatcacttgccgggccagtcagagtattagtgtctgggtggcctggtatcagcagaaccagggaaagcccctaaggtcctgatctatgagcatctactttaaaactgtagtccatcaagtccagcgcagtgatcgtgggacagaattcactctcgccatcagcagcctgcagcctgatgattctgactaacttattactagaccaaacagttattatagttagtcgggggacgttcggaccgtaaaggggaccaaaggggttagggaaaacttaccgaaaaaccggtaacgttaggtaacggggcttacgggactaacccgaagttaccgtttacgttcc

SEQ ID NO: 427963 - DNA, 523 bp, Homo sapiens
  misc_feature: GZ8MTXP02HKBBP.22.25.C03.1.454.CMB.2.raw
  modified_base (397)..(397): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggcagtcagagtattagtgtctgggtggcctggtatcagcagaaaccagggaaagcccctaaggtcctgatctatgaagcatctactttaaaaactggtagtcccatcaaggttccagcgcagtgatctggggacagattcactctcgcatcagcagctgcagctgatgattcngtacaactttattactgaccaactagtattatagttagtcgggggacgttcggaccgaaggggacctaagggtacggaaactacgaaaacgtaacgtggtaaggctaggaccacgactctgtttcc

SEQ ID NO: 427964 - DNA, 622 bp, Homo sapiens
  misc_feature: GZ8MTXP02H4AO2.22.25.C03.1.454.CMB.2.raw
  modified_base (406)..(406): a, c, t, g, unknown or other
  modified_base (422)..(422): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtcctccttcaccctgtctgcatctgtaggagacagagttaccatcacttgccgggccagtcagtagttattagtgtcgtgggtggcctggtatcagcgaagaaaccgaggggaaacgccccgtaaggtcctagatctagtgaggctaagttacttaactttaaaaacgtggtactacccctataccaaggttccgagtcggcaggtggatcgtgggaacagtaacttcactcgtcnccatcagcacgtcccngcacgctagtatgtacttcgtacgtacttaaactttactactacgtacctaaagtaagttaatttaagttaaggttacgggttacgggggtaccgttacgggaacggtaaaacgggtacggtaaacgggtaacggtaaaacgtaaccgaaaacgtaagtacggtaacggtacgtacgacctacgtacgtcgttacgtacc

SEQ ID NO: 427965 - DNA, 531 bp, Homo sapiens
  misc_feature: GZ8MTXP02GQTWR.22.25.C03.1.454.CMB.2.raw
  modified_base (407)..(407): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccaggggaaagcccctaaaggtcctgatctatgaggcatctaactttaaaaactggtagtcccatcaaggttccagcggcagtggatctggggacagaattcactctcgccatcagcagcctgcagcctgatgattcngtcaatttattactgaccaacagtattatagttagtcgggggacttcggaccgtaaagggaccaaagggtaggaaaattaccgaaaacgtaacgtgtaagggctaggccaccactctactttcc

SEQ ID NO: 427966 - DNA, 512 bp, Homo sapiens
  misc_feature: GZ8MTXP02GQTZW.22.25.C03.1.454.CMB.2.raw
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaaactggtgtcccatcaagttcagcgcagtgatgtgggacagattcactctcgcatcagcagcctgcagctgatgattctgctaacttattactgaccaactagttattagttagttaggtcgggggtacgttcggtaccgaagggaccgaaggtaggaaactacgaaaacgactgtgctgacaccatctgtttacc

SEQ ID NO: 427967 - DNA, 503 bp, Homo sapiens
  misc_feature: GZ8MTXP02IV6OF.22.25.C03.1.454.CMB.2.raw
  modified_base (201)..(201): a, c, t, g, unknown or other
  modified_base (240)..(240): a, c, t, g, unknown or other
  modified_base (357)..(357): a, c, t, g, unknown or other
  modified_base (392)..(392): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtagganacagagttaccatcacttgccggcagtcagagtattagngtctgggtggcctggtatcagcagaaccaggaagcccctaaggtcctgatctatgaggcatctaactttaaaactgtctccatcaagtccagcgcagtgatcgtgggacagaacttnactctcgccatcagcagcctgcagctgatgattcngactacttatactgaccactagtattatagttagtacggggtacttacggacgaagggaccaaaggtgaaaactacgaaacgtactaggtgactagcacacgtctacgttc

SEQ ID NO: 427968 - DNA, 555 bp, Homo sapiens
  misc_feature: GZ8MTXP02IKTUD.22.25.C03.1.454.CMB.2.raw
  modified_base (319)..(319): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggcagtcagagtattagtgtctggtgctggtatcagcagaaaccaggaaagcccctaaggtcctgatctatgaggcatctaactttaaaactggtntccatcagttcagcgcagtgatcgtgggacagtaatcactctcgccatcagcagcctgcacgctgatgattctgactaaactttattactagaccctaaactagttaatttaattaaggtttacgtacggggggtactttacgggaccaaagggggaacctaaaggggttacgaaaaagttccgaaaaaacgtcgtaggttaaggaccgttagacctactacttcctaggtttacc

SEQ ID NO: 427969 - DNA, 520 bp, Homo sapiens
  misc_feature: GZ8MTXP02FIR12.22.25.C03.1.454.CMB.2.raw
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaaactggtgtcccatcaaggttccagcgcagtggatcgtgggacagaattcactctcgcatcagcagcctgcagcctgatgattctgactaacttattactgaccaactagttattatagttagtcgggggtacgttcgggaccgaaggggaccaaagggtaggaaaactacgaaaacgactaggtggctagcaccatctgttac

SEQ ID NO: 427970 - DNA, 506 bp, Homo sapiens
  misc_feature: GZ8MTXP02GUPR9.22.25.C03.1.454.CMB.2.raw
  modified_base (401)..(401): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaacgcccctaaggtcctgatctatgaggcatctaactttaaaactggtagtccatcaaggttcagcgcagtggatctgggacagaattcactctcgccatcagcagcctgcagctgatgattctnactaacttatactacgacaatagtattagtagttagtacggggtacgtcggacgtaaggactaaggtagaaactacgaaacgactgtcgcacgacacactctctc

SEQ ID NO: 427971 - DNA, 584 bp, Homo sapiens
  misc_feature: GZ8MTXP02IY9IH.22.25.C03.1.454.CMB.2.raw
  modified_base (282)..(282): a, c, t, g, unknown or other
  modified_base (302)..(302): a, c, t, g, unknown or other
  modified_base (370)..(370): a, c, t, g, unknown or other
  modified_base (386)..(386): a, c, t, g, unknown or other
  modified_base (415)..(415): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtcgtgggtggcctggtatcagcaagaaaccagggaaacncccctaaggtcctgatctangaggcatacttaaactttaaaacgtggtactacccatacgtaaggttccgagcggacaggtggatcgnggacagtaatcactcncgacagtcagcacgctgcacgctagatgnttctagtacctaaactttactactgaaccctaagtagttaacttagtaggttacggtacgggggtacgtaccggtacggaaacgggtaccgaaagggtaacgtaaacgtaaccgtaaaaccggtacgttagggaacgtacgcgtaccgaacctcttacgtacgtttacc

SEQ ID NO: 427972 - DNA, 559 bp, Homo sapiens
  misc_feature: GZ8MTXP02FWOXS.22.25.C03.1.454.CMB.2.raw
  modified_base (403)..(403): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtgcctggtatcagcagaaaccagggaaagcccctaaggtcctgatctatgaggcatctaactttaaaactggtgtcccatacaaggttccagcggcagtgatcgtggggacagattcactctcgcatcagcagccctgcaggcctgatgattcngctaacttattactcgacctaacgagttaattagtaagtttacggtacgggggtacgttcgggaccgtaaagggggaccctaaaggggtacgggaaaactaccgtaaaacgacgttaggcggtacgtacggacctacgtacttcgtacgtttaccc

SEQ ID NO: 427973 - DNA, 523 bp, Homo sapiens
  misc_feature: GZ8MTXP02IVYRW.22.25.C03.1.454.CMB.2.raw
  modified_base (353)..(353): a, c, t, g, unknown or other
  modified_base (369)..(369): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaacgcccctaaggtcctgatctatgaggcatctaactttaaaatggtgtccatcaaggttccagcggcagtgatcgngggacagattcactcncgcatcagcagcctgacagcctgatgattctagctaacttatactgaccaaactagtattatagttagtcgggggacgttacggcgaaagggacctaagggtagaaattaccgaaaacgtacgtggtaacgctacgacacatccgtagtttacc

SEQ ID NO: 427974 - DNA, 488 bp, Homo sapiens
  misc_feature: GZ8MTXP02FKPFX.22.25.C03.1.454.CMB.2.raw
  modified_base (140)..(140): a, c, t, g, unknown or other
  modified_base (191)..(191): a, c, t, g, unknown or other
  modified_base (208)..(208): a, c, t, g, unknown or other
tcagacatacgcgtcacgaccggtgctcgattagtagtgtagatttgggtttgggtcaggagtcagacccagtcagacacagcatggacatgagggtccccgctcagctcctgggctcccgctgctctggctcccaggtnccaaatgtgacatccagatgacccagtctccttccaccctgtctgcatctntagagacagagttaccntcacttgccggccagtcagatattagtgtctggtggcctggtatcagcagaaacccaggaaagccccctaaggtcctgatctatgaggcatctacttaaaactgtgtcccatcaaggttcagcggcagtggatctgggacagaaattcactctgccatcagcagcctgcagcctgatgattctgcactattactgccacactatatagtatacggtacggtcgtcgacgacgaacgtagtaaagacaacgaaactaagtggcgtgcaccactctctcttc

SEQ ID NO: 427975 - DNA, 524 bp, Homo sapiens
  misc_feature: GZ8MTXP02JA9SU.22.25.C03.1.454.CMB.2.raw
  modified_base (400)..(400): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaacctgtctgcatctgtaggagacagagttaccatcacttgccgggccagtcagagtattagtgtctgggtggcctggtatcagcagaaaccagggaaagcccctaaggtcctgatctatgaggcatactaactttaaaactgtcgtccatcaagttccagcggcagtggatctggggacagaattcactctcgcatcagcagcctgcagctgatgattcngctaactttattactgacccaaatagtattataggttagtcgggggaacttcgggacgaagggaaccgaaaggcggaaaactcgaaaacgtacgtaggtggctaggacactacgtctcgtttcc

SEQ ID NO: 427976 - DNA, 569 bp, Homo sapiens
  misc_feature: GZ8MTXP02IQB2G.22.25.C03.1.454.CMB.2.raw
  modified_base (380)..(380): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggcagtcagagtattagtgtctgggtggcctggtatcagcaagaaaccagggaaacgcccctaaggtcctgatctatgaggcatactaaactttaaaactggtacgtacccatacaaggttccagcggacagtgatcgtggggacagtaatcactcncgcatcagcacgctgcagtccgtgaatgacttctagtactaactttatactcgaccaactagttaacttagtaaggttacgtacgggggtacgttacgggaccgaaagggtaaccgtaaagggtaacggaaaacgttacgaaaaacgtacgtaggtaaggccgtacgaccaactactcgttacgtttcc

SEQ ID NO: 427977 - DNA, 821 bp, Homo sapiens
  misc_feature: GZ8MTXP02I25S0.22.25.C03.1.454.CMB.2.raw
  modified_base (201)..(201): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtagganacagagttaccatcacttgccggcagtcagtagtattagtgtcgtgggtggctggtatcagcagaaaccagggaaacgcccctaaggtcctgatctatggaggctatacttaaactttaaaaactggtacgtacccctaagtacgtaaacggtttcccgaaggccgggtacctaacgggttaggtaacgttacccggttaggggggaaacctaaagggttaaaacgtttaccctaaccggttcccttacccgggacccctaaacgtttaccgaaacggtacccgtaaaccggcccgttacgggacccaaccgggtcccctttaagggaaaccctttgggtaacttttaccgtacggtaaacccttaaaaaccgtttttacgttaaacccctttacgggaaaccccctaaaaacgttaacggttttaaacgtttaaagtttaaacgggtttaacgggggttaacccggggggttaacggtttacccggggaaacccggtaaaacgggggtaacccgtaaaagggggtttaaacggaaaaacgtttaccggaaaaaaccggtagttaacgggttcggaccttacggaccctaacctaacggtttaccttcggttttaacccg

SEQ ID NO: 427978 - DNA, 560 bp, Homo sapiens
  misc_feature: GZ8MTXP02HGCOK.22.25.C03.1.454.CMB.2.raw
  modified_base (393)..(393): a, c, t, g, unknown or other
  modified_base (412)..(412): a, c, t, g, unknown or other
  modified_base (420)..(420): a, c, t, g, unknown or other
  modified_base (529)..(529): a, c, t, g, unknown or other
tcagacatacgcgtcacgaccggtgctcgatttagtagtgtagatttgggtttgggggcaggagtcagacccacgtcaggacacagcatggacatgagggtccccggcctcagctcctggggctcctgctgctctggctcccaggtgccaaatgtgacatccagatgacccagtctccttccaccctgtctgcatctgtaggagacagagttaccatcacttgccgggccagtcagagtattaggtgtcgtgggtggccgtggtatcagcgaacgaaaccgagggaaacgcccctaaggtcctgatctatgaggctatactaactttaaaactggtcgtacccatacgtaaggttccagccgcgagtgagtctggggacagtaattcacttcncgtcatcagcagcctgcanccgtgtangtattcagactaactttatactcgaccaatagttacttagtaggttagtcgggggtacgtcggaaccgaagggacgtaaaggtagaaacgtacgaaaccggtatacggngtaccgtagacccaactactcgttgttaccc

SEQ ID NO: 427979 - DNA, 589 bp, Homo sapiens
  misc_feature: GZ8MTXP02GXSEB.22.25.C03.1.454.CMB.2.raw
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcaagaaaccagggaaacgcccctaaggtcctgatctatgaggcatacttaactttaaaaactggtactcccatactaaggttccagcggacaggtggatcgtggggacaagtaattcactctacgccaatcaaggcaacgccctgccaacggcccttgattgacttctacgtactaaactttattaactcgacctaaaacagttaattaaagttaggttagtacggggggtaacgttcgggaaccgaaaacgggggaaccgtaaacgggtaggaaaacgtacgaaaacgtaacgtaggtaaggctacggacacacttccgtattcc

SEQ ID NO: 427980 - DNA, 557 bp, Homo sapiens
  misc_feature: GZ8MTXP02GS8F7.22.25.C03.1.454.CMB.2.raw
  modified_base (201)..(201): a, c, t, g, unknown or other
  modified_base (327)..(327): a, c, t, g, unknown or other
  modified_base (382)..(382): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtagganacagagttaccatcacttgccgggccagtcagagtattagtgtctgggtggcctggtatcagcaagaaaccagggaaagcccctaaggtcctgatctatgaggcatactaactttaaaaactggtntccatcaaggttcagcggcagtggatctggggacagaattcactctcgccatcancagctgcagcctgatgattcagtcaaactttattacagtacccaaactagttaatttagtaggtttaagtcgggggtacgttcgggaccgaaagggaccgaaagggttacggaaaacttacgaaaacgggtaaactggtaacggtctacggaccaacctacgtactcggtttacc

SEQ ID NO: 427981 - DNA, 553 bp, Homo sapiens
  misc_feature: GZ8MTXP02HW6CO.22.25.C03.1.454.CMB.2.raw
  modified_base (202)..(202): a, c, t, g, unknown or other
  modified_base (531)..(531): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtcctccttccaccctgtctgcatctgtagganacagagttaccatcacttgccggcagtcagagtattagtgtctgggtggcctggtatcagcaagaaaccagggaaacgcccctaaggtcctgatctatgaggcatactaactttaaaaacgtggtacgtaccctatacgtaaggttccaggcggactaggtggattcgtggggaactagaacttcaacttctcgaccatcaacgcagccctgcagcctagactgtattctagactaactttatactcgaccaagtagtaattagtaggttacgtcggggtacgttcggacgaaggtaccgaaagtaggaaactaacgaaacgtacgtgngctacgacactactctacgtcc

SEQ ID NO: 427982 - DNA, 523 bp, Homo sapiens
  misc_feature: GZ8MTXP02JO27K.22.25.C03.1.454.CMB.2.raw
  modified_base (400)..(400): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaacgcccctaaggtcctgatctatgaggcatacttactttaaaaactggtagtcccatcaaggttccagcgcagtgatctgggacagattcactctcgcatcagcagctgcagctgatgattcngtctaaacttattactgaccaaactagttaattatagttagtcgggggacgttcggacgaaggggaccaaagggtagaaatacgaaaacgaacgtggtaaggctaggaccacactctgtttcc

SEQ ID NO: 427983 - DNA, 522 bp, Homo sapiens
  misc_feature: GZ8MTXP02GV5RT.22.25.C03.1.454.CMB.2.raw
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaaggtcctgatctatgaggcatctaactttaaaactggtagtcccatcaggttccagcgcaggtgatgtgggacagaatcactctcgccatcagcagccctgcacgcctgactgattctgactacttatactgacaactagtattatagttagtacgggggtacgttcggacgaagggaccaagggtaggaaacttacgaaacgtaactggtggactcggtacacctatctgtttcc

SEQ ID NO: 427984 - DNA, 547 bp, Homo sapiens
  misc_feature: GZ8MTXP02HFUOC.22.25.C03.1.454.CMB.2.raw
  modified_base (380)..(380): a, c, t, g, unknown or other
  modified_base (432)..(432): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcaagaaaccgagggaaacgcccctaaaggtcctgatctatgagcatctaactttaaaactggtacgtcccatactaaggttccagcggcaggtgatcgtgggacagtaattcactcncgccatcagcagcctgcagccgtagactgattctacgactaactttattacngacccaatagttattagtagttaggtacggggtacgttcggtacgaaacggggacgaaagggtagaaaacgttacgaaaacgtactagggtgacgtcgacacctatacgtcttcc

SEQ ID NO: 427985 - DNA, 520 bp, Homo sapiens
  misc_feature: GZ8MTXP02G610H.22.25.C03.1.454.CMB.2.raw
  modified_base (400)..(400): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggcagtcagagtattagtgtctgggtggcctggtatcagcagaaaccagggaaacgcccctaaggtcctgatctatgaggcatctaactttaaaactggtctcccatcaaggttccagcgcagtgatctggggacagattcactctcgccatcagcagcctgcagcctgatgattcngactaacttatactcgacaactagtattagtagttagtcggggtacgttcggacgaagggaccaaagggtacgaaactacgaaaacgagtgtggctaggaccaccgtatcgtagttaccg

SEQ ID NO: 427986 - DNA, 558 bp, Homo sapiens
  misc_feature: GZ8MTXP02H2MD2.22.25.C03.1.454.CMB.2.raw
  modified_base (327)..(327): a, c, t, g, unknown or other
tcagacatacgcgtcacgaccggtgctcgatttagtagtgtagatttggggtttgggggcaggagtcagacccagtcaggacacagcatggacatgagggtccccgctcagctcctggggctcctgctgctctggctcccaggtgccaaatgtgacatccagatgacccagtctccttcaccctgtctgcatctgtaggagacagagttaccatcacttgccgggccagtcagagtattagtgtctgggtggcctggtatcagcaagaaaccagggaaacgcccctaaggtcctgatctatgaggcatactaatttaaaaactggtntacccatcaaggttccagcggcaggtggatcgtgggacagaattcactctcgcatcagcagcctgcagcctgatgtattctagtctaaactttattactcgaccctaaataagtaatttaagtaggttaggtcgggggtacgttaccgggaccgaaaacggggaccgaaagggtaggaaaactacgaaaacgtaacgtggtaacggctacggacacctactcttcgttacc

SEQ ID NO: 427987 - DNA, 521 bp, Homo sapiens
  misc_feature: GZ8MTXP02G6A27.22.25.C03.1.454.CMB.2.raw
  modified_base (201)..(201): a, c, t, g, unknown or other
  modified_base (402)..(402): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtagganacagagttaccatcacttgccgggccagtcagagtattagtgtctgggtggcctggtatcagcagaaaccagggaaagcccctaaaggtcctgatctatgaggcatctactttaaaaactgtgtccatcaaggttccagcgcagtgatctgggacagaatcactctcgccatcagcagcctgcagcctgatgattctcganaactttatactgacccaatagtattatagttagtcgggggacgttacggacgaaacgggaccgaaaggtaggtaaaactacgaaaacgaacgttgaagctacggacacacttctattcc

SEQ ID NO: 427988 - DNA, 561 bp, Homo sapiens
  misc_feature: GZ8MTXP02HY8I0.22.25.C03.1.454.CMB.2.raw
  modified_base (277)..(277): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagattaccatcacttgccggccagtcagagtattagtgtctgggtgcctggtatcagcagaaacagggaaacnccctaaggtcctgatctatgaggcatactaactttaaaactggtctccatcaaggttccagtcgcagtgatcgtggggacagtaattcactctcgccatcagcacgctgcacgctgatgattctgactaactttattactgacccaaatagtactttaagtaggtttacggtacgggggtacgtttcgggaccgtaaaggggtaccgaaaggttacgggaaaacttaccgaaaaacgtaacgtaggtaacgggtactacggaccaacctactcgttacgttacc

SEQ ID NO: 427989 - DNA, 544 bp, Homo sapiens
  misc_feature: GZ8MTXP02JIQQZ.22.25.C03.1.454.CMB.2.raw
  modified_base (400)..(401): a, c, t, g, unknown or other
  modified_base (419)..(419): a, c, t, g, unknown or other
tcagacatacgcgtcacgaccggtgctcgatttagtagtgtagatttgggtttgggggcaggagtcagacccagtcaggacacagcatggacatgagggtcccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatcatgaggcatctactttaaaaactgtgtacccatcaaggttccagcgcaggtgatcgtgggacagaattcatctcgcatcagcagcctgcagctgatgattcgnntaacttatactgaccaanagtattatagttagtcgggggtacttcgggaccgtaagggacctaaagggtaaggtaaactacgaaaaacgtacgttaggtaagggtaccttacgggacctaacccgtataccgtttacgttccg

SEQ ID NO: 427990 - DNA, 652 bp, Homo sapiens
  misc_feature: GZ8MTXP02I6PWA.22.25.C03.1.454.CMB.2.raw
  modified_base (425)..(425): a, c, t, g, unknown or other
  modified_base (429)..(429): a, c, t, g, unknown or other
  modified_base (433)..(433): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacattagttaccatctacttggcccgggccagtcagagttattagtgtcgtgggtcggcctggtatcagacgaagaaaccgaagggaaacgacccccgttaaaggtccctaggatctagtgaggctatactttaaaactttaaaaacgtggttacgtccatacgtaaggttccaggcgcaggtgactgtgggacagaacttcgactctcgtccatacgagaccncgcngacncgtactagtatcgtacttcgtcgtaacttaactttattacgacgtaacctaaacgttaagttaaagtttaagttaacgggttacggggtaccgggggttaccgtaaccgggtaaaccgggaaacgggtaaccggtaaacgggtaaacgtaaaacgtaaaccgtaaaacgtaacggtcggaacggtacgtacgacctaacttacgttacgttaccgttac

SEQ ID NO: 427991 - DNA, 533 bp, Homo sapiens
  misc_feature: GZ8MTXP02GLQ9Q.22.25.C03.1.454.CMB.2.raw
  modified_base (305)..(305): a, c, t, g, unknown or other
  modified_base (350)..(350): a, c, t, g, unknown or other
  modified_base (397)..(397): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccacctgtctgcatctgtaggagacagagttaccatcacttgccggcagtcagagtattagtgtctgggtggcctggtatcagcaagaaaccagggaaacgcccctaaaggtcctagatctatgaggnatactaactttaaaaacgtggtactccatactaaggttccagcgnagtgatcgtgggacagaatcactctcgcatcagcagcctgcacgccngatgattctagtactaactttattactagaccaaactagtaattatagttagtacggggtacttcgggacgaaggaaccgaaggtaggtaaactacgaaaacggacttaggcgacgtagacacctatctacgtttc

SEQ ID NO: 427992 - DNA, 577 bp, Homo sapiens
  misc_feature: GZ8MTXP02IUL97.22.25.C03.1.454.CMB.2.raw
  modified_base (362)..(362): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccggcagtcagagtattagtgtcgtgggtggcctggtatcagcagaaaccgagggaaacgcccctaaaggtcctgatctatgagcatctaactttaaaacgtgtagtcccatctaaggtccagcggcagtggatcgtggganagaattcactctcgcatcagcaggcctgcagcctagactgatttctgtacctaaactttattaccgttgaccctaaacgtagttaattagttaagttacggttacgggggtacgtttacggaccgtaaaggggaccgtaaagggtaaggaaaacttaccgaaaacgtaacgtaggttaacggtacttacggaccacctacgttacgtcgtttacc

SEQ ID NO: 427993 - DNA, 537 bp, Homo sapiens
  misc_feature: GZ8MTXP02F9IVW.22.25.C03.1.454.CMB.2.raw
  modified_base (201)..(201): a, c, t, g, unknown or other
  modified_base (324)..(324): a, c, t, g, unknown or other
  modified_base (369)..(369): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacattcagatgacccagtctccttccaccctgtctgcatctgtagganacagattaccatcacttgccggcagtcagagtattagtgtctgggtggcctggtatcagcagaaaccgagggaaacgcccctaaaggtcctgatctatgaggcatctaactttaaaactggtntcccatacaaggttccagcgcagtgatctgggacagattcactcncgcatcagcagcctgcagcctgatgattctgactaacttatactgacctaacagttattaagtagttagtcgggggtacttcgggacccgaaaggggacctaaagggttacgaaaattaccgaaaacgtacgtaggtaaggcttaggaccacctatccgttagtttcc

SEQ ID NO: 427994 - DNA, 542 bp, Homo sapiens
  misc_feature: GZ8MTXP02GS0MN.22.25.C03.1.454.CMB.2.raw
  modified_base (201)..(201): a, c, t, g, unknown or other
  modified_base (514)..(514): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtagganacagagttaccatcacttgccgggccagtcagagtattagtgtcgtgggtggcctggtatcagcagaaaccagggaaacgcccctaaaggtcctgatctatgaggcatactaactttaaaaactggtcgtccatacaaggttccagcgcaggtgatcgtgggacagaattcactctcgcatcagcagcctgcagcctgactgattctgacctaatttatactgaccctaactagttattagtacgttagtacgggggtacgttcggaccgaaacgggtaccaaagggtagaaactacgaaaacgtacgtaggngtctacgactaccacttcgtcgtttacc

SEQ ID NO: 427995 - DNA, 574 bp, Homo sapiens
  misc_feature: GZ8MTXP02FMDPC.22.25.C03.1.454.CMB.2.raw
  modified_base (201)..(201): a, c, t, g, unknown or other
  modified_base (430)..(430): a, c, t, g, unknown or other
  modified_base (444)..(444): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtagganacagagttaccatcacttgccggcagtcagagtattagtgtcgtgggtggcctggtatcagcaagaaaccgagggaaacgacccctaaggtcctagatcgtatgaggctatacttaaactttaaaacgtggtacgtacccatacgtaaggttccaggacggactaggtggattcgtggggaacagtaattccactctcgaccatcagcagcctgcacgctgatgattcngactaattattacngaccaacgtagttaattagtaggttacggtcgggggtaccgttacgggaccgaaagggtaccgaaagggtagaaaacgtacgaaaacgacgtggtcggactacggaccaacgtactcgttacgtttaccc

SEQ ID NO: 427996 - DNA, 582 bp, Homo sapiens
  misc_feature: GZ8MTXP02G1JOJ.22.25.C03.1.454.CMB.2.raw
  modified_base (201)..(201): a, c, t, g, unknown or other
  modified_base (359)..(359): a, c, t, g, unknown or other
  modified_base (412)..(412): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtagganacagagttaccatcacttggccgggcagtcagagtattagtgtctgggtggcctggtatcagcagaaaccgagggaaagcccctaaggtcctgatctatgaggcatactaactttaaaaactggtgtccatcgaaggttccagcggcagtggactcgnggggacaagtattcactctcgcactcagcagcctgacacgctgatgtattcgnacttaacttacttactagaccaactaagttattagttaacgttacggtacgggggtacgttaccgggacggaaacggggtaaccgtaaaagggtacggtaaaactaaccgtaaaacgtaaaccgtggttaacggcttaacggacctaaccgtacttcgttacgtttaccc

SEQ ID NO: 427997 - DNA, 675 bp, Homo sapiens
  misc_feature: GZ8MTXP02G20DD.22.25.C03.1.454.CMB.2.raw
tcagacatacgcgtcacgaccggtgctcgatttagtagtgtagatttgggtttgggggcaggagtcagacccagtcaggacacagcatggacatgagggtcccccgctcagctcctggggctcctgctgctctggctcccaggtgccaaatgtgacatccagatgacccagtctccttccaccctgtctgcatctgtaggagacagagttaccatcacttgccgggcagtcagagtattagtgtctgggtggcctggtatcagcaagaaaccgaagggaaacgaccccgtaaggtcctagatctagtgaggcacttacttaaacttttaaaaacgtggtacgtaccctagtacgtaaggttccaggccggcgaggtggtacgttcgtgggggaactaaggtaacttccgaactccgtaccgaccctatcgacgcaacgccgtagaccgacgtcccgtgtagttacgtacgtttccgtagttacctaaacttttacttaaccgtcggtaaccctaaacgtagttaactttagttaacggtttacggtaccgggggtacgtttaccggggaaccgtaaacggggaaccgtaaagggtaaacggtaaaacgttaaccgaaaacggtacgttaggaacgggtacgtacggtccaacccggtatttccgtacgtttaccc

SEQ ID NO: 427998 - DNA, 607 bp, Homo sapiens
  misc_feature: GZ8MTXP02IE2W4.22.25.C03.1.454.CMB.2.raw
tcagacatacgcgtcacgaccggtgctcgatttagtagtgtagatttgggtttgggggcaggagtcagacccagtcaggacacagcatggacatgagggtcccccgctcagctcctggggctcctgctgctctggctcccaggtgccaaatgtgacatccagatcgacccagtcctccttccaccctgtctgcatctgtaggagacagtagttaccatcacgttcggccgggcagtcagtagttatagtgtcgtgggtggcctggtatcagacaagaaaccgagggaaacgcccctaaggtcctgatctatgaggctatactaaactttaaaatggtacaccatacaagttccagcgcaggtaggatcgtgggaacaagtaattcactctaccgccaatcagcacgcctgcacgtcctagacttgtacttacgtcgaaccttaatttacttaccgtacgaaccctaagtaagttaattagttaaggttaacggtcgggggtaacgttaccggacggaaaacgggtaccgaaaggttacggaaaactaccgtaaaacgtaacgtcggtaacgggtacttacgaccaacgttacgtcgtttacgttacc

SEQ ID NO: 427999 - DNA, 647 bp, Homo sapiens
  misc_feature: GZ8MTXP02FP4AF.22.25.C03.1.454.CMB.2.raw
  modified_base (279)..(279): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcactgccgggcagtcagagtattagtgtcgtgggtggctggtatcagacaagaaacgagggaacnccccgtaaggtcctagatctagtgaggcatacttaaactttaaaacgtggtacgtacccatacgtaaggttccgagtcgataggtggtacgtcgtgggacagtaacttcgactcgtcgcctactcgacgacgacgcctagacgacgtaccttagtacgttagtacctttcgttacgtaaccttaaactttaacttaccgttaccgaaccctaaagtagtttaaatttaaggttaacggtttacgggtacgggggtacggtttacccggaacggtaaaacggggtaaccgtaaaggggttaacgaaaacgtaacgtaaaacggacgttagggtaacgtacgtacgacgtaccattacgttactttaccg

SEQ ID NO: 428000 - DNA, 615 bp, Homo sapiens
  misc_feature: GZ8MTXP02HRBA6.22.25.C03.1.454.CMB.2.raw
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagttaccatcacttgccggcagtcagagtattagtgtcgtgggtggcctggtatcagcaagaaaccaggggaaacgcccctaaggtcctagattcgtatgaggcatacttaaactttaaaacgtggtacgtccctatacgtaaggttccaaggcgacagtggacttcgtggggacagtaattcactctcgccatcagcagcctagcagccttagatgacttcgtagacttaaactttattcctagacccctaaagtaagtttaattaacgttaaggtttagggtaccgggggttaacgttacccgggaccgtaaaagggggaacccgtaaaaggttaaccggggaaaatacccgaaaaaggtaccgtacggtaaggtcctacggaccaccgttataccttacgtttccc

SEQ ID NO: 428001 - DNA, 573 bp, Homo sapiens
  misc_feature: GZ8MTXP02IH6HB.22.25.C03.1.454.CMB.2.raw
  modified_base (201)..(201): a, c, t, g, unknown or other
  modified_base (255)..(255): a, c, t, g, unknown or other
  modified_base (274)..(274): a, c, t, g, unknown or other
  modified_base (338)..(338): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtagganacagattaccatcacttgccggcagtcagtagtattagtgtctgggtgctgatnagcaagaaacgaggaaacncccctaaggtcctgatctatgaggcatactaactttaaaactgtacgtccatcagttccagcgnagtgatcgtgggacagtaattccgactctcgcatcagcagcctgactacgcctagactgattcagtactaaacgttattactagaccctaaagtacgtttaattacgttaggtttaacggtccgggggtacgttaccgggaccgaaaggggaaacccgtaaagggttaacggaaaacgttacgaaaaacgtacgtcggtaacgacttacggacctacgtactcgttagtttaccc

SEQ ID NO: 428002 - DNA, 568 bp, Homo sapiens
  misc_feature: GZ8MTXP02HH14W.22.25.C03.1.454.CMB.2.raw
  modified_base (284)..(284): a, c, t, g, unknown or other
  modified_base (309)..(309): a, c, t, g, unknown or other
  modified_base (358)..(358): a, c, t, g, unknown or other
  modified_base (425)..(425): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagttaccatcacttgccgggccagtcagagtattagtgtcgtgggtggcctggtatcagcaaggaaaccagggaaacncccctaaggtcctgatctatgaggnatacttaaactttaaaactggtcgtacccatacgtaaggttccagcggntaggtggtactcgtggggacagtacttcactctcgccaatcagcagccctgacacgcctgatgattnactactaactttactactacgaccaaatagttaattagtacggttaggtacgggggtacttaccgggaacgaaggggaccgtaaagggtacggaaacttaccgaaaacgtcgtacggtggactacgccaactactctatttcc

SEQ ID NO: 428003 - DNA, 579 bp, Homo sapiens
  misc_feature: GZ8MTXP02JI9OR.22.25.C03.1.454.CMB.2.raw
  modified_base (410)..(410): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggcagtcagagtattagtgtcgtgggtggcctggtatcgagcaagaaaccgagggaaacgcccgtaaggtcctagatctagtgagcactactaactttaaaactggtacgtccatacgtagttccagcgctagtgatcgtgggacagtactcactctcgcatcagcagcctgcagctgatgtattcntactacttatacgtacaccctaagtagttattaagtaggtttacggtacgggggtaacgttcgggaaacggaaacggggtacccaaaaggggttacgaaaacgttacgaaaaccgaacgttggtaacgggacttacggacctaacccgtaattacggtacgttttcccg

SEQ ID NO: 428004 - DNA, 761 bp, Homo sapiens
  misc_feature: GZ8MTXP02GFRVM.22.25.C03.1.454.CMB.2.raw
  modified_base (200)..(200): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccacctgtctgcatctgtagganacagagttaccatcacttcggccggccagtcagagtattagtgtcgtgggtggctggtatcagcaagaaaccagggaaacgcccctaaggtcctagatcgtatgaggctactacttaaactttaaaacgtgggttactacccatacgtaacggttcccgaagcggacgaggtcggtaacgttcgtggggaaacctaaggtaactttaccgtaacccttccgttaccggaccccctaattacccgaaacggcccaacggtccccttaggacccaacggtcccgtaggtaacttgtaacctttccgtaacggtaacctttaaaacgtttaacgttaaccctacgggtaaacccctaaaaccgttaaggttttaaaactttaacggtttaaagggtttaccggttaccgggggggttaacgtttaacccggggaacccggtaaaacgggggaaaccggtaaaaggggttaacggaaaaacgttacccgaaaaacgggtaaaccgtttggaaccggggttaacccgtacggtaacccgtacgtacgtttaccgttacgtttaccg

SEQ ID NO: 428005 - DNA, 589 bp, Homo sapiens
  misc_feature: GZ8MTXP02F26FJ.22.25.C03.1.454.CMB.2.raw
  modified_base (357)..(357): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccacctgtctgcatctgtaggagacagagttaccatcacttgccggcagtcagtagtattagtgtcgtgggtggctggtatcagcaagaaaccgagggaaacgccctaaggtcctgatctagtagaggactatacttaaactttaaaactggttacgtaccatacgtaagttccagcganagtgatcgtgggacagtaattcactctcgcatcagcagcctgcacgtcctgactgtattctacgactaactttattactagacctaaacgtagttaattagttacggttacggtacgggggtacgttacgggaacgtaaacggggacgtaaagggtacggaaaacgtacgaaaaaccggtacgtagggttaacggacgttacggacctacgttactcggttacgtttacccg

SEQ ID NO: 428006 - DNA, 599 bp, Homo sapiens
  misc_feature: GZ8MTXP02HANTO.22.25.C03.1.454.CMB.2.raw
  modified_base (201)..(201): a, c, t, g, unknown or other
  modified_base (367)..(367): a, c, t, g, unknown or other
  modified_base (386)..(386): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtagganacagagttaccatcacttggccggcagtcagagttattagtgtcgtgggtggcctggtatcagcaacgaaaccgagggaaacgccccgtaaaggtcctgatctatgagacatacttaaactttaaaactggtactcccatacgtaaggttcccagcgacagtggancgtgggacagattcactcncgccatcacgcacggcctgaccagcctagacttgtacgttcacgtactaactttataccagacccaaagtattaattagtaggttacgggtacgggggtacgttccggaacgaaacgggtaaccgtaaagggtaaacggaaaacgttaaccggaaaaacgtaccgtttagggcggtaacgtcggtaacccactacggttactcggtttaaccc

SEQ ID NO: 428007 - DNA, 589 bp, Homo sapiens
  misc_feature: GZ8MTXP02H53WX.22.25.C03.1.454.CMB.2.raw
  modified_base (385)..(385): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatcgacccagtcctccttccaccctgtctgcatctgtaggagacagagttaccatcacttgccggccagtcagtagtattagtgtcgtgggtggctggtatcagcaagaaaccgagggaacgcccctaaggtcctgatctatggacgcataccttaaactttaaaacgtggtactacccatacgtagttccagcgcaggtgatcgtgggacagacttcactacnccgtcatcagcacgcctgacacgtctgatcgaattcgtctactaaactttctacgtcgaaactaacttaggttattagtttaaacggttggtaccgggggtacgttacggaaccggaaacggggttaccgaaggggtaaacgtaaacgtacgaaaaacgttgtacggtaacgcgttaaccgcctacgtactttcgtactttacc

SEQ ID NO: 428008 - DNA, 587 bp, Homo sapiens
  misc_feature: GZ8MTXP02I6CXP.22.25.C03.1.454.CMB.2.raw
  modified_base (202)..(202): a, c, t, g, unknown or other
  modified_base (348)..(348): a, c, t, g, unknown or other
  modified_base (356)..(356): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtcctccttccaccctgtctgcatctgtagganacagtattaccatcacttgccgggccagtcagtagtattagtgtcgtgggtggcctggtatcagcaagaaaccgagggaaacgcccctaaggtcctgactctatgagcatactaactttaaaactgtctccatctaaggtcagcgnagtgatcngggacagtaattcactctcgcatcagcacgcctgacacgtcctagatgtactttcgactacttaaactttgttacctcgaaccctaaagtagttaatttagttaaaggttacggttaccggggggtaacgtttccggaaacggtaaacgggtaaccgtaaaggggttaacgaaaacttacgaaaaacgtcgttaaggtcggactacgacctacctacgtcgttactttacc

SEQ ID NO: 428009 - DNA, 598 bp, Homo sapiens
  misc_feature: GZ8MTXP02GNAHR.22.25.C03.1.454.CMB.2.raw
  modified_base (432)..(432): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccacctgtctgcatcgtgtaggagacagattaccatcacttggccggcagtcagtagttattagtgtcgtgggtggcctggtatcagcaagaaaccgagggaaacgcccctaaggtcctgatctagtgagctattacttaaacgtttaaaacgtggtacgtaccatacgtaaggttccaggcgacgaggtgatcgtgggacaagtattcactctcgctatcagcacgcctgacgacgtctagattgacttcgtanacttaactttagtactcgacctaaagtagtttaattaagttaggttacggtacgggggtacgtccgggaaccggaaacggggtactaaacggggtaagaaacgtaaccgaaaacgtacgttaggtaacggacgtacggaccaccgtacgttccgttacgtttaccc

SEQ ID NO: 428010 - DNA, 826 bp, Homo sapiens
  misc_feature: GZ8MTXP02H4LWJ.22.25.C03.1.454.CMB.2.raw
  modified_base (284)..(284): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtcctccttccaccctgtctgcatctggtaggagacagacgttaccatcacttggccggcagtcagagtattagtgtctgggtgcctggtatcgagcaagaaaccgagggaaacnccccgtaaggtcctagacttctagtacggaggactaagttacctttaaaacgttttaaaaaacgtgggttaccgtacccctaattaccgtaaacggggtttcccacggggtaccgggtacgaaggggttcggaacgtttccggttagggggaaaccgtaaaggttaaaacctttcccgtaacccttcccgttacccgaccctaaccgttaccgaacgggtacctaaccgggaccccttcgggacccgtaacggggtcccttaccgggttaaagttcggttaaaccttttccgttaacggttaaccctttaaaacgtttttaaccttttaaaccgggaccgtacccctaaaagtttaacgttaaagttttaaccggttaaagggttttaaccgggggtaccggggggttaacccgtttaacccgggggaccccgtaaaagggggtaaacccggtaaagggtaaccggggtaaaaactacccgaaaaaccggttaagtcgggtaacgggtctaacgtacccgtacaccgtttgttcgtttaccc

SEQ ID NO: 428011 - DNA, 519 bp, Homo sapiens
  misc_feature: GZ8MTXP02J2LMD.22.25.C03.1.454.CMB.2.raw
  modified_base (242)..(242): a, c, t, g, unknown or other
  modified_base (321)..(321): a, c, t, g, unknown or other
  modified_base (357)..(357): a, c, t, g, unknown or other
  modified_base (397)..(397): a, c, t, g, unknown or other
  modified_base (405)..(405): a, c, t, g, unknown or other
  modified_base (409)..(409): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagngtctggtggcctggtatcagcagaaaccaggaaagcccctaaggtcctgatctatgaggcatctactttaaaactggtntccatcaagttccagcgcagtgatctgggacagatnactctcgtccatcagcagccctgcagcctgactgattcgnctaacttntacngaccaacagttatataggttagtcgggggtacgttcggcgaaaggaccgaaggtaggaaactacgaaaacgtaccgtaggtaaggctagacctacactactcgtttaccc

SEQ ID NO: 428012 - DNA, 630 bp, Homo sapiens
  misc_feature: GZ8MTXP02HG9TM.22.25.C03.1.454.CMB.2.raw
  modified_base (385)..(385): a, c, t, g, unknown or other
  modified_base (399)..(399): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcagttgccggcagtcagagtattagtgtcgtgggtggcctggtatcagacaagaaacgagggaaacgtccccgtaaggtcctgactctagtggaggctatacttaaactttaaaacgtggtacgtaccctatacgtaaggttccgaggcggcgtaggtggattcgtggaanagtaacttcactcncgaccatacagctacgccgtgacgacgcctagtacgtatacttcgtacgtacttaaactttactactacgtaacctaacgtaagttaattaagttaaggttacgggtaccgggggtaacgttaccgggaaccggtaaaacggggaaccgtaaagggtaacgtaaaacgtaaccgaaaacgtacgtacggtcgtacgtacgaccgtaactacgtttaccgttcgtttacccg

SEQ ID NO: 428013 - DNA, 752 bp, Homo sapiens
  misc_feature: GZ8MTXP02HKGBV.22.25.C03.1.454.CMB.2.raw
  modified_base (200)..(200): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctccaggtgccaaatgtgacatccagatgacccagtctccttccaccctgtctgcatctgtagganacagagttaccatcacttgccggcagtcagtagtattagtgtctgggtgcctggtatcagcaagaaaccgaggaaacgcccctaaaggtcctagtactctagtgaggctaataccttaacgtttaaaactggtacgtacctatacgtaacgttccgagacgcgtagtcggtaagttcgtacggggtaactaacgtaacgtttaccgacctttccgtaccgtaccctaagttaccaacggtacccgaaggtcccgttagacccgtaacggtccccgttaagggtaattacgttaagtttacccggtacgtttaacccttaaaccggtttttaactttaacccgttaccgggttaaaccctaaaaccgttaagggtttaaacctttaagggttaacgggtttaaccgggttaccggggggttaaccgtttaccggggaaacccgtaaaacgggggtacccggtaaaagggttaacgggtaaaacgtacccggtaaaaacgtcgtaacggtaacggtaccgttacgaccgtaccgtactccgttacgtttacccg

SEQ ID NO: 428014 - DNA, 622 bp, Homo sapiens
  misc_feature: GZ8MTXP02GCXNQ.22.25.C03.1.454.CMB.2.raw
  modified_base (435)..(435): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatcgacccagtctccttccaccctgtctgcatctgtaggagacagtacgttaccatcacttggccggcagtcagtagtattagtgtctgggtgctggtatcagcgaagaaaccgagggaaacgccccgtaaaggtcctgacttctagtgaggctagtaccttaaactttaaaacgtggttactaccctatacgtaaggttccgaggcggctaggtggactcggtggggacaaggtaacttcactctcgccatcagcacgctgcacgtcctgatntacgttctcgtaactaactttactacgtcgaacctaaactagtttaattgtaaagggttacggtaccgggggtacgttaccggggaaaccgtaaacggggaccgtaaaggggtaacggtaaaacgtaacgaaaacggttacgtagggtaaccgtcgtacggactaccgtacgtttcgtacggtttcc

SEQ ID NO: 428015 - DNA, 600 bp, Homo sapiens
  misc_feature: GZ8MTXP02FG8BK.22.25.C03.1.454.CMB.2.raw
  modified_base (398)..(398): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagtatgacccagtctccttccaccctgtctgcatctgtagggagacaggagttaccatcgaacttcgccgggccagtcagaggtattagtgtctgggtggtcctggtatcagcagaaaccaggaaagcccctaaggtcctcgatctactgaggacgatactacgttaaaactaggtgtccatctaaggttactagcggcgacgtggagtctgggacaagaagttacactctcgacactnacgcagcctcgcgagccctagtacgagactttcttgacctaaacttaattactcgaccaaacgtagttattaagttaggtagttaccgggggagttaccggaccgttaaaacggggacctaaaagggttacggaaaacgttaccgaaaaaccggaagtagttaacggggaacttcggaccaccctatacccgttgtttaccg

SEQ ID NO: 428016 - DNA, 732 bp, Homo sapiens
  misc_feature: GZ8MTXP02I9LEW.22.25.C03.1.454.CMB.2.raw
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccacctgtctgcatctgtaggagacagagttaccatcacttgccggcagtcagagtattagtgtctgggtggctggtatcgagcagaaaccacgggaaacgaccccgtaacgtcctagactcgtataggaggctataccttaaactttaaaaacgttacggttacgtacctaactacgtaaacggttaccgtacggacggtaccgtaaggttacggtacgttacggtacgggggtaacaacgggtaaacttccgtaaccttaccgtccgaccctaacgttaccaaagggcaaacgggcccgttagaccgaacggtccctagtactacggtatttaccgtacggtacttaaaccttttaagtacctacggttaacccaaaacgttacggttaatttaaacgttaacgggtttacggttaaccggggggtaccggtttaccgggaaacccgtaaacgggggtaaaacccgtaaagggggtaaacggtaaaactacggaaaaaccgtagtacgggtcgtactacggtaccaaccgtaattcccggttaagttttcccg

SEQ ID NO: 428017 - DNA, 666 bp, Homo sapiens
  misc_feature: GZ8MTXP02GNBKJ.22.25.C03.1.454.CMB.2.raw
  modified_base (267)..(267): a, c, t, g, unknown or other
  modified_base (305)..(305): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatcgacccagtctccttctaccctgtctgcatctgtaggagacagtacgttaccatctacttcggccggccagtcagtagttattagtgtcgtgggtgcgtggtancgagacaaggaaaccgagggaaactaccccgtagtctnatctagtcgagactatacttaaaactttaaaacgtggttcgtaccagtacgtaacggtccaggcgcgtagtacggtattacggtaggggtaacaacggttaattcctaaccgttccgtaccgtacccattccgaaacgccgaacggtcctacggacacgtcctaggtcttagtacttctaacgtacttaacgttttactacctacaaccctaaagttacgttagtttaaagtttacgggttaggggttaccggggtacggttaacggaccggtaaaacgggtaccgaaaggggtaaagaaactaacggaaacgtaccgttggccgtaccgtagaccctacgttacgtcgttcgtttacccg

SEQ ID NO: 428018 - DNA, 745 bp, Homo sapiens
  misc_feature: GZ8MTXP02FF9CN.22.25.C03.1.454.CMB.2.raw
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctcctccacctgtctgcatctgtaggagacagtagttaccatcacttggccgggccagtcagagttattagtgtcgtgggtggctggtatcagacaagaaaccagggaaacgcccctaaggtcctagatctagtgaggcatacgtaactttaaaaactggtacgtcccaataccgtaaggttccaacggtcggcgtaaggtggaactcggtacggggaacaacggttaaactttccaacgttctccggacctaacgttccaaaggcaacgggtcccctaggacgaacggtcccttaggacttacggtaaactttcccgttaaagtaaacctttaaaccgttttaacgttaaccgttaaccggtaaacccttaaaacgttaaacggttttaaacgtttaaacggtttaacgggttaacgggggttacccggggggtttaacccggttaacccggggaaaccggtaaaaccggggtaaccgggttaaaacgggtaaacggtaaaacctaaaccggtaaaaccgtacgttacgggtaacggtaccgtacgaaccctacgtacgtacgttcgttaccc

SEQ ID NO: 428019 - DNA, 710 bp, Homo sapiens
  misc_feature: GZ8MTXP02GKGED.22.25.C03.1.454.CMB.2.raw
  modified_base (201)..(201): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtagganacagagttaccatcacttgccgggcagtcagagtattagtgtctggggtggcccgtggtatcgagacgaaacgaaaaccggaaacgggaaaccgtaccccggttaaacggtaccgtagtacttacctaagtggaacggtactaacttactttaaaacgttttaaaaacgtggttaccgtaccctaagttaccgtaaggttacccgaggtaccggtacgaggttaggacttccggtaggggacctaaaggtaacttaccacctacgtaccgacctagtacacgtacaggtccctggacaaccggtccaggtactagtactttacgcgaaacctttaaactttagtaacgtcgaaaccctaaaagtctttaaagtttacgtaaggttacgggtacgggggtaccgttacggaacggtaaaacgggtacgtaaacggggtaaagaaacgtaacgtaaaaaccgaggttagcggtaccgtacgaccctaaactccgttacgtcgtttaaaccc

SEQ ID NO: 428020 - DNA, 750 bp, Homo sapiens
  misc_feature: GZ8MTXP02JJW10.22.25.C03.1.454.CMB.2.raw
  modified_base (261)..(261): a, c, t, g, unknown or other
  modified_base (317)..(317): a, c, t, g, unknown or other
  modified_base (391)..(391): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagtagtaccatcacttggcccggcagtcagtagtattagtgtcgtgggtgcctggtntcgagacaacgaaaccgaagggaaaccgtcccctaagggtcctagacttacgtagngacggtctacttaaccgtttaaactttaaaacgtggtacgtacccgtataacgtaaggtcccgaggccgggtanaggtaggtacgttcggaggggtaacaaggtaacttaccacttccgtcgaccctatccgaacgcaccgtacctcgggaccacggtcccgttaggacttaacggtcttttaacgacggttaaacctttaaaccgtttcttaaacccggttccgggaaaaccttaaaccgttaaggtttaagtttaaggtttaacgggttaccgggggttaaccgggggttaacggggttaccccggaaacggggtaaaaccggggttaaacggaaacggggtaaaacgtaaaccgtaaccggtaaaaccggtaccggttggtaaccggacgtaccgaacggttaacctcggttaaccgttcgtttaacccg

SEQ ID NO: 428021 - DNA, 841 bp, Homo sapiens
  misc_feature: GZ8MTXP02FLHGO.22.25.C03.1.454.CMB.2.raw
  modified_base (204)..(204): a, c, t, g, unknown or other
tcagacatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatcgacccagtcctcccttccaccctgtctgcatctgtagganaacgagtacgttaccatcacgttcggccgggcagtacagtagttataggtgtcgtggggtcgtccgtggtactcagacgaacgaaaccgaagggtaaacccgtaccccgtaacggttcctagacttaccgtaagtcggacggtcctaagtttaaccttaaaaccgtttaaaaaccgtggttaccgtacccctaataccgtaaggttccccgaggaccgcgtaggtggacgttcgggtagggaaactacgtaaacttaccgtaaccttcgtaccgtacccaagttcccgaaacggtccgaaaccgtcccgtacgggaccctacgggtacccttaggtacgttacgttactttaccgtcgttaaacccttaaacgtttaccgttaccgtaccgaaccctaaacccgtttagttaaaacggtttaacgtttaacggggttaaaccgggggtacccgggggttaaacggtttaccccgggggaaaaccgtaaaacccgggggttaaaccggtaaacgggttaaaacccgggaaaagtttaaaaccccggtaaaaaccgggtaaacgtttcgggggtaaaccggtaccgttaaccggtaaacccgtaccgtttaaaaccggttcctttcgtttaaacccccg

SEQ ID NO: 428022 - DNA, 440 bp, Homo sapiens
  misc_feature: GZ8MTXP01DIQIE.8.81.H04.1.454.CMB.2.raw
  modified_base (432)..(432): a, c, t, g, unknown or other
  modified_base (434)..(440): a, c, t, g, unknown or other
tcagctcgcgtgtccacgaccggtgctcgatttagtagtgtagattcgcgggaagatgaagacagagtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgattttgctacttattactgccaacagtattagttactttttctccggactacgttttgggccgggggaccaaggctgggagatacaaacgaactgtggcctgcaccatctgttcttcatccttcccgctatctgacacacgcgagctggagcgggctgggacaagggcgacatagngnnnnnnn

SEQ ID NO: 428023 - DNA, 330 bp, Homo sapiens
  misc_feature: GZ8MTXP01BC93Z.8.81.H04.1.454.CMB.2.raw
  modified_base (208)..(208): a, c, t, g, unknown or other
  modified_base (291)..(291): a, c, t, g, unknown or other
  modified_base (320)..(320): a, c, t, g, unknown or other
  modified_base (326)..(330): a, c, t, g, unknown or other
tcagctcgcgtgtccacgaccggtgctcgatttagtagtgtagattcgcgggcgtagactttgtgtttctcgtagtctactttggaaagtggggtcccatcaaggttccgcggcagtggatctgggacagacttcactctcaccatcagcagcctgcagcctgatgattttgctacttattactgccaacagtatagttactttttcnccggacacgttttggccgggggacaagctggagatcaaacgactgtggctgcaccatctgtctcatccttcccgcatctgacncacgcgagctgagcgggctggacaaggcncatagnnnnn

SEQ ID NO: 428024 - DNA, 460 bp, Homo sapiens
  misc_feature: GZ8MTXP02H49JE.8.81.H04.1.454.CMB.2.raw
  modified_base (299)..(299): a, c, t, g, unknown or other
  modified_base (333)..(333): a, c, t, g, unknown or other
  modified_base (349)..(349): a, c, t, g, unknown or other
  modified_base (444)..(460): a, c, t, g, unknown or other
tcagctcgcgtgtccacgaccggtgctcgatttagtagtgtagattcgcgggaagatgaagacagagtcaccatcagttgccgggccagtcacagtattgacaatttgttggcctggtatcagcagaaaccaggaaagccccgaacctcctgatctatcaggcgtctactttggaaagtggggtcccatcaaggttccgcgcagtggatctgggacagacttcactctcaccatcagcagcctgcagcctgatgtatttgcttacttattactgaccaactagtatagttacttttccnccggtactacgtttggaccggggacaagctgganatacaaaacgtactgngcctgacacatctgttctcaccttcctcccgactactcgacgacgaccgacgcgagcgtaggacggtcgggcgtcgggacgaacgggcagagagnnnnnnnnnnnnnnnnn

SEQ ID NO: 428025 - DNA, 327 bp, Homo sapiens
  misc_feature: GZ8MTXP02GKDAM.8.81.H04.1.454.CMB.2.raw
  modified_base (299)..(299): a, c, t, g, unknown or other
  modified_base (325)..(327): a, c, t, g, unknown or other
tcagctcgcgtgtccacgaccggtgctcgatttagtagtgtagattcgcgggcgtagactttgtgtttctcgtagtctactttggaaagtggggtcccatcaaggttccgcggcagtggatctgggacagacttcactctcaccatcagcagcctgcagcctgatgattttgctacttattactgccaacagtatagtactttttctccggacacttttggccggggaccaagctggagatcaaacgaactgtggctgcaccatctgtcttcatcttcccgccatctgagacacgcganctgagcgggctggcaaggcgcatagnnn

SEQ ID NO: 428026 - DNA, 422 bp, Homo sapiens
  misc_feature: GZ8MTXP02FRSDY.8.81.H04.1.454.CMB.2.raw
  modified_base (294)..(294): a, c, t, g, unknown or other
  modified_base (414)..(422): a, c, t, g, unknown or other
tcagctcgcgtgtccacgaccggtgctcgatttagtagtgtagattcgcgggaagatgaagacagagtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgatttgctacttatactgccaacagtatagtacttttcnccggactacttttggccggggaccaagctggagatcaaacgactgtggcctgcaccatctgtcttcatcttcccgccatctgagacacgcgagctgagcgggctggcaagggcgcatagnnnnnnnnn

SEQ ID NO: 428027 - DNA, 499 bp, Homo sapiens
  misc_feature: GZ8MTXP02JJEJK.8.81.H04.1.454.CMB.2.raw
  modified_base (310)..(310): a, c, t, g, unknown or other
  modified_base (485)..(485): a, c, t, g, unknown or other
  modified_base (488)..(499): a, c, t, g, unknown or other
tcagctcgcgtgtccacgaccggtgctcgatttagtagtgtagattcgcgggaagatgaagacagagtcaccatcagttgccgggccagtcacagtattgacaatttgttggcctggtatcagcagaaaccaggaaaagccccgaacctcctgatctatcaggcgtctacttggaaagtggggtcccatcgaaggttccgcggcaggtggatctgggacagacttcactctcaccatcagcagcctgcagcctgatgtattttgcttacttagttactcgacccaactacgtatacgttacctttttacncccggtactaccggttttcggggacccgggggaacctaaggccgtagggtagaacttccgaaaaacgtactggttcggccttcgacctaaccctattcttacgttccttcgacttcccttcccgcctatccgtgacgacccacgaccgagcgtgacgtcggccaggcaagggtcntannnnnnnnnnnn

SEQ ID NO: 428028 - DNA, 582 bp, Homo sapiens
  misc_feature: GZ8MTXP02IJ0HN.3.14.B03.1.454.CMB.2.raw
  modified_base (344)..(344): a, c, t, g, unknown or other
  modified_base (365)..(365): a, c, t, g, unknown or other
  modified_base (388)..(388): a, c, t, g, unknown or other
  modified_base (392)..(392): a, c, t, g, unknown or other
  modified_base (528)..(528): a, c, t, g, unknown or other
tcagagacgcactccacgaccggtgctcgatttagtgtgagtagtcccgcggaactactcacacccatggcctggaccgttctcctcctcggcctcctctctcactgcacaggctctgtgacctcctatgtgctgactcagccaccctcggtgtcagtggccccaggaaagacggccaggattacctggtggggaaacaaattggagataaagtgtgcactggtaccagcagaagccaggccaggcccctgtgctggtcatccattctgatagcgacccgcccctcagggatccctgagcgattctctggctccactctgcgacacgcccacctcgacccatcngcgagggtacgagccgggggntaggacggccactattctttcgngtgnggtgggagtattagttatgttgagttactcggtcgggacgggacggtaacacgtcgaccgtcgtaaccgtcgacgaccgaaccggactccgtccccctccggttccgttctaccttccgttccgttaaaccccccncccgttaccgtggtcgcgtccgtccgtacgcgggcggtccggtacgtacggacg

SEQ ID NO: 428029 - DNA, 509 bp, Homo sapiens
  misc_feature: GZ8MTXP02G5XHS.3.14.B03.1.454.CMB.2.raw
  modified_base (287)..(287): a, c, t, g, unknown or other
  modified_base (329)..(329): a, c, t, g, unknown or other
tcagagacgcactccacgaccggtgctcgatttagtgtgagtagtcccgcggaactactcacacccatggcctggaccgttctcctcctcggcctcctctctcactgcacaggctctgtgacctcctatgtgctgactcagccaccctcggtgtcagtggccccaggaaagacggccaggattacctgctctggagatgcattgccaaagcaatatgcttattggtaccaacaaaagccaggccaggcccctgtggtggtgatatataaagacagtgagaggccctnagggatccctgagcgattctctggctccagctcagggacaanacgtcacgttgaccatcagtggagtccaggcagagacgaggctgactatatgtacaatcagcaagacaacagtaatacttatactttatgtcttcggatcgtgggacagggtcacgtcgtacggtcacgacccaaggacccaacccgactcgtacaactctcgttcccacctctcgatcg

SEQ ID NO: 428030 - DNA, 775 bp, Homo sapiens
  misc_feature: GZ8MTXP02GJSCP.3.14.B03.1.454.CMB.2.raw
  modified_base (272)..(272): a, c, t, g, unknown or other
tcagagacgcactccacgaccggtgctcgatttagtgtgagtagtcccgcggaactactcacacccatggcctggaccgttctcctcctcggcctcctctctcactgcacaggctctgtgacctcctatgtgctgactcagccaccctcggtgtcagtggccccaggaaagacgccaggattacctggtaggggaaacaaaagttggagaataaaagtgtgcactggtaccagcagaagccaggccacggcccctgtgctggcactcattcngatagccgacccgcccctgacgggactccccgtgacgcgtattctcgtcggcctccaactctgaccgaacaccggcccaccctgaccccatcacgcgaggggtaccgaaggggtcccgggggatcgggacgggtacccgtaaacgtttacgtttcgtttacggggtccgtaaggggttggtagggggtaaatttacgggtttaaacgttaacgttgggttaaggttaagtttaacgggttaccgggggcggggaaacgggggtaacccaaagggtcccgtacgggtaccccggtccgttaacgggtacccgaccgggtcccgaaacggggtccgttccccgtcccccccggttcgggttacccctaccgtttccccgtttccccggtttaccccccgtcccccggttccccgttaccgggtaccgttccggttaccccggttccttaccggttaccgggaccggggtaccggggtcccggttacggggaccgtaaaccggggg

SEQ ID NO: 428031 - DNA, 408 bp, Homo sapiens
  misc_feature: GZ8MTXP01EXJR6.13.42.D09.1.454.CMB.2.raw
  modified_base (403)..(408): a, c, t, g, unknown or other
tcagtcacgtactacacgaccggtgctcgatttagacacatacgcagggaaagggactggagtggattgcatacatgagtggaggtggagccaccagatactacgcagagtctgtgaaggaccgtttcatcatttccagagacaacgccaagaactctctgttcctacaaatgaatcgcctgagccccgaggacacggctgtctactactgcgggagacgaggctttgactacgtggggccaggggaaccctggtcaccgtctcctcagcctccaccaaggcccatcggtctccccctggcaccctcctccaagacgcacctctgggggcacagcggcctgggctgcctggtccaaggactactcctagtaacgtgctgagcgggctgggcaaggcgcatagnnnnnn

SEQ ID NO: 428032 - DNA, 427 bp, Homo sapiens
  misc_feature: GZ8MTXP01ASLTH.13.42.D09.1.454.CMB.2.raw
  modified_base (333)..(333): a, c, t, g, unknown or other
  modified_base (422)..(427): a, c, t, g, unknown or other
tcagtcacgtactacacgaccggtgctcgatttagacacatacgcagggaaaggggctggtgtgggtctcacggattgacaatgatgggagagacacaatccacgcggattctgtgaggggccgattcaccacatcgagagacaacgccaagaacacggtatatctgcaaatgaacagtctgagaggcgaagacacggcggtttacttctgtgcaagaggtggctggtcgcatggttttgattctctgggggccagggggacaaagtggtaaaccgtctcttcagcctccaccaaggcccatcggtcttcccctggccgccctgctccaggcncacctccgagagcacacgccggcctgggctgccctgggtcaaggactacttcctagtacgtgactgagcgggctggcaaggcgcatagnnnnnn

SEQ ID NO: 428033 - DNA, 414 bp, Homo sapiens
  misc_feature: GZ8MTXP01EUCTF.13.42.D09.1.454.CMB.2.raw
  modified_base (409)..(414): a, c, t, g, unknown or other
tcagtcacgtactacacgaccggtgctcgatttagacacatacgcagggaaagggactggagtggattgcatacatgagtggaggtggagccaccagatactacgcagagtctgtgaaggaccgtttcatcatttccagagacaacgccaagaactctctgttcctacaaatgaatcgcctgagccccgaggacacggctgtctactactgcgggagacgaggctttgactacgtggggccaggggaaccctggtcaccgtctcctcagcctccaccaagggcccatcggtcttccccctggccaccctcctccaagagcacctctgggggcacgagcggcccctgggctgcctggtccaaggactacttcctagtaaccgtgctgagcgggctggcaaggcgcatagnnnnnn

SEQ ID NO: 428034 - DNA, 487 bp, Homo sapiens
  misc_feature: GZ8MTXP01CHN12.13.42.D09.1.454.CMB.2.raw
  modified_base (468)..(468): a, c, t, g, unknown or other
  modified_base (471)..(471): a, c, t, g, unknown or other
  modified_base (473)..(487): a, c, t, g, unknown or other
tcagtcacgtactacacgaccggtgctcgatttagacacatacgcagggaaagggactggagtggattgcatacatgagtggaggtggagccaccagatactacgcagagtctgtgaaggaccgtttcatcatttccagagacaacgccaaagaactctctgttcctaacaaatgaatcgcctgacgccccgaggacacggctgtctactactgcgggagacgaggtctttgactacgtggggaccgacgggtaaccctggtccacccgtctcctcgacgccctccaaccgacgggccccacgttcccggtcccttcccccgtcggccccacccctccctacccaaagccgccacccgtcggtcgggggaccacgacggccggccgtggcctcgccgtcggtaccaaggtacttacgttacctaagtaacccgtgcgtggacggccgggctacgggaccgaagcgtanagngnnnnnnnnnnnnnnn

SEQ ID NO: 428035 - DNA, 494 bp, Homo sapiens
  misc_feature: GZ8MTXP01AJ7NF.13.42.D09.1.454.CMB.2.raw
  modified_base (482)..(494): a, c, t, g, unknown or other
tcagtcacgtactacacgaccggtgctcgatttagacacatacgcagggaaagggcctggagtggattgggtacatctattacagtgggactacctactataatccgtccctcacgagtcgagtgaccatatcagtagacacgtctgagaaccagttctccctgaaactgagttctgtgactgccgcggacacggccgtgtattattgtgcgagaggtgagtggatggttcagggtatttctttgactacgtggggccaggggaccctggtcaccgtctcctcacgcctccaccgacggcccatccggtccttccccctggcccacccctccctaccaacgtacgccacccgtcgtcggggggccacgacggccggcccgtcggggccgtccggcctgggtaccgaacggtaccttaaccttcccgtaaggtaccgtggacgttggacggcgggcgtcgggacgaagggccgacgagtacgnnnnnnnnnnnnn

SEQ ID NO: 428036 - DNA, 497 bp, Homo sapiens
  misc_feature: GZ8MTXP01ALKI2.13.42.D09.1.454.CMB.2.raw
  modified_base (280)..(280): a, c, t, g, unknown or other
  modified_base (328)..(328): a, c, t, g, unknown or other
  modified_base (476)..(482): a, c, t, g, unknown or other
  modified_base (484)..(497): a, c, t, g, unknown or other
tcagtcacgtactacacgaccggtgctcgatttagacacatacgcagggaaaggggctggtgtgggtctcacggattgacaatgatgggagagacacaatccacgcggattctgtgaggggccgattcaccacatcgagagacaacgccaagaacacggtatatctgcaaatgaacagtctgagaggcgaagacacggcggtttacttctgtgcaaggaggtgctggtcgctagttggttttgattctcgtgggtaccgaggggacaagtggtaaccgtntcttcacgccctccaccgaacgggccctagtccggtcccttcccccgnggccgccctgttccaggtcgccacccgtccgagacgccacgacggccccggaccctggggctcgcccgtgggtaccaaggtacctaccgtttccgtaagtaccggtgacgtggacggtcgggactcgggacgaaggcgactagtacgnnnnnnngnnnnnnnnnnnnnn

SEQ ID NO: 428037 - DNA, 423 bp, Homo sapiens
  misc_feature: GZ8MTXP02JJ0ZS.13.42.D09.1.454.CMB.2.raw
  modified_base (418)..(423): a, c, t, g, unknown or other
tcagtcacgtactacacgaccggtgctcgatttagacacatacgcagggaaagggcctggagtggattgggtacatctattacagtgggactacctactataatccgtccctcacgagtcgagtgaccatatcagtagacacgtctgagaaccagttctccctgaaactgagttctgtgactgccgcggacacggccgtgtattattgtgcgagaggtcgagtggatggttcagggagttcttttgactactggggccaggggaaccctggtcaccgtctcctcagcctccaccaagggcccatcggtcttccccctggcaccctcctccaagagcacctctggggcacagcggccctgggctgcctggtcaaggctacttctgtacgtgactgagcgggctgggcaaggcgcatagnnnnnn

SEQ ID NO: 428038 - DNA, 405 bp, Homo sapiens
  misc_feature: GZ8MTXP02GNEEN.13.42.D09.1.454.CMB.2.raw
  modified_base (314)..(314): a, c, t, g, unknown or other
  modified_base (378)..(378): a, c, t, g, unknown or other
  modified_base (399)..(405): a, c, t, g, unknown or other
tcagtcacgtactacacgaccggtgctcgatttagacacatacgcagggaaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaaggggacccacgggtcaccgtctcctcagccctccaccaagggcccatcggtcttccccctggcgccctgctccaggancacctccgagacgcacagcggccctgggctgcctggtcaaggcctactcctagtacgtgactgngcgggctggcaggcgcatagnnnnnnn

SEQ ID NO: 428039 - DNA, 489 bp, Homo sapiens
  misc_feature: GZ8MTXP02ILLLJ.13.42.D09.1.454.CMB.2.raw
  modified_base (268)..(268): a, c, t, g, unknown or other
  modified_base (475)..(489): a, c, t, g, unknown or other
tcagtcacgtactacacgaccggtgctcgatttagacacatacgcagggaaagggactggagtggattgcatacatgagtggaggtggagccaccagatactacgcagagtctgtgaaggaccgtttcatcatttccagagacaacgccaagaactctctgttcctacaaatgaatcgcctgagccccgaggacacggctgtctactactgcgggagacgaggtctttgactacgtggggccagggaaccctggtcaccgtctcctcncgcctccaccacggcccagtccggtccttcccccgtggccacccctcctccaagcgccaccctcggtcggggccacgacggccggccccgtcggggcctcggcccgtcggtaccccgaaacgggtaccttaccgtttacccgtaggttaccggtcgtaccgttgggaacggccggggtcgtcggggacgaaacgggccgacagtagnnnnnnnnnnnnnnn

SEQ ID NO: 428040 - DNA, 440 bp, Homo sapiens
  misc_feature: GZ8MTXP02HPGHD.13.42.D09.1.454.CMB.2.raw
  modified_base (418)..(418): a, c, t, g, unknown or other
  modified_base (433)..(440): a, c, t, g, unknown or other
tcagtcacgtactacacgaccggtgctcgatttagacacatacgcagggaaagggcctggagtggattgggtacatctattacagtgggactacctactataatccgtccctcacgagtcgagtgaccatatcagtagacacgtctgagaaccagttctccctgaaactgagttctgtgactgccgcggacacggccgtgtattattgtgcgagaggtcgagtggatggttcagggtatttcttttgactacgtggggccaggggaaccctggtcaccgtctcctcagcctccaccaaggcccatccggtccttcccccctggccaccctcctccaagacgccacctcgtgggggccacgacgccggccccgtgggcctcgcctggtcaaggactacttctgtacgtgatgagcgggntggcaggcgcatagnnnnnnnn

SEQ ID NO: 428041 - DNA, 495 bp, Homo sapiens
  misc_feature: GZ8MTXP02GXTW6.13.42.D09.1.454.CMB.2.raw
  modified_base (334)..(334): a, c, t, g, unknown or other
  modified_base (359)..(359): a, c, t, g, unknown or other
  modified_base (372)..(372): a, c, t, g, unknown or other
  modified_base (450)..(450): a, c, t, g, unknown or other
  modified_base (463)..(463): a, c, t, g, unknown or other
  modified_base (471)..(495): a, c, t, g, unknown or other
tcagtcacgtactacacgaccggtgctcgatttagacacatacgcagggaaagggtcgtggagtggattggggaaatctatcatagtgggaccacctactacagcccgtccctcaatagtcgcgtcaccatgtcagtggacgagcccaagaaccagttctccctgagcctgacctctgtgaccgccgcggactccggccctatacttctgtgtgagagatcgagatgtgtcagtcggcggggctacttttgatatcgtggggccaagggtcgagtggcatcgtctcttcacgccctccaccgaacgggcccctagtccggtccccttcccccgngggcccgcccctcgcctccgaggcnccaccgtcgagcncccacgcgccggccctgggcctcgccgtgtacgaacggtaccttaccgtcgtaagtcgtcgacgtggacggcgggcgnggacgacgggccntaacgtgnnnnnnnnnnnnnnnnnnnnnnnnn

SEQ ID NO: 428042 - DNA, 549 bp, Homo sapiens
  misc_feature: GZ8MTXP01CSUHA.45.14.B03.1.454.CMB.2.raw
  modified_base (529)..(529): a, c, t, g, unknown or other
  modified_base (544)..(544): a, c, t, g, unknown or other
tcagacgcgatcgacacgaccggtgctcgatttagtgtgagtagtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgagttttggagtggttaattcgggcggtatgggacgtcgtggggaccaagggaccacggtcaccggtctcctcacgcctccaccgaacgggcccagtccggtccttcccccgtggggccctaccccgtcctaccaacgcgcgaccctcgtcgggggccacgacgccggcccgtggctgccgtggtcaggcttactcncgaatcgcgttctgngcggg

SEQ ID NO: 428043 - DNA, 569 bp, Homo sapiens
  misc_feature: GZ8MTXP01D6PUV.45.14.B03.1.454.CMB.2.raw
  modified_base (272)..(272): a, c, t, g, unknown or other
  modified_base (290)..(290): a, c, t, g, unknown or other
  modified_base (325)..(325): a, c, t, g, unknown or other
  modified_base (408)..(408): a, c, t, g, unknown or other
tcagacgcgatcgacacgaccggtgctcgatttagtgtgagtagtttgggtttgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatgganctgagcgagtcgcgaagntctagacgacacggcgtgtattactgtgcgagagnagaatacgtatttgtagtgttagttcggtacggtaagtggtacgtcgtgggccgaacgggacgaacggtccgaccgtctctcncgcctaccgaccgacgccgacgtccgtccgtcccgtccgccgaccctcctaccgacgacgccgccgtcggtcgggcgacgacgccggccggtcggcgcgtccgttcggtacgtaacgttacgttccttccgtcgtcgtcgtcgtcgttcggtcggcggtcg

SEQ ID NO: 428044 - DNA, 552 bp, Homo sapiens
  misc_feature: GZ8MTXP01E0UCV.45.14.B03.1.454.CMB.2.raw
  modified_base (313)..(313): a, c, t, g, unknown or other
  modified_base (533)..(533): a, c, t, g, unknown or other
  modified_base (547)..(547): a, c, t, g, unknown or other
tcagacgcgatcgacacgaccggtgctcgatttagtgtgagtagtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggccgtgtattacngtgcgagaggcaggaattacgatttttggagtggttaattcgggcggtatgggacgtctgggggcaagggaccacggtcaccgtctcctcagccctccaccgaacgggcccactccggtccttccccctcggggccacccctcctccaagacgccacctcgtcgggggccacgacgccgggcccctggggcctcgccgtggtcaacgggcttacgttccncgctcgcgttctgngcggg

SEQ ID NO: 428045 - DNA, 637 bp, Homo sapiens
  misc_feature: GZ8MTXP01CAJSQ.45.14.B03.1.454.CMB.2.raw
  modified_base (261)..(262): a, c, t, g, unknown or other
  modified_base (288)..(288): a, c, t, g, unknown or other
  modified_base (321)..(321): a, c, t, g, unknown or other
  modified_base (603)..(603): a, c, t, g, unknown or other
tcagacgcgatcgacacgaccggtgctcgatttagtgtgagtagtttggggctgaggtgaagaagcctggggcctcagtgaaggtctcctgcaaggcttctggatacaccttcaccggctactatatacactgggtgcgacaggcccctggacaagggcttgagtggatgggatggatcaaacctaacaatggtgacaacaaactatgcacagaagtttcgagggcagggtcaccatcgacagggacacgtcatcagcacnnctacatggagctgagcgagctagagntcgcgacgacgacggaccgttgtaactttacgngtacgacggagacggtacgaagttaaccgttagttagttttaggagttaggttaagttacgggaaggttagtgggacgttcgggacgggaccggaacgggacccgtacgtcctacgtcctcctcgacgccctaccaccgtaccgcctacgtccgtacccttccccgcgggccctaccccgtaccacccgaaagccgccgtaccgttcggccgggtccacgggaccgcccgggtcccgttcggccgttcggaccgtcggtacgaacggttcttaccgttccgngtaaccgtcggtcgttaccgtaaggcggtccggg

SEQ ID NO: 428046 - DNA, 649 bp, Homo sapiens
  misc_feature: GZ8MTXP01BG3TY.45.14.B03.1.454.CMB.2.raw
  modified_base (137)..(137): a, c, t, g, unknown or other
  modified_base (265)..(265): a, c, t, g, unknown or other
  modified_base (319)..(319): a, c, t, g, unknown or other
  modified_base (353)..(353): a, c, t, g, unknown or other
tcagacgcgatcgacacgaccggtgctcgatttagtgtgagtagtttggggctgaggtgaagaagcctggggcctcagtgaaggtctcctgcaaggcttctggatacaccttcaccggctactatatacactgggtncgacaggcccctggacaagggcttgagtggatgggatggatcaaccctaacaatggtggcacaaactatgcacagaagtttcaggcaggtcacatgaccagggacacgtccatcagcacagcctacanggagctgagcgaggctagagatcgtacgacgacgacggcgttagtactttacgngtgcgagaggcaggtaacttacgtagttttaggngttggttaacgttcgggtaagtagtcgggtaccgttcggtcgggggaaccaacggggtacccgtacggtaccgacccgttccgtacctacgacgaccccttcccggaacccgtaacgggccctaacgtcccgttacccgttcccccccgtggggtacccctccccgtacccctaccgtaaacgcccgacctccgttccggcggggacctacgacgccggcctcggggctcggccgtggtccgaacggttccttacctccgtcgaacgtccggcgttccgtaagggcgtaaccgggg

SEQ ID NO: 428047 - DNA, 719 bp, Homo sapiens
  misc_feature: GZ8MTXP01EX9GN.45.14.B03.1.454.CMB.2.raw
  modified_base (188)..(188): a, c, t, g, unknown or other
  modified_base (269)..(269): a, c, t, g, unknown or other
  modified_base (273)..(273): a, c, t, g, unknown or other
  modified_base (285)..(285): a, c, t, g, unknown or other
  modified_base (300)..(300): a, c, t, g, unknown or other
  modified_base (328)..(328): a, c, t, g, unknown or other
tcagacgcgatcgacacgaccggtgctcgatttagtgtgagtagtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaanatggtggcacaaactatgcacagaagtttcgagggcagggtcaccatcgaccagggacacgtccatcagcacagcctacangganctgagcgagcgngagctcgagacgacncggtcgtgtatacgtgtcgcgagacggngaggtaacttacggtattttgggagttaggttaagttcgggtaacggtagtgggtaccgtcggtacgggggaccgaaacggggtacccgtaccggtccgtaacccgttccgtccctacacccggtaccctaccccgaacgaacccgggtccctacgtcccgggttacccttcccccgtcggggacccctaccccgtaccctaccgaaacgcccgacccgtaccgttccggggacggggtcctaaccggacccgggccgggtaaccccggtcggggttcctccgggttccccgaagggttaccccgaaacgggttacccctttacccgttcccggtaacccggtaacgttccccgggtcggttccggttcgggttaaccggggtcccggggg

SEQ ID NO: 428048 - DNA, 612 bp, Homo sapiens
  misc_feature: GZ8MTXP02HBW7X.45.14.B03.1.454.CMB.2.raw
  modified_base (188)..(188): a, c, t, g, unknown or other
  modified_base (272)..(272): a, c, t, g, unknown or other
  modified_base (287)..(287): a, c, t, g, unknown or other
  modified_base (312)..(312): a, c, t, g, unknown or other
tcagacgcgatcgacacgaccggtgctcgatttagtgtgagtagtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaanaatggtggcacaaactatgcacagaagtttcagggcagggtcaccatgaccagggacacgtccatcagcacagcctacatgganctgagcgagctgagntctagacgacacggcgtgtattacngtgcgagaggcaggaattacgtatttttggagttggttattcgggagtatggacgtgtgggggaccaagggacccacgggtcaccggtctccgtcacgtcctccaccgaacggccccagtccggtccttcccccgtggccctacccctccctaccgaaagcgaccaccgttcgcgggggaccaacgacggcccggcccgttcggggccctcggaccccgttgggtaccgaaacgggtaaccgttaccgtttaacccccgtcgtaccgttccggtaccggttcggtacggtacggcccggg

SEQ ID NO: 428049 - DNA, 558 bp, Homo sapiens
  misc_feature: GZ8MTXP02JOSE1.45.14.B03.1.454.CMB.2.raw
  modified_base (272)..(272): a, c, t, g, unknown or other
  modified_base (445)..(445): a, c, t, g, unknown or other
tcagacgcgatcgacacgaccggtgctcgatttagtgtgagtagtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatgganctgagcaggctgagatctgacgacacggcgtgtattactgtgcgagagcaggaattacgatttttggagttggttattcgggacggttagtggacgtcgtgggggaccgaagggaccacggtcaccgtcgcctcagccctccaccaggggtcccagtccggtccttcccccgnggcccacccctcctaccgaagaccgccacctcgtcgggcgacacgccggcccgtcggcgtcgccgtcggtcgacggaccgtactccttcgacgtcgtcgtcgtcggacgcggg

SEQ ID NO: 428050 - DNA, 627 bp, Homo sapiens
  misc_feature: GZ8MTXP02I09D3.45.14.B03.1.454.CMB.2.raw
  modified_base (290)..(290): a, c, t, g, unknown or other
  modified_base (313)..(313): a, c, t, g, unknown or other
tcagacgcgatcgacacgaccggtgctcgatttagtgtgagtagtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggcgtgaganctgacgacacggcgtgtattacngtgcgagaggcgaggtaacttacgatttttggagttggttagttcgggacggtatgggacgtcgtgggggaccgaaaggggacccacgggtacaccgtctacccgtcacgcctacccgaaccgaacgggccccacgtcccggtcccttccccccgttacggccctaacccctccctaccgaaacgacgtccacctcgtgggggccacgcgcccggccgtcgggggcctcggccgttcgggaccgtaaaacgggtccttaaccgttcccgtaaccgggtacttcccggccggttcctacgggtacggtcccgggg

SEQ ID NO: 428051 - DNA, 680 bp, Homo sapiens
  misc_feature: GZ8MTXP02HKDNO.45.14.B03.1.454.CMB.2.raw
  modified_base (187)..(187): a, c, t, g, unknown or other
  modified_base (265)..(265): a, c, t, g, unknown or other
  modified_base (271)..(271): a, c, t, g, unknown or other
  modified_base (296)..(296): a, c, t, g, unknown or other
tcagacgcgatcgacacgaccggtgctcgatttagtgtgagtagtttggggctgaggtgaagaagcctggggcctcagtgaaggtctcctgcaaggcttctggatacaccttcaccggctactatatacactgggtgcgacaggcccctggacaagggcttgagtggatgggatggatcaaccctanatggtgcacaactatgcacagaagtttcagggtcagggtcaccgatgaccagggaccacgtccatcagcacagcctangtgganctgacgcgaggtctagagacttcgngacgacgtacggtcgtatacgttcgtggtcgacgagaggtcgtaaggtaccttacggtagttttggagttcggttacttcgggacggttatcgggtacgttccggtacggggaccgtaagggtcccgtacgggttccaacccgtttcgaccgttacgaccgttcccgtaccgaacgtaacgggtccctaggttcccggttacccttaccccggtggaccccttacccgtcctaacggacgtccgtaccgtacgttcgggtcggggacctacggcgtacccgggtccgttacggggccttaccgggtacggttacggtaccgtaacggttaccgtaccggttccgacggtacgttaccggtcgttacggtcggtacggtcccggg

SEQ ID NO: 428052 - DNA, 590 bp, Homo sapiens
  misc_feature: GZ8MTXP02I8402.45.14.B03.1.454.CMB.2.raw
  modified_base (404)..(404): a, c, t, g, unknown or other
tcagacgcgatcgacacgaccggtgctcgatttagtgtgagtagtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcgggacggtatggacgtcgtgggggccaaaggggccacggtcaccgtctcctcncgcctccaccgaacgggcccacgtccggtccttcccccgtggcccacccctcctcccaacgacgccaccgtcgtcgggggccacgacgccggcccgtcggggcctcggcccgtacgggttccgaaacgggtaccttaaccgttcccgtcggtaacttccggccggttcgtcggacggtcccggggg

SEQ ID NO: 428053 - DNA, 654 bp, Homo sapiens
  misc_feature: GZ8MTXP02J0JGS.45.14.B03.1.454.CMB.2.raw
  modified_base (272)..(272): a, c, t, g, unknown or other
tcagacgcgatcgacacgaccggtgctcgatttagtgtgagtagtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatgganctgagcaggctgagatctgacgacacggccgtgtattactgtgcgagagcgagaattacgattttggagttgttagttcggacggtagtaggtacgtcgtgggggaccaaagggggacccacggtacctaacccggtcctaccgtacacgccctacccaacccgaaacggggcccctacgtccggttacccttcccccgtcgggacccctaccccttaccctacccaaacgacgacccaacccttccgacggggaaccaccgacggtcccggcccccgtggggtccctccggtcccgttacgggtaaccgaaacggggtaacccttaccgttaaccctacccggtaagtcccggtaccgtccgttacggaacggtcccgggg

SEQ ID NO: 428054 - DNA, 649 bp, Homo sapiens
  misc_feature: GZ8MTXP02HLAVR.45.14.B03.1.454.CMB.2.raw
tcagacgcgatcgacacgaccggtgctcgatttagtgtgagtagtttgtgtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctccgtgcaaggcttcgtggactacaccttcgaccggctactatatacagtgggtgcgacgacggcccctggaacgaagggtcttggagtggagtgggatggactacaaacccccgtaacgagtggtacggacaacaaactgtacgacaacgtagtaagtttcggagggtacgacgggtaccaacgtacgtacggaaccgaacggggacctaccggtacctaacgtaccgaacgaccgaaacgaaccggtaccctaaacgtaacgtcgggaacgtccgtaggacggtacggacgggtacgtacggaacgtacgttcgtaacggaccggtaccggaccggttccggttaagtacgttacggtgcggaacggaggacggtacgtaaggtactttacggtttaagttttgggg

SEQ ID NO: 428055 - DNA, 628 bp, Homo sapiens
  misc_feature: GZ8MTXP02GYXBT.45.14.B03.1.454.CMB.2.raw
  modified_base (271)..(271): a, c, t, g, unknown or other
tcagacgcgatcgacacgaccggtgctcgatttagtgtgagtagtttggggctgaggtgaagaagcctggggcctcagtgaaggtctcctgcaaggcttctggatacaccttcaccggctactatatacactgggtgcgataggcccctggacaagggcttgagtggatgggatggatcaacctaacaatggtggcacaaactatgcacagaagtttcagggcagggtcaccatgaccagggacacgtccatcagcacagcctacatgganctgagcaggctgagatctgacgacacggccgtgtattactgtggcgaggaggcaaggtaactttacgtatttttggagttgggttattcggggtaggttagtgggaacggttcgtcgggggaccaaacggggtacccgacggtcccgaaccgtcctcctcgacgccctacccgacccgaacggggcccacgtcccggttcccttcccccgtcggcccctacccctccctacccgaacgaccgaccacccgttcgcgggggccaacgacggcccggcccgtcgggccgtcgcccgtcggtaccgaacggtaccgttaaccttcccgtacgacgtccgccgtcgtcggacggcccgggg

SEQ ID NO: 428056 - DNA, 652 bp, Homo sapiens
  misc_feature: GZ8MTXP02HF28Q.45.14.B03.1.454.CMB.2.raw
  modified_base (462)..(462): a, c, t, g, unknown or other
tcagacgcgatcgacacgaccggtgctcgatttagtgtgagtagtttgggtttgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagtaagtttcagggcagggtcaccatcgaccgagggacacgtccatcagcacacgcctacatggagctgagcgaggctgagatctagaacgacgacggccgtagtactactgtcgacgaggaggcgaaaggtacttacgttagttttagggtagttggtttaagttcgggtacgggttagtcgggtaacggttcggtacggggaccgaacgggacccgacggtacccgtacccgtcctcccgtcacgtcccnccgtaacccgaaccggccctaacgtcccgtccctttcccccgcggtaccctacccccgttcctacccgaagacccgtccgacccgtcggtccggggaccaacgccggccgcccggtcggccgtccggccgttaggaccgacggtacttaccgtccgtaacgtccgtcgcggttcgcggtcggcggtaccg

SEQ ID NO: 428057 - DNA, 610 bp, Homo sapiens
  misc_feature: GZ8MTXP02HDCUY.45.14.B03.1.454.CMB.2.raw
  modified_base (429)..(429): a, c, t, g, unknown or other
tcagacgcgatcgacacgaccggtgctcgatttagtgtgagtagtttggggctgaggtgaagaagcctggggcctcagtgaaggtctcctgcaaggcttctggatacaccttcaccggctactatatacactgggtgcgataggcccctggacaagggcttgagtggatgggatggatcaaccctaacaatggtgcacaaactatgcacagaagtttcagggcagggtcacatgaccgagggacacgtccatcagcacacgcctacagtggagctgagcgaggctgagctctgacgacgacggcgtgtattacgtgtgcggagaggacgaggtaattacgttagttttggtaggttggttagttcgggtacgggtagtaggtacgtcggtcggggtacgaacgggaccgacggtcacccgtctccgtcncgcctacccgacgtaccggcctacgtccgtcccttaccccgtcggccctacccgttccacgaacgacgtccaccgtcgggcggggccacggcggcccggtccgtcggggctccggacggtacggtaccgacggtccttacttcccgtacggtactccggtacgtcgtacgggcggtccggg

SEQ ID NO: 428058 - DNA, 574 bp, Homo sapiens
  misc_feature: GZ8MTXP02F8UCV.45.14.B03.1.454.CMB.2.raw
  modified_base (486)..(486): a, c, t, g, unknown or other
tcagacgcgatcgacacgaccggtgctcgatttagtgtgagtagtttggggctgaggtgaagaagcctggggcctcagtgaaggtctcctgcaaggcttctggatacaccttcaccggctactatatacactgggtgcgataggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggctaggaacttacgatttttggagttggttattcgggacggtagtgggacgttcgtgggggaccaaaggggacccacggtcaacccggtctcccgtcacgcctcccaaccaacgggccccacgtccggtccttcccccgtggcccacccctcctaccgaacgacnccacctcgtacgggggccacgacgccggcccgtgggctcgcgtcggtacaacggctacctccgttcgacttccgcgtcgtcggcgcgg

SEQ ID NO: 428059 - DNA, 527 bp, Homo sapiens
  misc_feature: GZ8MTXP01DF1LG.22.6.A06.1.454.CMB.2.raw
tcagacatacgcgtcacgaccggtgctcgatttagatctactgacaggggtgggtccaggaggcagaactctgggtgtctcaccatggcctggatccctctacttctcccctcctcactctctgcacagactctgaggccgcctatgagctgacacagccaccctcggtgtcagtgtccccaggacagacggcagaatcacctgctctggagatgcactgccaaatcaatatgtctttttggtatcaacagaggccaggccacgcccctgtcttaatgatatataaagacagtgagaggccctcagggatctctgagcgattctctgccctccaagctcgagggacaaacattcacattcgaccatcagtgaagtccaggcagaagatgagctgacttattattgtcaatcaacagacagtagtagggaaattatggtggttattcgggcggtaaaggggaccaaaacgttcgaaaccggttcccttaaagggtccaggccccgaaagggtccttcgggtccccccg

SEQ ID NO: 428060 - DNA, 518 bp, Homo sapiens
  misc_feature: GZ8MTXP01BU2KC.22.6.A06.1.454.CMB.2.raw
  modified_base (413)..(413): a, c, t, g, unknown or other
tcagacatacgcgtcacgaccggtgctcgatttagatctactgacagggggtgggtccaggaggcagaactctgggtgtctcaccatggcctggatccctctacttctcccctcctcactctctgcacagactctgaggccgcctatgagctgacacagccaccctcggtgtcagtgtccccaggacagacggccagaatcacctgctctggagatgcactgccaaatcaatatgtctttttggtatcaacagaggccaggccacgcccctgtcttaatgatatataaagacagtgagaggcctcagggatctctgagcgattctctgcctccaagctcagggacaacattcacattgaccatcagtgaagtccaaggcagaagatgaggctgactattattgtacaatcaanagaacagtaagtagggaaatgtggtaggttagttcgggacggaggggaccaaaacgttgaccgttccctagggtccacggcccgaagggtccttcggtccccccg

SEQ ID NO: 428061 - DNA, 507 bp, Homo sapiens
  misc_feature: GZ8MTXP01BPEJP.22.6.A06.1.454.CMB.2.raw
tcagacatacgcgtcacgaccggtgctcgatttagatctactgacagggggtgggtccaggaggcagaactctgggtgtctcaccatggcctggatccctctacttctcccctcctcactctctgcacagactctgaggccgcctatgagctgacacagccaccctcggtgtcagtcgtccccaggacagacggccagaatcacctgctctggagatgcactgaccaaatcaatatgtctttttggtatcaacagaggccaggccacgcccctgtcttaatgatatataaagacagtgagaggccctgagggatctctgagcgattctctgcctccaagcctcagggacaaacattcacattcgaccatcagtgaagtccaaggcagaagatgaggctgacttattatgtacaaatcaacagaacagtaggtaggaaatgtgtgttagttcgggacggagggacaaacgttgaccgtccaggtcacgcccgaaggccttcgcccccg

SEQ ID NO: 428062 - DNA, 522 bp, Homo sapiens
  misc_feature: GZ8MTXP01B8VDC.22.6.A06.1.454.CMB.2.raw
  modified_base (235)..(235): a, c, t, g, unknown or other
tcagacatacgcgtcacgaccggtgctcgatttagatctactgacagggggtgggtccaggaggcagaactctgggtgtctcaccatggcctggatccctctacttctcccctcctcactctctgcacagactctgaggccgcctatgagctgacacagccaccctcggtgtcagtcgtccccaggacagacgccagaatcacctgctctggagatgcactgaccaaatcaaatntgtctttttggatcaacagaggccaggccacgcccctgtctaatgatatataaagacagtgagaggccctcagggatctctgagcgattctctgccctccaagctcagggacaacattcacattgaccatcagtgaagtccaggcagaagatgaaggctagatattattgacaatcaacagacagtagtagggaaatgtgtcggttagttcgggacgggaagggaccaaaacgttcggacccgtccttagggcaacggccccgaaagggtccttaacgtccccccgg

SEQ ID NO: 428063 - DNA, 526 bp, Homo sapiens
  misc_feature: GZ8MTXP01CSDRI.22.6.A06.1.454.CMB.2.raw
  modified_base (382)..(382): a, c, t, g, unknown or other
  modified_base (453)..(453): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgaccaaatcaatatgtctttttggtatcaacagaggccaggccacgcccctgtcttaatgatatataaagacagtgagaggccctagagggatctctgagcgtacttctctgccctccgaagcctcgagggacaaactattcactattgacctatcagtnaacgtccaaggcaagaagatagaggctagaacttatttatgtacaaatcaaacagacagtagtaggaaatntgtcggttagttcggcgggtaaagggaccaaacgttgacccgtcgtagtcacgccgaacgtcgaacgtccccg

SEQ ID NO: 428064 - DNA, 493 bp, Homo sapiens
  misc_feature: GZ8MTXP01D6X2I.22.6.A06.1.454.CMB.2.raw
  modified_base (213)..(213): a, c, t, g, unknown or other
  modified_base (463)..(463): a, c, t, g, unknown or other
tcagacatacgcgtcacgaccggtgctcgatttagatctactgacagggggtgggtccaggaggcagaactctgggtgtctcaccatggcctggatccctctacttctcccctcctcactctctgcacagactctgaggccgcctatgagctgacacagccaccctcggtgtcagtgtccccaggacagacggcagaatcacctgctctgganatgcactgaccaaatcaatatgtctttttggtatcaacagaggccaggccacgccctgtcttaatgatatataaagacagtgagaggccctcagggatctctgagcgacttctctgccctccaagctcgagggacaacattcacattcgaccatcagtagaagtccaggcaagaagatgagctgacttattattgtacaatacaacagacagtagtaggaaatgtgtcgttagttcggagagggacaagngacgtctagtcagccgagtcttcgtccccg

SEQ ID NO: 428065 - DNA, 669 bp, Homo sapiens
  misc_feature: GZ8MTXP01B7A23.22.6.A06.1.454.CMB.2.raw
tcagacatacgcgtcacgaccggtgctcgatttagatctactgacagggggtgggtccaggaggcagaactctgggtgtctcaccatggcctggatccctctacttctcccctcctcactctctgcacagactctgaggccgcctatgagctgacacagccaccctcggtgtcagtgtccccaggacagacggcagaatcacctgctctggagatgcactgaccaaatcaatatgtctttttggtatcaacagaggccaggccacgcccctgtctaatgatatataaagacagtgagaggccctgagggatctctgagcgattctctgccctcaagctcagggacaacattcacattcgacctataccagtagaacgtacccgaaggaccgaagaaagattaggagggtaccttaggtaaccgttaattttaagtttacggttactaaaacttaccaaaacccgaagtaaaccgtaaggttaaagggttaagggggtaaaattaaggttaaggttaaggggttaaacggtttccgggggttacggggaaacgggggtaacccgttaaaaaccggttggaaacccccgggttaaccgttaaacggggttaaccgtaacccgggtaccccgaaaacgggggtcccgtttaacccgggtccccccccccggg

SEQ ID NO: 428066 - DNA, 505 bp, Homo sapiens
  misc_feature: GZ8MTXP01AEYTF.22.6.A06.1.454.CMB.2.raw
  modified_base (304)..(304): a, c, t, g, unknown or other
  modified_base (349)..(349): a, c, t, g, unknown or other
  modified_base (412)..(412): a, c, t, g, unknown or other
  modified_base (416)..(416): a, c, t, g, unknown or other
tcagacatacgcgtcacgaccggtgctcgatttagatctactgacaggggtgggtccaggaggcagaactctgggtgtctcaccatggcctggatccctctacttctcccctcctcactctctgcacagactctgaggccgcctatgagctgacacagccaccctcggtgtcagtgtccccaggacagacggccagaatcacctgctctggagatgcactgccaaatcaatatgtctttttggatcaacagaggccaggccacgcccctgtcttaatgatatataaagacagtgagacggcctnagggatctctgagcgacttctctgccctcaagctcgagggacaanattcacattgaccatcagtgaagtcaggcagaagatgagctagactattatgtacaatcaaanaganagtagtagaaatgtgtggttagtcgggacggaacggaaccttaacgttcgaccggtcgtaggtcgacgaccgacgtccgttccgccccg

SEQ ID NO: 428067 - DNA, 669 bp, Homo sapiens
  misc_feature: GZ8MTXP01ECS64.22.6.A06.1.454.CMB.2.raw
  modified_base (216)..(216): a, c, t, g, unknown or other
  modified_base (239)..(239): a, c, t, g, unknown or other
  modified_base (505)..(505): a, c, t, g, unknown or other
tcagacatacgcgtcacgaccggtgctcgatttagatctactgacagggggtgggtccaggaggcagaactctgggtgtctcaccatggcctggatccctctacttcctcccctcctcactctctgcacagactctgaggccgcctatgagctgacacagccaccctcggtgtcagtcgtccccaggacagacggccagaatcacctgctctgganatgcactgaccaaatcaaattancctttacgtttttaggtatactaacgaaggtacggaccgacggaccgacccctacccgtcgttaacttaactagaacttaattaaagtaaaacgacgtaggtagaaggaccggtcccctacgggaagggacttctcgtagagcgtacttctgtcgtccctaccgaagcctcggacgggaaaccaaactacttcaactagttacgactactactagtagtaacgtacgacgacgaagaactagagaagtctaggtacttagttattntaactaataccaaagtacgaaactaggtaaggtaagggtaaattggtaaggttaggttaaggtacggggttacgggtaacggggaaaccttaacgggttccgaaacccggtccgtaacgggtaaccaccgggaccccgaaagggtcccttaacccggtcccccg

SEQ ID NO: 428068 - DNA, 510 bp, Homo sapiens
  misc_feature: GZ8MTXP01ELLV9.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgaccaaatcaatatgtcttttggtatcaacagaggccaggccacgcccctgtctaatgatatataaagacagtgagaggccctcgagggatctctgagcgattctctgcctccaagctcgagggacaacattcacattcgaccatcagtgaagtccaggcaagaagatgaggctgacttattatgtacaatcaacagacagtagtaggtaaatgtggtaggttagttcggacgggaggaaccaaacgttgaccgtcgtaggtcacgcccgaaggccttcggtcccccg

SEQ ID NO: 428069 - DNA, 555 bp, Homo sapiens
  misc_feature: GZ8MTXP01DZG9F.22.6.A06.1.454.CMB.2.raw
  modified_base (314)..(314): a, c, t, g, unknown or other
  modified_base (409)..(409): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtcgtccccaggacagacggccagaatcacctgctctggagatgcactgaccaaatcaaattatgttctttttggatcaacagaggccaggccacgcccctgtcttaatgatataataaagacagtgagacggccctnagggatctctgagcgtacttctctgccctccaagctcgagggacaaacattcactattcgaccatcagtgaacgtccgaaggcaagaagatgagntagacttattattgtacaatcaaacgagactaggtaaggtaggtaaaattgtggtggttaacgttcggggacggtaacgggaaccttaaacgttcggttaccgtaaccgtaggtcacgcccgaacggtccgttaaccgtcccccgg

SEQ ID NO: 428070 - DNA, 582 bp, Homo sapiens
  misc_feature: GZ8MTXP01EKOLA.22.6.A06.1.454.CMB.2.raw
  modified_base (303)..(303): a, c, t, g, unknown or other
  modified_base (354)..(354): a, c, t, g, unknown or other
  modified_base (442)..(442): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggcagaatcacctgctctggagatgcactgaccaaatcaatatgtctttttggtatcaacagagcaggccacgccctgtctaatgatatataaagacagtgagacgccctnagggtactctctgagcgtacttctctgcctccaagctcgagggtacaactntcacattcgacctatacagtagaacgtaccaaggacaagaagatagaggctagaactttatttagttatactaaatcaaacgagtaanaaggttaagtaggggtaaatagttaaggttaacggttaggttaccgggacgggaaacggggtaacccttaaaacgttcggttaacccggtcgtaaggtaaccgacgggtacccgaacgggtcccgttccgggtccccccg

SEQ ID NO: 428071 - DNA, 567 bp, Homo sapiens
  misc_feature: GZ8MTXP01DMUPI.22.6.A06.1.454.CMB.2.raw
  modified_base (250)..(250): a, c, t, g, unknown or other
  modified_base (456)..(456): a, c, t, g, unknown or other
  modified_base (468)..(468): a, c, t, g, unknown or other
  modified_base (472)..(472): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggcagaatcacctgctctggagatgcactgaccaaatcaatatgtcttttggatcaanagagcaggccacgccctgtctaatgatatataaagacagtgagacggccctagagggatctctgacgcgtactttctactcgcccttccgaaacggtcctccgaaacggggtaaaccaaactactttaccaactaatttacgaaccctattaccaagtagaaacgttcccgaaggaccaagaagatgaggctagacttatttagtntacaatcaaacngaanagtaaggtagggaaaatgtggtcggttagttcggagggaggaaccaaacgttcgaccgtctaaggtcgacgcccgaaggtccttccggtcccccg

SEQ ID NO: 428072 - DNA, 566 bp, Homo sapiens
  misc_feature: GZ8MTXP01DQVTD.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgaccaaatcaattatgtctttttggtatcaacagaggccaggccacgcccctgtcttaatgatataataaagacagtagagacggccctgagggatctctgagcgtattctctgccctccgaaagctcgagggaacaaactatttaccactatttacgaccctagttcaagttaggaagttacccgaaggacaaggaagagtgaggctaggaacgttatttattgtacaatacaaacagaacagtaagagggtaaattagtgtaggttagttcgggacgggaagggaaccaaacgttcgaccgtcgtacggtcgacgaccgaaggtccgttccggtaacccccg

SEQ ID NO: 428073 - DNA, 584 bp, Homo sapiens
  misc_feature: GZ8MTXP01ETP0W.22.6.A06.1.454.CMB.2.raw
tcagacatacgcgtcacgaccggtgctcgatttagatctactgacagggggtgggtccaggaggcagaactctgggtgtctcaccatggcctggatccctctacttctcccctcctcactctctgcacagactctgaggccgcctatgagctgacacagccaccctcggtgtcagtcgtccccaggacagacggccagaatcacctgctctggagatgcactgaccaaatcaatatgtcttttggtatcaacagaggccaggccacgcccctgtcttaatgatatataaagacagtgagagcctacgagggatctcgtgagcgtacttctctcgccctccgaagctcgagggacaaactattacactattcgaccattcagtgaagtccaaggcaagaagatcgaggactaggacttagtttattagtactaaataccaaatagaacgtaaggtaagtaggggtaaattggtaaggttggttaaagttcggggaacgggtaacgggtaaccttaaaacgttcggttaaccccggtcgttaagggtccgacggtaccccgaagggtcccgttccggtccccccgg

SEQ ID NO: 428074 - DNA, 606 bp, Homo sapiens
  misc_feature: GZ8MTXP01DHBZ9.22.6.A06.1.454.CMB.2.raw
  modified_base (252)..(252): a, c, t, g, unknown or other
  modified_base (316)..(316): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtcgtccccaggacagacggccagaatcacctgctctggagatgcactgaccaaatcaatatgtcttttggatcaanagaggccaggccacgccctgtctatgatatataagacagtagagaggcctcaggagtctcgtgngcgtacttcgtctcgcctccaacgctcgacgggaacaaactactttccactattacgacctaataccgagtagaacgtaccgaaggacagaaagagtagaggctagtacttaatttattagtacaatacgaaacagtaaacgaggttaaggtagggtaaagttgttaagggttggttaaggtttcggggaacgggaaaggggtaacccaaaacggttcggaacccgttaacccggtaaggttaacccgacggaccccgttaacgggtccgttcccgggtaacccccccgg

SEQ ID NO: 428075 - DNA, 538 bp, Homo sapiens
  misc_feature: GZ8MTXP01BLTWL.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgaccaaatcaatatgtctttttggtatcaacagaggccaggccacgccctgtcttaatgatatataaagacagtgagacggcctcgagggatctctgagcgacttctctcgcctccaagctcgagggacaacattcacattgaccatcagtgaagtccaggacagaagatgaggctcggatatttattgtactaaatcaaacagaactagtaagtagggaaattagtaaggtggttagttcgggacgggaacggggaaccaaacgttcgaaccggtccgtaggtccgacggcccgaaggtccgttccgtccccccg

SEQ ID NO: 428076 - DNA, 526 bp, Homo sapiens
  misc_feature: GZ8MTXP01BLCWL.22.6.A06.1.454.CMB.2.raw
  modified_base (394)..(394): a, c, t, g, unknown or other
tcagacatacgcgtcacgaccggtgctcgatttagatctactgacagggggtgggtccaggaggcagaactctgggtgtctcaccatggcctggatccctctacttctcccctcctcactctctgcacagactctgaggccgcctatgagctgacacagccaccctcggtgtcagtgtccccaggacagacggccagaatcacctgctctggagatgcatgaccaaatcaatatgtcttttggtatcaacagaggccaggccacgccctgtcttaatgatatataaagacagtgagaggccctacgagggatctctgagcgtacttctctgccctccaagctgagggacaactattcactattcgaccatcagtgaagtccaaggcaagaaganagaggactgaacttagttattagtactaatacaaacagaactagtaagtagggaaatgtggtggttagttcgggaggaacgggtaacaacgttgaccgtcgtaggcacggaccaagggtccttcgtcccccg

SEQ ID NO: 428077 - DNA, 533 bp, Homo sapiens
  misc_feature: GZ8MTXP01AKEL2.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgaccaaatcaatatgtctttttggtatcaacagagccaggccacgccctgtcttaatgatatataaagacagtgagagccctgaggatctctgagcgtattctctgcctccaagctcgagggacaactattcactattcgaccatcgagtgaacgtcaggacaagaagataggaggctagaacgttattagttgtacaatacaacagacagtagtaggaaatgtggtggttagttcgggacgggtaacggaccttaaacgttcgacccgtcgtaacggtccgacgccgaacggtccgttccgtccccccgg

SEQ ID NO: 428078 - DNA, 569 bp, Homo sapiens
  misc_feature: GZ8MTXP01ARX3V.22.6.A06.1.454.CMB.2.raw
  modified_base (172)..(172): a, c, t, g, unknown or other
  modified_base (216)..(216): a, c, t, g, unknown or other
  modified_base (236)..(236): a, c, t, g, unknown or other
  modified_base (328)..(328): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtntcagtcgtccccaggacagacggccagaatcacctgctctgganatgcactgaccaaatcaatntgtcttttggtatcaacagaggccaggccacgcccctgtctaatgatatataaagacagtgagaggccctgagggatctctgagcgattctntgccctcaagctcgagggacaactacttacactattcgaccctatccagtacgaaagttccaagggacaaggaaagagtgaaggctagaacttatttagttgtactaaatcaaagagaacgagttaaggtaggtaaatgtgtaggttaggttcgggcgggtaaacgggaaccaaacggttcgaacccgttcgtaagggtccaacggtccccgaacgggtcccgttaaccggtcccccccgg

SEQ ID NO: 428079 - DNA, 587 bp, Homo sapiens
  misc_feature: GZ8MTXP01AZ0N6.22.6.A06.1.454.CMB.2.raw
  modified_base (214)..(214): a, c, t, g, unknown or other
tcagacatacgcgtcacgaccggtgctcgatttagatctactgacagggggtgggtccaggaggcagaactctgggtgtctcaccatggcctggatccctctacttctcccctcctcactctctgcacagactctgaggccgcctatgagctgacacagccaccctcggtgtcagtgtccccaggacagacggccagaatcacctgctctgganatgcactgaccaaatcaatatgtcttttggatcaacagagcaggccacgccctgtctaatgatatataaagacagtgagacggcctacgaggatctctgagcgtacttctctcgccctccaagcctcgaacgggacaactacttacactattacgaccataccagtacgaacgtccgaaggacaagaagagtagaggcttaggaacgtttaattagttagtaccaaattacaaacgagtaacaggttaagtagggtaaatggttaagtagggttacgttcggggacggtaaacgggtaacccttaaacgttcgggaacccgttaacggtacggtccgaaccggacccgaacggtccgttaacccgtcccccgg

SEQ ID NO: 428080 - DNA, 542 bp, Homo sapiens
  misc_feature: GZ8MTXP01BBANO.22.6.A06.1.454.CMB.2.raw
  modified_base (215)..(215): a, c, t, g, unknown or other
  modified_base (352)..(352): a, c, t, g, unknown or other
tcagacatacgcgtcacgaccggtgctcgatttagatctactgacagggggtgggtccaggaggcagaactctgggtgtctcaccatggcctggatccctctacttctcccctcctcactctctgcacagactctgaggccgcctatgagctgacacagccaccctcggtgtcagtcgtccccaggacagacggccagaatcacctgctctgganatgcactgaccaaatcaatatgtctttttggtatcaacagaggccaggccacgcccctgtcttaatgatatataaagacagtgagaggccctcgagggatctctgagcgattctctgccctcaagctcagggacaanattcacattcgaccattacagtgaaagtccaaggacaagaagatgaaggctagacttaattattagtacaaatcaaacagaacagtaagtagggtaaatgtgtaggttgttacgggcggtaacgggaaccaaacgttcgaacccgtccgtaaggtccgacgccccgaaggtcccgttaacgtccccccgg

SEQ ID NO: 428081 - DNA, 511 bp, Homo sapiens
  misc_feature: GZ8MTXP01BIJXU.22.6.A06.1.454.CMB.2.raw
  modified_base (401)..(401): a, c, t, g, unknown or other
  modified_base (416)..(416): a, c, t, g, unknown or other
  modified_base (427)..(427): a, c, t, g, unknown or other
  modified_base (431)..(431): a, c, t, g, unknown or other
tcagacatacgcgtcacgaccggtgctcgatttagatctactgacagggggtgggtccaggaggcagaactctgggtgtctcaccatggcctggatccctctacttctcccctcctcactctctgcacagactctgaggccgcctatgagctgacacagcccaccctggtgtcagtcgtccccaggacagacggccagaatcacctgctctggagatgcactgaccaaatcaaatatgtctttttggtatcaacagaggccaggcccacgcccctgtcttaatgatatataaagacagtgagaggccctcgagggatctctgagcgtacttcgtctgcctccaagcctcgagggacaaactattacactattcgacctatcagtgaactcgagacagatangagctgactattatntacaatcaaanaganagtagtagtaatgtgtggttagtcggaggaacgaacgaacgttcgaccgtcgtacgcacgaccgacgtccgttccgcccg

SEQ ID NO: 428082 - DNA, 521 bp, Homo sapiens
  misc_feature: GZ8MTXP01DR4G7.22.6.A06.1.454.CMB.2.raw
  modified_base (214)..(214): a, c, t, g, unknown or other
tcagacatacgcgtcacgaccggtgctcgatttagatctactgacagggggtgggtccaggaggcagaactctgggtgtctcaccatggcctggatccctctacttctcccctcctcactctctgcacagactctgaggccgcctatgagctgacacagccaccctcggtgtcagtgtccccaggacagacggccagaatcacctgctctgganatgcatgccaaaatcaaatatgtcttttggtatcaacagaggccaggccacgccctgtcttaatgatatataaagacagtgagaggccctcagggatctctgagcgattctctgccctccaagctcgagggacaacattcacattgaccatcagtgaagtccaaggcaagaagatgaggctagacttatttattgtacaaatcaaacagaacagtagtagggaaatgtgttggttagtttcgggacggtaagggaccaaacgttcgaaccgtctaacggtcagccccgaaggtcttaacgtcccccg

SEQ ID NO: 428083 - DNA, 580 bp, Homo sapiens
  misc_feature: GZ8MTXP01BPI7H.22.6.A06.1.454.CMB.2.raw
  modified_base (236)..(236): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctggtgtcagtcgtccccaggacagacggccagaatcacctgctctggagatgcactgaccaaaatcaatntgtcttttggtatcaacagaggccaggccacgccctgtcttaatgatatataaagacagtgagacgcctgagggatctcgtgagtcgtacttctctgccctccaagcctcgaggaacaactattacactattcgacctatacagtagaagtccgaaggacaagaaagagtaggacggtcgttagtaacgttatttagttagtaacctaaattaaccaagaagaactaaggtaaggtaagggtaaattaggtggttaggttaggttcgggacgggaacggtaaccaaacgttcgaacccgttcgtaacggtcgacggacccgaggtcccgttaaccggtcccccg

SEQ ID NO: 428084 - DNA, 602 bp, Homo sapiens
  misc_feature: GZ8MTXP01DB0LN.22.6.A06.1.454.CMB.2.raw
  modified_base (477)..(477): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtcgtccccaggacagacggccagaatcacctgctctggagatgcactgaccaaatcaattatgttcttttggtatcaacagagccaggccaccgccctgtctaatgatatataaagacagtgagacgcctgaggatactcgtagagcgtacttcctcgtcgaccctccaacgtccgtaacgaacgggaaccaaacctattaccactattacgacctatacgagtagaacgtaccgaaggacaaggaagagtaggaggtacctaggtaacgttatttagttactactaaatacaaacagaanaggtaagtaggtaaattagtaaggttagggttagttacgggacgggtaacgggtaaccttaaacgttcggttacccgttcgtaacggtccgacggacccgaagggtcccttaacccggtcccccg

SEQ ID NO: 428085 - DNA, 611 bp, Homo sapiens
  misc_feature: GZ8MTXP01CXBHB.22.6.A06.1.454.CMB.2.raw
  modified_base (212)..(212): a, c, t, g, unknown or other
  modified_base (248)..(248): a, c, t, g, unknown or other
tcagacatacgcgtcacgaccggtgctcgatttagatctactgacagggggtgggtccaggaggcagaactctgggtgtctcaccatggcctggatccctctacttctccccctctcactctctgcacagactctgaggccgcctatgagctgacacagccaccctcggtgtcagtcgtcccaggacagacggcagatcacctgctctgganatgcactgaccaaatcaatatgtcttttggatcaanagagccaggccacgccctgtacttaatgataataataaagacagtgaagacggccctacgagggatctctagacgtcgtacttcctctcgccctccaagcctcgaacgggaaccaaactactttacaactattcgaccctaatcgaagtgaaacgtaccgaaggacgaagaaagagtagggacgtacgtaacgtagtttaattagttactaactaactaacgaaacgtaagtaacgtaaggtaaggtaaggtaattaggtaaggttacggttaggttacgggacgggtaaacggaacgaaacggttcgaaccggttaacgaacggtccaacggtacccgttaacgtccgttaacccgtccccg

SEQ ID NO: 428086 - DNA, 575 bp, Homo sapiens
  misc_feature: GZ8MTXP01CM6A3.22.6.A06.1.454.CMB.2.raw
  modified_base (217)..(217): a, c, t, g, unknown or other
  modified_base (237)..(237): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtcgtccccaggacagacggccagaatcacctgctctgganatgcactgaccaaatcaatntgtcttttggtatcaacagaggccaggccacgccctgtcttaatgatatataaagacagtgagacggccctgagggatcgtctgagcgtacttcctctgccctccgaagtcctcgagggaaccaactattcaactattcgacctatacagttacgaacgtccgaggacaagaagagtggagtctagtacttatttagttgtacaatacgaaacagtaacgagtaaggtagggaaattggttggttaggttaggttacgggacgggtaacgggtaccaaacgttcgttaacccggttcgtaacggtcgaccgtaccgaacgtccgttcccggtcccccg

SEQ ID NO: 428087 - DNA, 535 bp, Homo sapiens
  misc_feature: GZ8MTXP01BLQ9T.22.6.A06.1.454.CMB.2.raw
  modified_base (397)..(397): a, c, t, g, unknown or other
tcagacatacgcgtcacgaccggtgctcgatttagatctactgacagggggtgggtccaggaggcagaactctgggtgtctcaccatggcctggatccctctacttctcccctcctcactctctgcacagactctgaggccgcctatgagctgacacagcccaccctcggtgtcagtgtccccaggacagacggccagaatcacctgctctggagatgcactgaccaaatcaatatgtctttttggtatcaacagaggccaggccacgcccctgtctaatgatatataaagcagtgagaggccctgagggatctctgagcgtattctctgcctccaagctcgagggaacaacattcactattcgacatcagtagaagtccaggcaagaagatgaggntagacttattatgtacaatcaaacagaactagtaggtaggggtaaatgtgtagggttagttacgggcggtaagggaaccaaacgttcgaccggtcccttaggaacacggacccgaagggtccttcggtaacccccccg

SEQ ID NO: 428088 - DNA, 624 bp, Homo sapiens
  misc_feature: GZ8MTXP01D1BXH.22.6.A06.1.454.CMB.2.raw
  modified_base (256)..(256): a, c, t, g, unknown or other
tcagacatacgcgtcacgaccggtgctcgatttagatctactgacagggggtgggtccaggaggcagaactctgggtgtctcaccatggcctggatccctctacttctcccctcctcactctctgcacagactctgaggccgcctatgagctgacacagcccaccctcggtgtcagtcgtccccaggacagacggccagaatcacctgctctggagatgcactgaccaaatcaaattatgtctttttggtatcaanagaggccaggccacgcccctgtcttaatgatatataaagacagtgagacggccctcgagggatctcgtgagcgtacttctctgccctccgaagcctcgaagggacaaactattacactattcgacctatcagtagaacgtccgaaggacaagaagatagagactaggtaacttattacttgtactaaatacaaacgagtaaacgtaggtaaggtaaggggtaaaattaggttaacgggttagggttaaggtttaccggggaggggtaaacgggtaacccttaaaacggttcggttaaaccccggttaaccgtaagggttaaccgaacggacccgttaaacgggtcccgttaacccggtcccccccggg

SEQ ID NO: 428089 - DNA, 648 bp, Homo sapiens
  misc_feature: GZ8MTXP01D3GWO.22.6.A06.1.454.CMB.2.raw
  modified_base (209)..(209): a, c, t, g, unknown or other
  modified_base (214)..(214): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtcgtccccaggacagacggcagatcacctgctntgganatgcactgaccaaatcaatatgttctttttggatcaacagaggcaggccacgccctgtcttaatgatataataaagacagtagagacggcctacgagggatctctgagcgtattctctgcctcagctcgagggaacaaactattaccaatatttacgaccctaagttccgaagtacggtaaagtacccgaagggacaaaggaaagagttacggaaggacgttacggtaacgttttaatttaggtttacgtactaaacgttaacccaaagtaaggtaaaacgtaggttaaaggggttaacgggtaaaagttaggttaagggttagggttaaggtttacggggaacggggtaaacgggtaaaccgttaaacggttcggttaacccggtaaccgtaggtcccgaaggacccgaacggtccgttaaccggtcccccgg

SEQ ID NO: 428090 - DNA, 655 bp, Homo sapiens
  misc_feature: GZ8MTXP01AONMA.22.6.A06.1.454.CMB.2.raw
  modified_base (280)..(280): a, c, t, g, unknown or other
  modified_base (331)..(331): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtcgtccccaggacagacgccagaatcacctgctctggagatgcactgaccaaatcaatatgtctttttggatcaacagaggccaggccacgcccctgtcttaangatatataaagacagtgagaggcctgagggatctcgtgagcgtacttcctntgccctccgaacgctcgacgggtaacaaactatttacaactatttcgaaccctatacaaggtacgaaacgtcccgaaggacaaggaaagagtaggaacgggtctaggtaaaccttaagtttagtttaacggtactaaacgttaccaaaactaacggaaacgtaaaggttaagggtaagggggtaaaatttaggtaaggttaggggttaacgtttccgggggaagggtaaacggggtaaacccttaaaacggttcgttaaccccggttcgtaacggtaacccgaacggtaccccgaacgggtcccgttaaccggttcccccccgg

SEQ ID NO: 428091 - DNA, 609 bp, Homo sapiens
  misc_feature: GZ8MTXP01C8NBP.22.6.A06.1.454.CMB.2.raw
  modified_base (142)..(142): a, c, t, g, unknown or other
  modified_base (282)..(282): a, c, t, g, unknown or other
  modified_base (418)..(418): a, c, t, g, unknown or other
tcagacatacgcgtcacgaccggtgctcgatttagatctactgacagggggtgggtccaggaggcagaactctgggtgtctcaccatggcctggatccctctacttctccccctctcactctctgcacagactctgaggccncctagagctgacacagccaccctcggtgtcagtgtccccaggacagacggccagaatcacctgctctggagatgcactgccaaatcaatatgtctttttagtatcaacagagcagccacgccctgtcttaatgatataanaaagtacagtagagacggccctcgagggtatctcgtagagcgtacttcctctcgcctcccagtctacaagggaacaactactttacacctattacgacccaatcgaagttagaacgtccgaacggagagaagtagngtaaggctagtactaatttacgttagtacctaagtacaaacgagaacgtaagtaggtagggtaaatagttggttaagggtaacgtttcgggacggggaacggtaaaccgtaacgttacgggcccgttaccgttaacgggttaccgaacggtaccccgaagggttaccgttccccggaaccccgtttcccgg

SEQ ID NO: 428092 - DNA, 609 bp, Homo sapiens
  misc_feature: GZ8MTXP01BZ6BF.22.6.A06.1.454.CMB.2.raw
  modified_base (216)..(216): a, c, t, g, unknown or other
  modified_base (313)..(313): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctcgtgganatgcactgaccaaatcaattatgtcttttggtatcaacagagccaggccacgccctgtctaatgatatataaagacagtagagacggcctcgagggntctctgagcgacttcctctgccctccaagctcgacgggaccaactattaccaactatttcgacctatacagtagaaacggtccaacgggactaaggaaagtagtaggacggtctaggtaacttaattttaaggttatacaaacttacgaaacgtacgaacgtaaggtaggtaagggtaaaattagtaagggttgggttagtttcggggacgggtacgggtaacccaaacggttcggttacccgttaaccgtaggtccaacggcccgttaacgggtccgttcccggtaaccccccgg

SEQ ID NO: 428093 - DNA, 565 bp, Homo sapiens
  misc_feature: GZ8MTXP01DH3JK.22.6.A06.1.454.CMB.2.raw
  modified_base (214)..(214): a, c, t, g, unknown or other
  modified_base (250)..(250): a, c, t, g, unknown or other
  modified_base (555)..(555): a, c, t, g, unknown or other
tcagacatacgcgtcacgaccggtgctcgatttagatctactgacagggggtgggtccaggaggcagaactctgggtgtctcaccatggcctggatccctctacttcctccccctcctcactctctgcacagactctgaggccgcctatgagctgacacagccaccctggtgtcagtcgtccccaggacagacggcagaatcactgctctgganatgcactgaccaaatcaatatgtcttttggatcaanagaggccaggccacgccctagtctaatgatatataaagacagtagaggacggccccttagagggactacgtctagagtcgtaacttctcttgcccttaccgaaacgtctcgaagggtaaccaaactacttcaactattacgaccatacaagtgaaagtcccgaagacgtaagaagatgaagtctagagttatttatatacaaatacaaacgagacgtagtaagtaggaaatagtggtaggttagtacggcgggaaggaaccaaacgttcggacccgttcgaggtaaccacggacccgaaggtccnccggtccccg

SEQ ID NO: 428094 - DNA, 613 bp, Homo sapiens
  misc_feature: GZ8MTXP01EHMBG.22.6.A06.1.454.CMB.2.raw
  modified_base (213)..(213): a, c, t, g, unknown or other
  modified_base (328)..(328): a, c, t, g, unknown or other
  modified_base (482)..(482): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctggtgtcagtcgtccccaggacagacggcagatcacctgctctgganatgcactgaccaaatcaaattatgttcgtttttaggatacaagagacggccaggcccaccgccctgtacttaagtgtataataaataaagacgagtagagacggcctcgaaggtntcgtcgagtagcgtacttctcgtcgtccctaccgaacgcctaacgtaacgggaacctaaactacttaccaactattaccgaacctatacgtagtaacgaacgtacgaaagggacaaaggaagtagtagaagtcgtagtaacgtttatttaagtntaactaatacaagtagaagtagtaaggtaggtaaatgtcggttaggttagtcgggttacggaacggtaacgttaaacgttcggttaccgtaacgtagtaaccgacggaccgagtcccgttccgtaaccccg

SEQ ID NO: 428095 - DNA, 601 bp, Homo sapiens
  misc_feature: GZ8MTXP01A922D.22.6.A06.1.454.CMB.2.raw
  modified_base (216)..(216): a, c, t, g, unknown or other
  modified_base (236)..(236): a, c, t, g, unknown or other
  modified_base (363)..(363): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtcgtccccaggacagacggccagaatcacctgctctgganatgcactgaccaaatcaatntgttctttttggtatcaacagacggccaggccacgcccctgtcttaatgatatataaagacagtgagacggccctgagggtatctctgacgcgtacttctctcgccctcaagctcgagggacaaacnttacacgtattacgaccctatacgagtacgaacgtcccgaggacaagaagagtagacggtataggaacctttatttaacgttgtacctaaatacccaaagaggaacgtaaggttaaggtagggtaaattaggttcggtagggttacggttacgggacgggtaaacggaaccttaaacgttcggacccgtaaccggtagggtccaacggcccgttaagggtcccttccggtaacccccg

SEQ ID NO: 428096 - DNA, 540 bp, Homo sapiens
  misc_feature: GZ8MTXP01AFIBR.22.6.A06.1.454.CMB.2.raw
  modified_base (407)..(407): a, c, t, g, unknown or other
  modified_base (425)..(425): a, c, t, g, unknown or other
  modified_base (436)..(436): a, c, t, g, unknown or other
  modified_base (440)..(440): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtgtccccaggacagacggccagaatcacctgctctggagatgcactgaccaaatcaaatatgtctttttggtatcaacagaggccaggccacgcccctgtcttaatgatataataaagacagtgagaggccctcgagggatctctgagcgtacttctctgccctccaacgcctcgagggaacaaacacttacacattacgaccatcagtagaagccgaggacaagaaganagaggctagatattattntacaatcaaanaganagtagtaggtaatgtgtggttacggtcgggacgggaacggaacgaacgttcgaccgtaacgtacggtaaccgacgacccgacggtccgttcccgtccccg

SEQ ID NO: 428097 - DNA, 737 bp, Homo sapiens
  misc_feature: GZ8MTXP01ATTHH.22.6.A06.1.454.CMB.2.raw
  modified_base (218)..(218): a, c, t, g, unknown or other
  modified_base (266)..(266): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtcgtccccatgacagacggccagaatcacctgctcgtgganatgcactcgaacctaaatcaattagtgttcgtttttaggtatacgaanagacgacacggccaccgccctagtacttaatgtaatataataaagacgtagtagaggaccggtccctagagggtacttctcgtgagtccgtacttctcgtcgtccctaccgagtccgtacgaacgggtaaccaacgtacttaccaacttacgttaccgaacctaagtacgtaacggtaaggtaacgtacccggaagggtaaccgaaagggaaacggtagttaacgggacgggttaccttaaggggttaacgttttaaactttagtttaccggtaaactaaaccttaacgaaaccgtaaaggtaaccggtaaagggtttagggtaaaccggttaaagttaagggttaagggttacgggtttaacgggttccgggggaaacgggtaacggaaacccgttaaaggttcccggtaaccggtaccggtaacggtaaccgacccggttaccgtaaccggttcccggttaacccccgg

SEQ ID NO: 428098 - DNA, 554 bp, Homo sapiens
  misc_feature: GZ8MTXP01AH57H.22.6.A06.1.454.CMB.2.raw
  modified_base (215)..(215): a, c, t, g, unknown or other
  modified_base (421)..(421): a, c, t, g, unknown or other
  modified_base (436)..(436): a, c, t, g, unknown or other
  modified_base (446)..(446): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctggtgtcagtgtccccaggacagacggccagaatcacctgctctgganatgcactgaccaaatcaatatgtctttttggtatacaacagaggccaggccaccgccctgtactaatgatatataaagacagtgagacgccctcgaggatctctagagcgtacttctctcgccctccgaagcctcgacgggaccaaactacttacacgtatttacgacctatacgagtagactacgaggacaagaagagtagagtntacgattattagttntacaatcaanagtacgagtaggaggtaaattgtgtgggttacgttcgggacggtaacgggaaccaacgttcgacccgtaacgtaggtccgacgccggaacgtccgttccgtcccccgg

SEQ ID NO: 428099 - DNA, 638 bp, Homo sapiens
  misc_feature: GZ8MTXP01CHNBR.22.6.A06.1.454.CMB.2.raw
  modified_base (216)..(216): a, c, t, g, unknown or other
  modified_base (237)..(237): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctggtgtcagtcgtccccaggacagacggccagaatcacctgctctgganatgcactgaccaaatcaattntgtctttttggatcaacagagcaggccacgccctgtcttaatgatatataaagacagtgagacggccctgagggatctctgacgcgtacttcctctcgccctccgaagcctcgacgggaaccaaactattccaactattcgaaccctatcaagtagtaacgtcccgaagggacaaggaagaagttggaaggtccgtaggaactttagtttatttacggtaactaaattaccaaacgaggtaacgtaagggtaagggtaagggtaaattagttgggttaggttacggttccggggacggggtaaagggaacccttaaaacggttccggaaccccggttcccggtaagggttccgaacccgggtaccccgaaacgggtccccgttccccggtaacccccccgg

SEQ ID NO: 428100 - DNA, 754 bp, Homo sapiens
  misc_feature: GZ8MTXP01EL2IK.22.6.A06.1.454.CMB.2.raw
  modified_base (209)..(209): a, c, t, g, unknown or other
  modified_base (214)..(214): a, c, t, g, unknown or other
tcagacatacgcgtcacgaccggtgctcgatttagatctactgacaggggggtgggtccaggaggcagaactctgggtgtctcaccatggcctggatccctctacttctccccctcctcactctctgcacagactctgaggccgcctatgagctgacacagccaccctggtgtcagtcgtccccaggacagacggcagatcacctgctntggantgcatgaccaaatcaatatgttcttttggatcaacaggacgcaggccacgtccctgtactaatgaatataataaagacaggtgaaggacggcccctagaagggtactcgtacgtaggacgtcgtaactttccgtacgtcgacccctaccgaaacgtcccgtaacggaaacgggtaaacctaaacctactttccaaacttactttcgaaaccctataccgtaacggttagaaaccgtacccgaaggggacaaaggaaagagttagggaacgtaccgttaggttaaactttaattttaacgtagttaactaaactaaccgtaaacgaaggtaaacggtaagggttaaagggtaaaggggttaaaaccttaggggtttgggttaaacccggtttagggttacccgggggaaacgggggaaaaccggggttaaaccccttaaaaccggtttcggggaaacccccgtttaacggttaaacgggggtaacccaaacccgggacccggttaaacggtcccccggttttaaccccgggtccccccccg

SEQ ID NO: 428101 - DNA, 510 bp, Homo sapiens
  misc_feature: GZ8MTXP01BTXXI.22.6.A06.1.454.CMB.2.raw
  modified_base (458)..(458): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtcccccaggacagacggccagaatcacctgctctggagatgcactgccaaatcaatatgtctttttggtatcaacagaggccaggccacgcccctgtcttaatgatatataaagacagtgagaggccctcgagggatctctgagcgtattctctgccctccaagctcgagggacaacattcacattcgaccatcagtgaacgtcgaaggcaaggaagagtagaggctgtacttattattgtacaatcaacagacagtagaggaaatgtgtgttagtcggnggtaggacaacgttcgaccgtcgtaggtcacgcccaggtccttcgtcccccg

SEQ ID NO: 428102 - DNA, 648 bp, Homo sapiens
  misc_feature: GZ8MTXP01ETI4F.22.6.A06.1.454.CMB.2.raw
  modified_base (217)..(217): a, c, t, g, unknown or other
  modified_base (254)..(254): a, c, t, g, unknown or other
  modified_base (288)..(288): a, c, t, g, unknown or other
  modified_base (314)..(314): a, c, t, g, unknown or other
  modified_base (327)..(327): a, c, t, g, unknown or other
  modified_base (403)..(403): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtcgtccccaggacagacggccagaatcacctgctctgganatgcactgaccaaatcaatatgtcttttggtatcaanagagcagccacgccctgtctaatgatatataaanacagtgagacgccctgagggtatctntgagcgtattctntcgccctcaagctcgagggtaacaactacttacaactattacgacccatccgtaagtagaaacgtacgaaacgganaaggaagagtaggagtacgtagtaaacgttatttaagttacgttacaaattaccctaaaacgaacgtaaacgtaaagggttaaggttaaaggggtaaaagttaaggttaacgggttaagggttagggtttaccggggaacggggttaaacggggaaacccttaaaacggttccggttaacccggttccggtaacgggttccgaaccgggaccccgaaacggtcccgttaacccggtcccccccgg

SEQ ID NO: 428103 - DNA, 679 bp, Homo sapiens
  misc_feature: GZ8MTXP01BS97F.22.6.A06.1.454.CMB.2.raw
  modified_base (217)..(217): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacacgcccacccgtcggtgtcagtcgtccccaggacagacggcagaatcactgctctgganatgacactgacctaaaatctaaatattgttctttttaggtactacgaacgaggacggaccgacggcccaccgtccctagttacttaaagtgtaataataaataaagacgaggtagagacggtccctagaggtacttcgtacgtaggacgtcgtacttcctcgtcgccctccgaacgtccgtaacgacgggaaccaactactttacaacttaagttcaaccgtattacgacgtagaacgtaccgaacgggacaaggaacgagtaggtacgtacttaacggtactttaagttacgtttagtaactaaataaccgaaacgtagaaacgttaggttaaagggtaaggaaatttggtaaggggtttaagttacgggttaccggggaacggaaacgggtaacccttaaacggttcggaccccgttaacgacggtccgacgtaccccggaggtcccgttccgtcccccg

SEQ ID NO: 428104 - DNA, 496 bp, Homo sapiens
  misc_feature: GZ8MTXP01A8VFQ.22.6.A06.1.454.CMB.2.raw
  modified_base (403)..(403): a, c, t, g, unknown or other
  modified_base (415)..(415): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgtctttttggtatcaacagaggccaggccacgccctgtctaatgatatataaagacagtgagaggccctcagggatctctgagcgtattctctgccctccaagctcgagggacaactattcacattgaccatcagtgaagtccaggcagaagatgagctagactattntgacaatcaaanagacagtagtagaatgtgtgttgtcggaggaacggaacacgttcgaccgtcgtagcgacgaccgacgtccgttccgccccg

SEQ ID NO: 428105 - DNA, 646 bp, Homo sapiens
  misc_feature: GZ8MTXP01BQRS3.22.6.A06.1.454.CMB.2.raw
  modified_base (214)..(214): a, c, t, g, unknown or other
  modified_base (234)..(234): a, c, t, g, unknown or other
tcagacatacgcgtcacgaccggtgctcgatttagatctactgacagggggtgggtccaggaggcagaactctgggtgtctcaccatggcctggatccctctacttctcccctcctcactctctgcacagactctgaggccgcctatgagctgacacagccaccctcggtgtcagtcgtccccaggacagacggccagatcacctgctctgganatgcactgaccaaatcaatntgttcttttggtatcaacagaggccaggccacgccctgtacttaatgatatataaagacagtgagacggcctgaggatctctgagcgtacttctctcgcctcaacgctcgaggacaactattcactattcgacctatcagtagtaacgtaccgaggacaaggaagacgtagggaacggtacttacggtaactttaatttaagtttacgtaactaaataaccgaaacgtaacggtaaacgtaagggttaagggtaaagggtaaagtttggtaagggttgggttaacgggtttccgggggaacggggtaaacgggggtaaacccgttaaaacggttccggggttaacccggttccggtaacgggttccgaacccggacccggttaacggtcccggttaaccccgttcccccggg

SEQ ID NO: 428106 - DNA, 593 bp, Homo sapiens
  misc_feature: GZ8MTXP01CO3C2.22.6.A06.1.454.CMB.2.raw
  modified_base (217)..(217): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtgtccccaggacagacggccagaatcacctgctcgtgganatgcactgaccaaatcaatatgtctttttggatcaacagaggccaggccacgccctgtctatgatatataaagacagtagagacggccctcgagggatctcgtagagcgtactttcctctcgcccttccgaacgtcctcgaagggaaccaaactacttacaactattacgaccctataccgagtagaacgtccgaggacaaggaagagtagaggtctagtacttatttaattcgtacaagttacaacgaagacgaaggtagtaagggtaaattagtaagggtaggttaggttcgggacgggtaaacgggaccgttaaacgttcggaccggttaacgacggtaacgacggaccgaacggtccgttcccgtcccccgg

SEQ ID NO: 428107 - DNA, 610 bp, Homo sapiens
  misc_feature: GZ8MTXP01CX1FY.22.6.A06.1.454.CMB.2.raw
  modified_base (213)..(213): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctggtgtcagtcgtcccaggacagacggcagatcacctgctctgganatgcactgaccaaatcaattattgttctttttaggtatacaacgagaggaccaggcccacgcccctgtacttaatgaatataataaagacagtagaagacggccctagaggctctcaggagcgtacttcctctcgccctaccaacgtcctcgaagggtaaccaaactactacaactattacgaaccatacgtaaggtacgtaaacgtccgaagggtacaaaggaagacgtaggagggtacttaggtaactttatttagtttaccaataaacacgaactagtaactaggtaaggtaggtaaataggtggttaggttagttcgggacggtaacgggtaccaaacgttcggacccgtcggttacggcgacggcccgaacgtcccgttaacccgtccccgg

SEQ ID NO: 428108 - DNA, 670 bp, Homo sapiens
  misc_feature: GZ8MTXP01A3ZO3.22.6.A06.1.454.CMB.2.raw
  modified_base (175)..(175): a, c, t, g, unknown or other
  modified_base (216)..(216): a, c, t, g, unknown or other
tcagacatacgcgtcacgaccggtgctcgatttagatctactgacagggggtgggtccaggaggcagaactctgggtgtctcaccatggcctggatccctctacttcctccccctcctcactctctgcacagactctgaggccgcctatgagctgacacacgcccacccgtggtntcagtcgtcccaggacagacgccagatcactgctcgtgganatgacactgacctaaatctaattagttgttacgtttttaggtaatacgaacgaggacggaccgacggcccaccgtcccctgttacttaagtgtaattaataaataaagacgaggtaggaaggacggaccctagaggtactcgtacgtaggacgtcgtacctttccgtcgtccggtacccctaccgaacgtcccgtaacggaaaccgggaaacctaaccgtaacttaccaacttagttaccgaacctatacggtacgtacggtaaacggttcccgaaggacgaagtaagagttagacggtataacgtacttaagtttagtataacaatacaacgaaggtaacgtaaggtaaggtaagggtaatggttggtacgggttagttaccgggacggtaacggtaaccagttccggacgtaaccgttgaaccgacgaccgttacgtccgttcccgtccccg

SEQ ID NO: 428109 - DNA, 620 bp, Homo sapiens
  misc_feature: GZ8MTXP01AUQ1I.22.6.A06.1.454.CMB.2.raw
tcagacatacgcgtcacgaccggtgctcgatttagatctactgacagggggtgggtccaggaggcagaactctgggtgtctcaccatggcctggatccctctacttcctccccctcctcactctctgcacagactctgaggccgcctatgagctgacacagcccaccctggtgtcagtcgtcccaggacagacggcagaatcactgctctggagatgcactgacctaaatcaaattatgtttctttttaggtatacaacgagacggccgacggcccaccgtcccctgtacttaatgtaataataataaagacagtagaagacggccctagaggtatcgtcgtagacgcgtacttcctctcgccctacgaacgtctaacgagggaacctaaactactacactattacgactatacgagtagaacgtccgaaggacaaaggaagtagtaggagtgtacgtaactttatttaagttagtaactaaataccaaagaacgtaaagtaggtaaggtaagtaattaggtggtaggttaggtcgggacgggtaaacgggaacttaaacggttcgttacccgttcgtacggtccgaacgacccggaacgtcccgttcccgtaaccccgg

SEQ ID NO: 428110 - DNA, 498 bp, Homo sapiens
  misc_feature: GZ8MTXP02JREEA.22.6.A06.1.454.CMB.2.raw
  modified_base (305)..(305): a, c, t, g, unknown or other
  modified_base (412)..(412): a, c, t, g, unknown or other
  modified_base (416)..(416): a, c, t, g, unknown or other
tcagacatacgcgtcacgaccggtgctcgatttagatctactgacaggggtgggtccaggaggcagaactctgggtgtctcaccatggcctggatccctctacttctcccctcctcactctctgcacagactctgaggccgcctatgagctgacacagccaccctcggtgtcagtgtccccaggacagacggccagaatcacctgctctggagatgcactgaccaaatcaatatgtctttttggatcaacagaggccaggccacgcccctgtctaatgatatataaagacagtgagacggccctnagggatctctgagcgattctctgcctcagctcgagggacaacattcacattgaccatcagtgaagtccgaggcaagaagatgaggctgactattatgacaatcaaanaganagtagtagaaatgtagtagtagtcggaggacggaaccaacgtcgaccgtcgtacggacacgaccgaacggtcctcgtccccg

SEQ ID NO: 428111 - DNA, 496 bp, Homo sapiens
  misc_feature: GZ8MTXP02JOOMH.22.6.A06.1.454.CMB.2.raw
  modified_base (307)..(307): a, c, t, g, unknown or other
  modified_base (388)..(388): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgtctttttggtatcaacagaggccaggccacgcccctgtcttaatgatatataaagacagtgagaggccctnagggatctctgagcgacttctctgcctcagctcgagggacaacattcactattgaaccatcagtgaagtccaggcagaagntgagctgactattattgtacaatcaacagacagtagtaggaaatgtgtaggtattcggaggacggaccaaacgtcgaccgtcgtaggtcacgccgaaggctcgccccg

SEQ ID NO: 428112 - DNA, 503 bp, Homo sapiens
  misc_feature: GZ8MTXP02IJML9.22.6.A06.1.454.CMB.2.raw
  modified_base (355)..(355): a, c, t, g, unknown or other
  modified_base (369)..(369): a, c, t, g, unknown or other
tcagacatacgcgtcacgaccggtgctcgatttagatctactgacagggggtgggtccaggaggcagaactctgggtgtctcaccatggcctggatccctctacttctcccctcctcactctctgcacagactctgaggccgcctatgagctgacacagccaccctcggtgtcagtgtccccaggacagacggccagaatcacctgctctggagatgcactgccaaatcaatatgtctttttggtatcaacagaggccaggccacgcccctgtcttaatgatatataaagacagtgagaggccctcagggatctctgagcgattcgtctgcctccagctcagggacaacattcanattgaccatcagtnaagtccaggcagaagatgaggctagactattattgtcaaatcaaacagacaaggtagtagggaaatataggtaggtattcgggaggaggaccaaaacgtgaccgtcgtaggtcacgccaagggctcgtcccccg

SEQ ID NO: 428113 - DNA, 521 bp, Homo sapiens
  misc_feature: GZ8MTXP02GCK8J.22.6.A06.1.454.CMB.2.raw
  modified_base (308)..(308): a, c, t, g, unknown or other
  modified_base (414)..(414): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgaccaaatcaatatgtctttttggtatcaacagaggccaggccacgcccctgtcttaatgatatataaagacagtgagaggccctnagggatctctgagcgattctctgcctcagctcagggacaacattccacattgaccatcagtgaagtccaggcagaagatgaggctgactattattgtacaatcaanagacagtagtagggaaaatagtggtggtagttcgggacggtagggaaccaaaacgtcggaacccgttccgtaagggtccaacggccccaagggtcctcggtcccccg

SEQ ID NO: 428114 - DNA, 521 bp, Homo sapiens
  misc_feature: GZ8MTXP02HQFHB.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtcgtccccaggacagacggccagaatcacctgctctggagatgcactgaccaaaatcaatatgtctttttggtatcaacagaggccaggccacgcccctgtcttaatgatatataaagacagtgagaggccctcagggatctctgagcgattctctgcctcagctcagggacaacattcacattgaccatcagtgaagtccaggcagaagatgagctagacttatttatgtacaatcaaacagacagtagtagggaaaatagtgtaggttattcgggacgggagggaccaaaacgtcggaaccgtaaccgtagggtacaacggcccgaaaggcgttacgcccccg

SEQ ID NO: 428115 - DNA, 523 bp, Homo sapiens
  misc_feature: GZ8MTXP02HU2R6.22.6.A06.1.454.CMB.2.raw
  modified_base (498)..(498): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgaccaaatcaatatgtctttttggtatcaacagaggccaggccacgcccctgtcttaatgatatataaagacagtgagaggccctcagggatctctgagcgattctctgcctcagctcagggacaaacattcacattcgaccatcagtgaagtccaggcaagaagatgaggctgactatttattagtcaatacaacagacaagtagtagggaaaatagtagtaggttagttcgggacggacgggaaccaaacgtcggaccgtaaccgtaggtaccncgacccgacggccgttacgcccccg

SEQ ID NO: 428116 - DNA, 570 bp, Homo sapiens
  misc_feature: GZ8MTXP02ISV1N.22.6.A06.1.454.CMB.2.raw
tcagacatacgcgtcacgaccggtgctcgatttagatctactgacaggggtgggtccaggaggcagaactctgggtgtctcaccatggcctggatccctctacttctcccctcctcactctctgcacagactctgaggccgcctatgagctgacacagccaccctcggtgtcagtgtcccaaggacagacggccagaatcacctgctctggagatgcactgaccaaatcaatatgtctttttggtatcaacagaggccaggccacgcccctgtcttaatgatatataaagacagtgagaggccctcgagggatctctgagcgattctctgcctcagctcgagggacaacattcacattgaccatcagtgaatccaggcaagaagatgaaggtctagaacttatttattgtacaaatcaaaacagaacaaggttaagtaggggaaaatagttaggtagggttaaacgtttcggggacggggtaaacgggaaccctaaaaacgtcggaaccccggttaacgtaacggggtaccaacggaccccgaaaacgggtccgttaccggtaccccccg

SEQ ID NO: 428117 - DNA, 503 bp, Homo sapiens
  misc_feature: GZ8MTXP02I56D2.22.6.A06.1.454.CMB.2.raw
  modified_base (214)..(214): a, c, t, g, unknown or other
  modified_base (325)..(325): a, c, t, g, unknown or other
  modified_base (401)..(401): a, c, t, g, unknown or other
  modified_base (414)..(414): a, c, t, g, unknown or other
tcagacatacgcgtcacgaccggtgctcgatttagatctactgacagggggtgggtccaggaggcagaactctgggtgtctcaccatggcctggatccctctacttctcccctcctcactctctgcacagactctgaggccgcctatgagctgacacagccaccctcggtgtcagtgtccccaggacagacggccagaatcacctgctctgganatgcactgccaaatcaatatgtcttttggtatcaacagaggccaggccacgcccctgtcttaatgatatataaagacagtgagaggccctcagggatctctgagcgattcnctgcctcagctcagggacaacattcacattgaccatcagtgaagtccaaggcagaagatgagctgatattattgtnaatacaacagaanagtagtaggaagtagtagtaggtagtacggacggacggaacgaacgtacgtacgtaacgtacgtacgacgaccgacgacgtacgtcccg

SEQ ID NO: 428118 - DNA, 510 bp, Homo sapiens
  misc_feature: GZ8MTXP02HANWM.22.6.A06.1.454.CMB.2.raw
  modified_base (347)..(347): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgaccaaatcaatatgtctttttggatcaacagaggccaggccacgcccctgtctaatgatatataaagacagtgagaggcctcagggatctctgagcgattctctgcctcagctcagggacaacnttcacattgaccatcagtgaagtccaggcaagaagatgaggctgtactattattagtacaaatcaaactagacgtagtaggtaggaaatagtaggtagtagtcgggaggacggaacaaacgtcgtaccgtcgtaggacgacgaccgaacggctaccgtccccg

SEQ ID NO: 428119 - DNA, 531 bp, Homo sapiens
  misc_feature: GZ8MTXP02HRB3O.22.6.A06.1.454.CMB.2.raw
  modified_base (311)..(311): a, c, t, g, unknown or other
  modified_base (421)..(421): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgaccaaaatcaatatgtctttttggtatcaacagaggccagggccacgcccctgtcttaatgatataataaagacagtgagaggccctnagggatctctgagcgattctctgcctcagctcgagggacaaacatttcaactattcgaaccatccaagtgaaagttccagggcaagaagatgaggctagactatttattnacaaatcaaacagacagtagtagggaaaatgtagtggtattcgggagggtacgggaaccaaacgtcgaccgtaacgtacggtacacgacccgaacggccttacgcccccg

SEQ ID NO: 428120 - DNA, 513 bp, Homo sapiens
  misc_feature: GZ8MTXP02HT9Y3.22.6.A06.1.454.CMB.2.raw
  modified_base (367)..(367): a, c, t, g, unknown or other
  modified_base (384)..(384): a, c, t, g, unknown or other
  modified_base (403)..(403): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgtctttttggatcaacagagcaggccacgcccctgtctaatgatatataaagacagtgagaggccctagagggatctctgagcgattctctgcctcagctcagggacaactattcacattgaccatcagtanaagtccagcaagaagangaggctagactattagttntacaatcaaacagacagtaagtaggaaaatagtagtaggtagttcgagggtacggaaccgaaacgttacgaccgtaacgtacgtacacggacccaaggcctcgacccccg

SEQ ID NO: 428121 - DNA, 507 bp, Homo sapiens
  misc_feature: GZ8MTXP02FTU34.22.6.A06.1.454.CMB.2.raw
  modified_base (423)..(423): a, c, t, g, unknown or other
  modified_base (427)..(427): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtgtccccaggacagacggccagaatcacctgctctggagatgcactgaccaaatcaatatgtctttttggtatcaacagaggccaggccacgcccctgtcttaatgatatataaagacagtgagaggccctcgagggatctctgagcgattctctgcctcagctcgagggacaacattcacattgaaccatcagtagaagtccaggcaagaagatagaggctagacttattattgtacaatcaaanaganagtagagtaatagtgtagtacgtcggacggaacggaacaacgtcgaccgtcgtacgacacgaccgacggcctaccgcccg

SEQ ID NO: 428122 - DNA, 516 bp, Homo sapiens
  misc_feature: GZ8MTXP02JO96K.22.6.A06.1.454.CMB.2.raw
  modified_base (307)..(307): a, c, t, g, unknown or other
  modified_base (427)..(427): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtcgtccccaggacagacggccagaatcacctgctctggagatgcactgaccaaatcaatatgtctttttggtatcaacagaggccaggccacgcccctgtctatgatatataaagacagtgagaggccctnagggatctctgagcgattctctgcctcagctcgagggtacaactattcactattcgaccatcagtgaagtccgagcagaagatagagctagacttagttattgtacaaattcaaacaganagtagtagggaaatgtcgtagtagttcggaggacggaccaaacgtcgaccgtcgtacggtacgacgtccgaacggcctacggtcccccg

SEQ ID NO: 428123 - DNA, 508 bp, Homo sapiens
  misc_feature: GZ8MTXP02JZ4FW.22.6.A06.1.454.CMB.2.raw
  modified_base (308)..(308): a, c, t, g, unknown or other
  modified_base (350)..(350): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgtctttttggtatcaacagaggccaggccacgcccctgtcttaatgatatataaagacagtgagaggcccctnagggatctctgagcgattctctgcctcagctcagggacaacnttcacattcgaccatcagtgaaagtcccaggcaagaagatgaggctagactattattgtcaatcaaacagacagtagtagggaaaatgtggtaggtagtcgggacggacgggaaccaacgtgacccgtcgtaggtcacgacccgaaggctcgcccccg

SEQ ID NO: 428124 - DNA, 525 bp, Homo sapiens
  misc_feature: GZ8MTXP02ICTW4.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgtctttttggtatcaacagaggccaggccacgcccctgtcttaatgatatataaagacagtagagaggccctgagggatctctgagcgattctctgcctcagctcgagggacaaacattcactattgacccatcagtgaagtccgaggacaagaagatgagctgactatttattgtacaaatcaaacagacagtagtagggaaaattagtagtaggtagttcggacggaacgggaccaaaacgtcggaaccgtccgtaggtacgacgacccgaacggccttacgcccccg

SEQ ID NO: 428125 - DNA, 507 bp, Homo sapiens
  misc_feature: GZ8MTXP02GZIMM.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctggtgtcagtgtccccaggacagacggccagaatcacctgctctggagatgcactgaccaaatcaatatgtctttttggatcaacagaggccaggccacgcccctgtctaatgatatataaagacagtgagaggccctagagggatctctgagcgattctctgcctcagctcagggacaacattcacattgaccatcagtgaagtccaggcagaagatgagctagacttattattgtacaatcaacagacaaggtagtagggtaaaatagtgtggtattcgggaggtaacgggaccaaaacgtgaccgtcgtaggtacacgacccgaaggctacgcccccg

SEQ ID NO: 428126 - DNA, 545 bp, Homo sapiens
  misc_feature: GZ8MTXP02FIVVF.22.6.A06.1.454.CMB.2.raw
  modified_base (397)..(397): a, c, t, g, unknown or other
  modified_base (421)..(421): a, c, t, g, unknown or other
  modified_base (430)..(430): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtgtccccaggacagacggccagaatcacctgctctggagatgcactgaccaaatcaaatatgtctttttggtatcaacagaggccaggccacgcccctgtcttaatgatatataaagacagtgagacggccctgagggatctctgagcgattctctgcctccagctcgaggggacaaacattcactattgaaccattcagtagaagtccaggcaagaagntagagtctgaacttattattgtanaatccaaanagacaggtagagggtaaaatataggttaggtagttcgggacggtaacgggaacctaaaacgtggtaacccgtaacgtacggtaccacggacccgaacggcgtaccgtaccccccg

SEQ ID NO: 428127 - DNA, 526 bp, Homo sapiens
  misc_feature: GZ8MTXP02G5EUB.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtcgtccccaggacagacggccagaatcacctgctctggagatgcactgaccaaatcaatatgtctttttggtatcaacagaggccaggtcacgcccctgtctaatgatatataaagacagtgagaggccctcgagggatctctgagcgattctctgcctccagctcgagggacaaacattcactattgaccatcagtgaaagtccagcagaagatgagctgactagttatgtacaatcaacagacagtagtagggaaaatagtaggtaggtattcgggacgggaacgggaaccaaaacgtcggaaccgttccgtagggtaccacggacccaagggtcctacgtccccccg

SEQ ID NO: 428128 - DNA, 511 bp, Homo sapiens
  misc_feature: GZ8MTXP02GC28W.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgaccaaatcaatatgtcttttggtatcaacagagccaggccacgcccctgtcttaatgatatataaagacagtgagaggccctgaggatctctgagcgattctctgcctcagctcgagggacaacattcatattgaccatcagtagaagtccaggcaagaagatagaggctagacttatttatgtacaatacaacagaacagtagtagggtaaatagtggtaggtagttcgggacggaacgggaccaaacgtcgaccgtcgtaggtacacgccgaaggcctcgaccccg

SEQ ID NO: 428129 - DNA, 517 bp, Homo sapiens
  misc_feature: GZ8MTXP02JOR1X.22.6.A06.1.454.CMB.2.raw
  modified_base (215)..(215): a, c, t, g, unknown or other
  modified_base (399)..(399): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctgganatgcactgccaaatcaatatgtctttttggatcaacagaggccaggccacgcccctgtctaatgatatataaagacagtgagaggccctcagggatctctgagcgacttctctgcctcagctcgagggacaaacattacactattgaccatacagtgaagtcccgaggcaagaagatgaaggcngtaactatttatgtacaatacaaacagaacagtagtagggaaaatagtacgtaggtagttcgggacggaacggaccaaacgtgaaccgtcgaggtcacgcccgaagccgtcgcccccg

SEQ ID NO: 428130 - DNA, 524 bp, Homo sapiens
  misc_feature: GZ8MTXP02F1K1C.22.6.A06.1.454.CMB.2.raw
  modified_base (389)..(389): a, c, t, g, unknown or other
  modified_base (421)..(421): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgaccaaatcaatatgtcttttggtatcaacagagccaggccacgcccctgtcttaatgatatataaagacagtgagaggccctgagggatctctgagcgattctctgcctcagctcgagggacaaacattcactattcgaccatcagtgaagtccaggcaagaaganagaggctagaacttattattgtacaatacaanagactagtagtaggaaatgtgttaggtagttcgggacgggaaggaccgaaaacgtggaaccgtaacgtaacggtcacggaccgaaacggccgtacgacccccg

SEQ ID NO: 428131 - DNA, 539 bp, Homo sapiens
  misc_feature: GZ8MTXP02HFQ4I.22.6.A06.1.454.CMB.2.raw
  modified_base (237)..(237): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtgtcccaaggacagacggccagaatcacctgctctggagatgcactgaccaaatcaaatntgtctttttggtatcaacagaggccaggccacgcccctgtacttaatgatatataaagacagtagagacggccctcgagggatctctgagcgacttctctcgcctcacgctcgagggacaacacttcaactattcgaacctatccagtagaacgtccgaggacaagaagagtagaggctagtacttattatgtacaatcaacagacagtagtagggaaatgtaggtaggtagttcgggacggtaacgggaccaaacgtcgacccgtaacgtaggtcacggacccacggcctccggtcccccg

SEQ ID NO: 428132 - DNA, 675 bp, Homo sapiens
  misc_feature: GZ8MTXP02H87L5.22.6.A06.1.454.CMB.2.raw
  modified_base (237)..(237): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgaccaaatcaaattntgtctttttggtatcaacagaggccaggccacgcccctgtcttaatgatataataaagacagtgagaggccctgaggatctctgagcgatctctgcctcagcctcgacggggaacaaactatttacaacctatttacgaaccctaataccgaagttagaaacggtcccgaagggacaaggaaagagtaggaaggacctaggtaaaccttaatttagtttaggtactaaaattaccaaaacgaagtaaacgtaagggttaaaggtaagggggtaaaaaagttaacggtttagggttaggggttttaacggtttaacgggtaccgggggaaacgggggtaaaacccgtaaaaaccgtacgggtaaacccggttaacccggttaaacggttaaccggtaacggacccccgtaaaagttaccggttccgttaaccccccggg

SEQ ID NO: 428133 - DNA, 560 bp, Homo sapiens
  misc_feature: GZ8MTXP02H45VU.22.6.A06.1.454.CMB.2.raw
  modified_base (272)..(272): a, c, t, g, unknown or other
  modified_base (366)..(366): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcatgaccaaatcaatatgtcttttttggtatcaacagaggccaggccacgcccngtctaatgatatataaagacagtgagaggccctgaggatctctgagcgattctctgcctcagctcagggaacaacattacacattgaaccctancagtgaaacgtccgaaggacaaggaaagagttaggaacgggaccgtaggtaaattaattttaagttaggtactaaattacaaaacctaagaacgagttaaggtaggggaaaattaagttgtaggttagttcggacgggaggaaccaaacgtgaccgtaaccgaggtacacgacccgaacggcttccgcccccgg

SEQ ID NO: 428134 - DNA, 589 bp, Homo sapiens
  misc_feature: GZ8MTXP02JYOP9.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtgtccccaggacagacggccagaatcacctgctctggagatgcactgaccaaatcaatatgtctttttggtatcaacagagccaggccacgcccctgtcttaatgatatataaagacagtgagacggccctcgagggatctcgtgagtcgacttctctcgcctcagctcgagggacaactatcactattcgaccatcagtagaacgtccgaggacaaggaaagagtaggacgactagaacttattagttatactaaatacaaacgaagtaacgtaaggtaggtaaggggtaaaattagttacggttaggttaggttaccggggaacgggaacggggaaccctaaaacgtaccggtacccgtaacgtaacgggtacgaccggacccggaacggtcccgtccggtaccccccgg

SEQ ID NO: 428135 - DNA, 545 bp, Homo sapiens
  misc_feature: GZ8MTXP02I0W9R.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtcgtccccaggacagacggccagaatcacctgctctggagatgcactgaccaaatcaaatatgtctttttggtatcaacagaggccaggccacgcccctgtctaatgatatataaagacagtgagacggcctacgagggatctctgagcgattctctgcctcagctcgagggacaaactattcaactattcgaacccattccaagtgaacgttacccaggccaagaagagtgaggactgaacttattattgtacaaatcaaacagacagtaggtagggaaatatggtagtagttcgggacggacgggtaccaaacgtcggacgtaaccgtaggtaccgacggacccgaacggtcctacggtccccccg

SEQ ID NO: 428136 - DNA, 521 bp, Homo sapiens
  misc_feature: GZ8MTXP02JY04Q.22.6.A06.1.454.CMB.2.raw
  modified_base (353)..(353): a, c, t, g, unknown or other
  modified_base (396)..(396): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtgtccccaggacagacggccagaatcacctgctctggagatgcactgaccaaatcaaatatgtctttttggatcaacagaggccaggccacgcccctgtctaatgatatataaagacagtgagaggccctgagggatctctgagcgtattctctcgcctcagctcgagggacaacnttcactattcgacctatcagtagaaacgtccgaggcaaggaanagtgagctagacttattattgtacaatacaaacagactagtaggtaggaaaatgtaggtagtagtcggaggacggaaccaaacgtcgaccgtcgtacggtcacgacccgaaggtcctcgcccccg

SEQ ID NO: 428137 - DNA, 540 bp, Homo sapiens
  misc_feature: GZ8MTXP02H3QPU.22.6.A06.1.454.CMB.2.raw
  modified_base (280)..(280): a, c, t, g, unknown or other
  modified_base (307)..(307): a, c, t, g, unknown or other
  modified_base (357)..(357): a, c, t, g, unknown or other
  modified_base (430)..(430): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctggtgtcagtgtccccaggacagacggcagaatcacctgctctggagatgcactgaccaaatcaaatatgtctttttggtatcaacagaggccaggccacgcccctgtcttaangatatataaagacagtgagaggccctnagggatctctggagcgacttctctgcctccagctcgaggacaacattcanattcgaccatcagtgaatccgaggcaaggaaagatagagactagtaacttagtttattgtacaaattccaaanagaacgtaagtaggtaaggtaaatagttaggtaggttagtacgggacggacggaaccgtaaacgtcgaccgtaacgtacggtacgacgacccgacggtcctccgtccccg

SEQ ID NO: 428138 - DNA, 528 bp, Homo sapiens
  misc_feature: GZ8MTXP02JDG7U.22.6.A06.1.454.CMB.2.raw
  modified_base (254)..(254): a, c, t, g, unknown or other
  modified_base (436)..(436): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtcgtccccaggacagacggccagaatcacctgctctggagatgcactgaccaaatcaaatatgtctttttggatcaangagccaggccacgcccctgtcttaatgatatataaagacagtgagacggccctgagggatctctgagcgtacttctctgcctccagctcgacgggacaactattcacattcgaaccattcagtgaacgtccgaggcaagaagatagaggctgaacttattattgtactaaatcaaagacganaagtaggtaggaaaatgttacggtggtagtcgggacgggacggaaccaacgtcgacgtcgtacggtacacgaccgaacggctccgtcccccg

SEQ ID NO: 428139 - DNA, 619 bp, Homo sapiens
  misc_feature: GZ8MTXP02ISWFB.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtcgtccccaggacagacggcagaatcacctgctctggagatgcactgaccaaatcaatatgttctttttggtatcaacagaggccaggccaccgcccctgtcttaatgatatataaagacagtgagaggccctcgaggatcgtctgagcgtacttcctctcgtcctccacgctcgagggaacaaactattaccaactattacgaacctatactagtagaaacgttcccgaggaccaaggaagagtaggaggctagtacttaatttagttagtactaaactacaaacaagtaacgaaaggttaggtaagggtaaaattagttacggttaggttaaggtttacggggaacggggaacgggtaaacccgtaaaacgtccggtaacccgtaaccgtaacgggttaccgaaccggacccgtaaacggcccgtaaccgtccccccggg

SEQ ID NO: 428140 - DNA, 629 bp, Homo sapiens
  misc_feature: GZ8MTXP02GC89R.22.6.A06.1.454.CMB.2.raw
  modified_base (210)..(210): a, c, t, g, unknown or other
  modified_base (215)..(215): a, c, t, g, unknown or other
  modified_base (253)..(253): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctggtgtcagtcgtccccaggacagacggcagaatcacctgctntgganatgcactgaccaaatcaatatgttcttttggtatcaanagacgccaggccaccgcccctgtacttaatagataataataaagacaggtgaagacggcctacgagggacttctcgtagacgtcgtactttctctcgccctaccgacgtctcggaacgggaactaaaccgtacttacaactactttacgaaacctattaccgaaggttagaaacgtcccgaaaggacaaaggaaagtagtaggaggtactaagtaatttaatttagttacgtaacaaatacaaacgaagtaataaggtaaggtaaagggtaaaattaggtacggttaggttaggtacggggacgggtaacggaacctaaacgtcggtaaccgtaacgttacggacgacgacccgaacgtcccgtaccgtacccccg

SEQ ID NO: 428141 - DNA, 618 bp, Homo sapiens
  misc_feature: GZ8MTXP02GJ2OJ.22.6.A06.1.454.CMB.2.raw
  modified_base (254)..(254): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtcgtccccaggacagacggccagaatcacctgctctggagatgcactgaccaaatcaatatgtcttttggtatcaanagaggcaggccacgcccctgtctaatgatatataaagacagtgagaggccctcgagggatcgtctgagcgattctctgcctcagctcgacgggacaaactattacactattacgacccatacagtagaacgttcccgagggacaaggaaagattagggacggacgtaggtaaacttatttaagttaggtactaaacttaccgaaaaccgagaaaccgtaaaggttaaggtaaggggtaaaattaggttaggttagggttaagtttacggggacgggtaaacggggaacccgtaaaaacgtcggtaacccggtaaccgttaacggtacgaacggacccgaaacggtcccgtaccggtccccccgg

SEQ ID NO: 428142 - DNA, 666 bp, Homo sapiens
  misc_feature: GZ8MTXP02IQEWO.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtcgtccccaggacagacggccagaatcacctgctctggagatgcactgaccaaatcaatatgttcttttaggtatacaacagacggccacggccaccgcccctgtacttaatgatataataaagacagtagagacggccctagaggatctcgtgagtcgtacttcctctcgcctacacgtctcgaaggaaccaaactactttaccactaactttacgaaaccctatacgtaagtacgtaaacggtcccgaaggacaaaggaaacgagtagggaacgggtacttaaggtaacctttaaatttttacgttacgtaactaaacttaccgaaacgtaaggaacgtaaaggttaaggggtaaaggtaaaagttaggttagggttagggttaacggttcggggaaaccggggtaaacgggaaacccgtaaaacgtcggtaacccggttaacgtaacggtacaccggacccgtaacggtcccgtacccgtcccccgg

SEQ ID NO: 428143 - DNA, 590 bp, Homo sapiens
  misc_feature: GZ8MTXP02GP6ZO.22.6.A06.1.454.CMB.2.raw
  modified_base (253)..(253): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgaccaaatcaatatgtctttttggtatcaanagaggccaggccacgccctgtcttaatgatatataaagacagtgagacggccctagaggatctcgtgagcgattctctcgcctcagctcgagggacaaacgtatacaactattcgaacctataccgagtacgaaagtcccgagggactaaggaaagtatggaaggctagtaacttatttagttagtactaaataccaaactagaactaaggtaggtaagggaaaattgtaggtagggttaacgttcggggacgggaacgggtaccgaaaacgtcggtaacccgtaacgttaacgggtacaaccggtacccgaaacggtcccgtaccggtaccccccg

SEQ ID NO: 428144 - DNA, 691 bp, Homo sapiens
  misc_feature: GZ8MTXP02JPBG4.22.6.A06.1.454.CMB.2.raw
  modified_base (215)..(215): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctgganatgcactgccaaatcaatatgtctttttggtatcaacagaggccaggccacgcccctgtctaatgatatataaagacagtgagacggccctagagggatctctgagcgacttctctcgcctccagctcgaacgggacaaactattacactacttcgaaccctattaccgaagttacgaaacggtacccgaaagggccgaaaggaaaggtagttagggaacgggtaccttaggtaaacctttatttttaagttacggttaacctaaaagttaccaaaaccgaaggtaaccgtaaagggttaaagggttaaagggggtaaaaattaggttagggttaccgggtttaaggttaccgggggacgggggttaaacgggaaaccccgtaaaaccggttccgggtaaaccccggttaaccggttaacgggtacccgacgggtacccccgaaacgggttccccgttaacccggtacccccccgg

SEQ ID NO: 428145 - DNA, 546 bp, Homo sapiens
  misc_feature: GZ8MTXP02FUNI4.22.6.A06.1.454.CMB.2.raw
  modified_base (281)..(281): a, c, t, g, unknown or other
  modified_base (432)..(432): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgaccaaatcaatatgtctttttggtatcaacagaggccaggccacgcccctgtcttaangatatataaagacagtgagaggccctagagggattctcgtgagcgtattctctgcctcagctgaggaacaacattcatattcgaaccatcagttagaaacgtccgaaggcaagaagataggaggctagacttattattgtacaataccaanagactaggtagtagggaaaatgtggtaggtagttcgggacggtaacggggacctaaaacgtcggaacccgtaacgtacggtacaacggtccccgaaacggcctacgtcccccgg

SEQ ID NO: 428146 - DNA, 587 bp, Homo sapiens
  misc_feature: GZ8MTXP02GHQST.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcaatgtccccaggacagacggccagaatcacctgctctggagatgcactgaccaaatcaatatgtctttttggatcaacagaggccaggccacgcccctgtcttaatgatatataaagacagtgagaggccctgagggatctctgagcgtattctctcgcctccagctcgagggacaaacattcaactattcgacccatacagtagaacgtcccaggcaagaagagtgaggctagaacttatttattgtacaatacaaacagaacgtaagttaaggtagggtaaaattagttaggttaggttaagtttacggggacggggtaacggggaaaacccgtaaaacgtcggtaaacccgttccgtaacgggttaccgaacggaccccgaaaacgggtcccttaccggtcccccccgg

SEQ ID NO: 428147 - DNA, 575 bp, Homo sapiens
  misc_feature: GZ8MTXP02IPBDC.22.6.A06.1.454.CMB.2.raw
  modified_base (214)..(214): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggcagaatcacctgctctgganatgcactgaccaaatcaatatgtctttttggtatcaacagaggccaggccacgcccctgtcttaatgatatataaagacagtgagaggccctcgagggatctctgagcgattctctgcctcagctcgagggacaacgattcactattgacctatccagtagaacgtcccgaaggccaaggaaagagtaggacggtactaggtaaccttaatttagttgtacaaactcaaacgagaacgtaagtaggtaggaaaatagttaggtggtttaagtcggggtacggaaacggggacctaaaacggtcgtaaccggtaaccgtaacggtacgacggtacccgaacgggtcctaccggtacccccgg

SEQ ID NO: 428148 - DNA, 536 bp, Homo sapiens
  misc_feature: GZ8MTXP02HV476.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtcgtccccaggacagacggccagaatcacctgctctggagatgcactgaccaaatcaatatgtctttttggatcaacagagccaggccacgcccctgtctaatgatatataaagacagtagagaggccctgagggtatctctgagcgtattctctgcctcacgctcgaggacaacattcacattcgaccatcagtgaacgtccaaggcaagaagatgaggactgaacttatttagtgtacaaatcaaacagaacagttaggaagggtaaatacgttaggtacggttaagttcgggacggtaacggaacctaaacgtcgaaccgtaacgtaggtacacggaccaacggcttacgacccccg

SEQ ID NO: 428149 - DNA, 538 bp, Homo sapiens
  misc_feature: GZ8MTXP02IMRJI.22.6.A06.1.454.CMB.2.raw
  modified_base (215)..(215): a, c, t, g, unknown or other
  modified_base (233)..(233): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctggtgtcagtcgtccccaggacagacggccagaatcacctgctctgganatgcactaacaatcaatntgtcttttgtatcacagaggccagccacgccctgtctatgatatataaagacagtgagaggcctcgagggatctctgagcgtattcctctcgcctccagctacaggggacaacattcactattcgaccatcagttgaagtccgaagcaggaagatagagctagtaacttatttattgtactaattacaaaccgagactaagtaagtagggtaaatagtaggtaggttagttacggacgggaacggaacgaacgtacgaccgtccgtaaggtcacgacccgaacggccgtccgaccccgttaccgg

SEQ ID NO: 428150 - DNA, 543 bp, Homo sapiens
  misc_feature: GZ8MTXP02JF7YI.22.6.A06.1.454.CMB.2.raw
  modified_base (217)..(217): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtcgtccccaggacagacggccagaatcacctgctctgganatgcactgaccaaatcaatatgtctttttggtatcaacagaggccaggccacgcccctgtcttaatgatatataaagacagtagagaggccctacagggatctctgagcgacttctctgcctccagctcgagggacaacattacacattcgacctatcagtagaagtcccgagcaagaagatagagctagacttattatgtacaatacaacagacagtaagtagggaaaatagtaggtaggttagttcgggaggaacgggtaaccaaacgtcgaccgtaacgtacggttaccgaacggacccgaaacggtccgtacgtccccccgg

SEQ ID NO: 428151 - DNA, 511 bp, Homo sapiens
  misc_feature: GZ8MTXP02F6K37.22.6.A06.1.454.CMB.2.raw
  modified_base (216)..(216): a, c, t, g, unknown or other
  modified_base (308)..(308): a, c, t, g, unknown or other
  modified_base (356)..(356): a, c, t, g, unknown or other
  modified_base (414)..(414): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtcgtccccaggacagacggccagaatcacctgctctgganatgcactgaccaaatcaatatgtcttttggtatcaacagaggccaggccacgcccctgtcttaatgatatataaagacagtgagaggccctnagggatctctgagcgattctctgcctcagctcgagggacaacattcanattgaccatcagtgaagtcaggcagaagatagagctgactattatgtacaatcaacanacagtagtagggaaatagtgtaggtagttcgggacggaagggaccaaacgtggacccgtaacgtagtaccgacgacccgaaggccgtacgtcccccg

SEQ ID NO: 428152 - DNA, 558 bp, Homo sapiens
  misc_feature: GZ8MTXP02HWFXT.22.6.A06.1.454.CMB.2.raw
  modified_base (310)..(310): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctggtgtcagtcgtccccaggacagacggccagaatcacctgctctggagatgcactgaccaaatcaaattatgttctttttggtattcaacagaggcaggccacgccctgtcttaatgatatataaagacagtgagaggccctnagggatctctgagcgattctctgcctcagctcgagggacaacattacactattcgacctatcagtagaagtcgaaaggcaagaagatgagctagacttatttattagtacaaatacaaacagaacaaggtaagtagggtaaaattagtaggttaggttagttacggggacgggaacgggaaccgtaaacgtacggtacccgtaacgtacggtaccgacgacccgtaaacggccgtaccggtcccccgg

SEQ ID NO: 428153 - DNA, 576 bp, Homo sapiens
  misc_feature: GZ8MTXP02GUVHP.22.6.A06.1.454.CMB.2.raw
  modified_base (362)..(362): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgaccaaatcaatatgtcttttggtatcaacagaggccaggccacgcccctgtcttaatgatatataaagacagtgagaggccctgaggatctctgagcgtacttctctcgcctccgagctcgagggaactaacattccanattacgacctatacagtagaacgtaccgaggacaagaagagtgaggtctagaacttagtttaatgtactaagtacaaacgagaactaggttaagtaggggtaaaattagttagtaggggttaacgttacggggacggtaacgggaaccgtaaaacgtcggaaccggttaaccgtacggtacgaacgcccgaacggtccgtcccggtacccccgg

SEQ ID NO: 428154 - DNA, 586 bp, Homo sapiens
  misc_feature: GZ8MTXP02GMT8D.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtcgtccccaggacagacggcagaatcacctgctctggagatgcactgaccaaatcaatatgtcttttggtatcaacagagaccaggccacgcccctgtcttaatgatataataaagacagtagagaggccctacagggtatctctgagcgtacttctctgcctcagctcgagggacaactattacaacgtattcgaacctattcgaagtgaaacgtccgaaggcgaagaaagagtagacggtatagtacttaatttagttagtactaaataaccaaagaagtaactaaggtaaggtagggaaaattagtacggttagggttagttacggggacgggaacgggtaaccctaaaacggtacgtaacccgtaacgttacggacacggtacccgaagtccgttaccgcccccgg

SEQ ID NO: 428155 - DNA, 542 bp, Homo sapiens
  misc_feature: GZ8MTXP02IJECL.22.6.A06.1.454.CMB.2.raw
tcagacatacgcgtcacgaccggtgctcgatttagatctactgacagggggtcggtccaggaggcagaactctgggtgtctcaccatggcctggatccctctacttctccccctcctcactctctgcacagactctgaggccgcctatgagctgacacagccaccctggtgtcagtgtccccaggacagacggccagaatcacctgctctggagatgcactgaccaaatcaatatgtctttttggtatcaacagaggcaggccacgccctgtctaatgatatataaagacagtgagaggccctgagggatctctgagcgacttctctcgcctcagctcagggacaacattcacatttcgaacctatacagtagaaacggtcccaagggcaaggaaagataggaggactagaacttatttagtgtacaatacaacagacgaagtaagtgggaaaatagtagtaggtagttcgggacggaacggaccgaaaacgtcgaccgtaaccgtaggtacacggacccgaacggcctaccggtacccccg

SEQ ID NO: 428156 - DNA, 558 bp, Homo sapiens
  misc_feature: GZ8MTXP02H82NH.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaaatatgtctttttggtatcaacagaggccaggccacgcccctgtcttaatgatataataaagacagtgagaggccctcgaggggatctctgagcgattctctcgcctcagctcagggacaacattcacattcgaccatcagtgaaacgtccaggacaagaagagtgagctgaacttatttattgtacaatacaaacagtacgaagttaggtagggaaaattagtggtacgggttattcggggacgggaaacgggtaaccgaaaacgttcggaacccggttccgtaacgggtaccacggaacccgaacggtccgtaccgtccccccgg

SEQ ID NO: 428157 - DNA, 531 bp, Homo sapiens
  misc_feature: GZ8MTXP02IE38L.22.6.A06.1.454.CMB.2.raw
  modified_base (215)..(215): a, c, t, g, unknown or other
  modified_base (252)..(252): a, c, t, g, unknown or other
  modified_base (438)..(438): a, c, t, g, unknown or other
  modified_base (440)..(440): a, c, t, g, unknown or other
tcagacatacgcgtcacgaccggtgctcgatttagatctactgacagggggtgggtccaggaggcagaactctgggtgtctcaccatggcctggatccctctacttcctccccctcctcactctctgcacagactctgaggccgctatgagctgacacagccaccctggtgtcagtcgtccccaggacagacggccagaatcacctgctctgganatgcatgaccaaatcaatatgtctttttggtatcaanagaggccaggccacgcccctgtacttaatgatataataaagacagtagagacggcctacgagggatctctagagcgtacttctctcgcctacagctcgacgggaacaaactattacactattcgaccatcagtgaaacgtccgaggacaagaagatgagctagtactatttatagtacaatcaaananagtagtagtagtaagtagtagtagtagtacggacggaacggaacgtaacgtacgacgtaacgtacgtacgacgacgacgacgtccgtcccg

SEQ ID NO: 428158 - DNA, 555 bp, Homo sapiens
  misc_feature: GZ8MTXP02H4IYT.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtccagtgtccccaggacagacggccagaatcacctgctctggagatgcactgaccaaatcaatatgtctttttggtatcaacagagcaggccacgccctgtcttaatgatatataaagacagtgagaggccctgagggtatctctgagcgtattctctcgcctcagctcgagggacaactattcactattcgacctatcagtgaacgtccaggcaagaagatagaggctagaacttatttatagtacaatcaaacagacaaggttagtagggaaaattgtaggttagggttaagttcggggacgggaacgggaccgtaaaacgtcggaaccgtaaccgtacggggtaccacggacccgaacggggtcctaccggtccccccgg

SEQ ID NO: 428159 - DNA, 567 bp, Homo sapiens
  misc_feature: GZ8MTXP02IW3BF.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctggtgtcagtcgtccccaggacagacggccagaatcacctgctctggagatgcactgaccaaatcaatatgtctttttggtatcaacagaggcaggccacgccctgtctaatgatatataaagacagtgagagccctacgaggatctctgagcgacttctctcgcctcgagctcgacggacaactattcaactattcgaacctatacgaagtagtaaacgtacgaaaggcaaaggaaagagtaggaaggtcgtagtaaacttattttatgtaccaaatacaaacagacaagtagtagggaaaatagttacggtagttaggtacgggacgggaaacggtaaccaaaacgttcgaaccgtccgtaaggtaccacggacccgaacggtccgtccgtacccccgg

SEQ ID NO: 428160 - DNA, 619 bp, Homo sapiens
  misc_feature: GZ8MTXP02IBI6V.22.6.A06.1.454.CMB.2.raw
  modified_base (253)..(253): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtcgtccccaggacagacggccagaatcacctgctctggagatgcactgaccaaatcaatatgtctttttggatcaanagaggcaggccacgcccctgtcttaatgatataataaagacagtgagacggcctgaggatctctgagcgtattctctcgccctcagtctcgacgggaacaactattacaactattcgaccctatccgtagtagaacgtccgaaggcaaagaaagagtaggagtacgtagtaaccttaatttagttgtaactaacttacaaaacgtaacgaagaaaggttaggtaaagggtaaaattaaggttaggttaggttaacgttacggggaacggggtaaacgggaaacccgtaaaacgttccggaacccgttaacggttaacggtaccgaacggaacccggaaaccggtccgtaaccccggttccccccgg

SEQ ID NO: 428161 - DNA, 535 bp, Homo sapiens
  misc_feature: GZ8MTXP02IKF9N.22.6.A06.1.454.CMB.2.raw
  modified_base (366)..(366): a, c, t, g, unknown or other
  modified_base (371)..(371): a, c, t, g, unknown or other
  modified_base (384)..(384): a, c, t, g, unknown or other
  modified_base (415)..(415): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctggtgtcagtgtccccaggacagacggccagaatcacctgctctggagatgcactgaccaaatcaaatatgtctttttggtatcaacagaggccaggccacgcccctgtacttaatgatatataaagacagtgagaggccctgagggatctctgagcgtattctctgcctcagctcgaggacaacattcacattcgacancagtnagtcagcagaagntgagctagactatttatgtactaatacaaanagaactaggtaaggtaggtaaaatagttaggtaggttagttacgggacgggaaacgggtaaccaaaacgtcgaccgtaacgtacggtacgacgacccgaacggtaccgtccgtacccccg

SEQ ID NO: 428162 - DNA, 520 bp, Homo sapiens
  misc_feature: GZ8MTXP02HZ98F.22.6.A06.1.454.CMB.2.raw
  modified_base (170)..(170): a, c, t, g, unknown or other
  modified_base (250)..(250): a, c, t, g, unknown or other
  modified_base (403)..(403): a, c, t, g, unknown or other
  modified_base (408)..(408): a, c, t, g, unknown or other
tcagacatacgcgtcacgaccggtgctcgatttagatctactgacagggggtgggtccaggaggcagaactctgggtgtctcaccatggcctggatccctctacttctcccctcctcactctctgcacagactctgaggccgcctatgagctgacacagccaccctggtntcagtgtcccaggacagacggcagaatcacctgctctggagatgcactgaccaaaatcaatatgtctttttggatcaacngagcaggccacgccctgtctaatgatatataaagacagtgagacgccctgagggatctctgagcgtattctctgcctcagctgaggacaacattcactattcgaccatcagtgaacgtcgagcagaagatgaggctgaacttagttatcgtanaatanaaacagtacaagtagtagggaaatacgtagtcggttagttcgggacgggaacggacctaaaacgtcgtacccgtaacgtggtaacacgccgaaacggtcctaccggtccccg

SEQ ID NO: 428163 - DNA, 598 bp, Homo sapiens
  misc_feature: GZ8MTXP02FRO2B.22.6.A06.1.454.CMB.2.raw
  modified_base (216)..(216): a, c, t, g, unknown or other
  modified_base (468)..(468): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtgtccccaggacagacggccagaatcacctgctctgganatgcactgaccaaatcaatatgtcttttggatcaacagaggcaggccacgccctgtcttaatgatatataaagacagtgagacggcctgagggatctctgagcgtacttcctctgcctcacgctcgagggacaaactacttacaactagtttcgaacctataccgtaagttacggaacgttccgagggacaaaggaaaggtataggaggaccgttaggtaacctttaattatttggtaactaattaccaaanacgataaggtaaggtaagggtaaaattagtacggttaggttaacggttcggggaacgggaacggggtaacctaaacggtcgtaacccgtaacgtacggtacacggacccgaacgggcctacggtcccccg

SEQ ID NO: 428164 - DNA, 557 bp, Homo sapiens
  misc_feature: GZ8MTXP02GZK8Q.22.6.A06.1.454.CMB.2.raw
  modified_base (209)..(209): a, c, t, g, unknown or other
  modified_base (362)..(362): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctggtgtcagtcgtccccaggacagacggccagatcacctgctntggagatgcactgaccaaatcaaattatgtctttttggatacaacagacggccaggccacgcccctgtacttaatgatataataaagacagtgagacggccctgagggtatctcgtagagcgtacttctctcgcctcagctcgaggacaactnttcacattcacctatcagtagaacgtccgaggacaaggaagagtacgaggtactagtaaacttatttattacgtacaatacaaagtagacgtaagtaggaagggtaaatagttcggttaggtagttcgggacggaacgggtaccaaacgtcgaaccgtcgtaacggtcaacgaccgaaggcctaccggtcccccg

SEQ ID NO: 428165 - DNA, 580 bp, Homo sapiens
  misc_feature: GZ8MTXP02GRVYS.22.6.A06.1.454.CMB.2.raw
  modified_base (216)..(216): a, c, t, g, unknown or other
  modified_base (236)..(236): a, c, t, g, unknown or other
  modified_base (252)..(252): a, c, t, g, unknown or other
  modified_base (316)..(316): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtcgtccccaggacagacggccagaatcacctgctctgganatgcactgaccaaatcaatntgtcttttggatcaanagagccaggccacgcccctgtcttaatgatatataaagacagtgagaggccctacgaggatctntgagcgtattctctcgcctcagctcgagggacaactattcaactattcgaacctatacgagttacggaaacgtcccgaggaccaaggaaagagtcggaaggtccttagaactttagttacttagtacaatacaaacgtagaacgtaaggtagtagggtaaaacttagtggttagggttagttcgggggaacggtaacggaaccgaaacgtcggaaccgtaaccgtacggtaccgacggacccaacgggtccctccggtcccccg

SEQ ID NO: 428166 - DNA, 631 bp, Homo sapiens
  misc_feature: GZ8MTXP02HO90R.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctggtgtcagtgtccccaggacagacggccagaatcacctgctctggagatgcactgaccaaatcaatatgtctttttggtatcaacagaggccaggccacgccctgtctaatgatatataaagacagtgagacggcctacgagggatctactgagcgtacttctctcgcctcacgctcgacgggacaaactattacactatttacgacctatacaagtagtaacgtacccgaggacgaaaggaaagaagtaggacgggtaccgttaggtaactttaagtttatttacgtaactaaaattaccaaaagtaacgaacgtaaggttaaggtaagggtaaaataggttacgtagggtttacgttaccggggacggggtaaacgggaaaccgtaaaacgtacggaacccggttaaccgtacgggttaaccgacggacccggaacggtaccgtttaccggtacccccccgg

SEQ ID NO: 428167 - DNA, 506 bp, Homo sapiens
  misc_feature: GZ8MTXP02JSW20.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtgtccccaggacagacggccagaatcacctgctctggagatgcactgccaaatcaatatgtctttttggtatcaacagaggccaggccacgcccctgtcttaatgatatataaagacagtgagaggccctgagggatctctgagcgattctctgcctccagctcagggacaacattcacattcgaccatcagtgaagtccaggcagaagatgaggctgacttattattgtacaatacaaacagacagtagtagggaaatgtgtagtagtcgggacggagggaccaaacgtgaccgtcgtaggtacacggacccacggcctcgtcccccg

SEQ ID NO: 428168 - DNA, 542 bp, Homo sapiens
  misc_feature: GZ8MTXP02FWAPB.22.6.A06.1.454.CMB.2.raw
  modified_base (217)..(217): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtcgtccccaggacagacggccagaatcacctgctctgganatgcactgaccaaatcaaatatgtctttttggtatcaacagaggccaggccacgcccctgtctaatgatatataaagacagtgagacggcctcgagggatctctgagcgattctctgcctcagctcgagggacaacattcactattcgaccatcagtagaagtccaggcaagaagatagaggctagaacttaatttattgtacaaatcaaacagaacaagtaggtagggtaaaatagtggtaggttacgttcggggacggaaacgggaccaaaacgtcggaacccgtaacgtacggtacacgacccgaaaggcctaccgcccccg

SEQ ID NO: 428169 - DNA, 535 bp, Homo sapiens
  misc_feature: GZ8MTXP02FUBDD.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgaccaaatcaatatgtcttttgtatcaacagaggccagccacgcccctgtcttaatgatatataaagacagtgagaggccctcgagggatctctgagcgattctctgtcctccagctcgagggacaaacacttcaacgtattcgaaccctatcgagtagaacgtcgaaggcaagaagatagagctagtaacttattattgtacaatcaaacagacgtagtagtaaggaaatagtcggtaggtagttcgggacggtacgggaacctaaacgtcgaaccgtcgtacggtacacgaccgaaggccgtccgcccccg

SEQ ID NO: 428170 - DNA, 667 bp, Homo sapiens
  misc_feature: GZ8MTXP02JZW6B.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtcgtccccaggacagacggccagaatcacctgctctggagatgcactgaccaaatcaatatgtctttttggtatcagcagaggccaggccacgcccctgtcttaatgatatataaagacagtgagaggccctcgagggatctcgtgagccgtattctctcgcctccagctacgagggaccaactattacactattacgaccatccaagtacgaaacgtccgaaggtacaaaggaaagagttaggacgggtacttaggaactttaagtttatttacggttaactaaaacttaccgaaaacgaagtaaaccgtaaggttaaaggttaaggggtaaaaatttacggttagggtttaggggtaaaggttttacccgggggtaacggggaaaccggggtaaaacccgtaaaaccggttcgggtaaaccccggttaccggttaacgggttaccgtaaaccggaccccgttaaaacgggcccgtttaacccccgggg

SEQ ID NO: 428171 - DNA, 498 bp, Homo sapiens
  misc_feature: GZ8MTXP02JCN1K.22.6.A06.1.454.CMB.2.raw
  modified_base (307)..(307): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgtctttttggtatcaacagaggccaggccacgcccctgtcttaatgatatataaagacagtgagaggccctnagggatctctgagcgattctctgcctcagctcaggggacaacattcacattgaccatcagtgaacgtcaggcagaagatgaggctgactattatgtcaatcaacagacagtaggaggtaaatatggtcggtatcggggaggacgggaccaaacgtgaccgtcgtaggctagacccaaggctacgtcccccg

SEQ ID NO: 428172 - DNA, 600 bp, Homo sapiens
  misc_feature: GZ8MTXP02HO28Y.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgaccaaatcaattatgtctttttggatcaacagaggccaggccacgccctgtctaatgatataataagacagtgagacggcctgaggatctcgtgagcgtacttctctgcctcagctcgaaggacaactattacactattcgaacctatacagtacgaacgtcccgaaggacaagaagactaggaggtactgtaattaagttttatagtaacaattacaaacaagaacgtaaggtaggtaagggtaaaatagttacggtagggttaacgttacggggacgggaaacgggtaaacccgtaaaacgtacggtaaccccggttaacgttaaccgggtacgaaccggacccggaaaacggtcccgttaacccgtccccccgg

SEQ ID NO: 428173 - DNA, 559 bp, Homo sapiens
  misc_feature: GZ8MTXP02JIUKS.22.6.A06.1.454.CMB.2.raw
  modified_base (345)..(345): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctggtgtcagtcgtccccaggacagacggccaagaactcacctgctcgtggagatgcactgaccaaatcaatatgtcttttggatcaacagaggccaggccaccgcccctgtacttaatgatataataaagacagtagagacggccctagaggtactctcgtgacgcgtacttctcgtcnccctcacgctcgaagggactaactattaccaatagttacgacctactcgaagtagaacgtcccgaagacgaaagaagagtagaggctagtaacttattagttacgtacaaatacaaacagaactaaggtagtaagaaatacgtggtagtagtcggacggacggtacctaaacgtcgacgtcgtaggtacacggacccacggtccgcgtcccccg

SEQ ID NO: 428174 - DNA, 512 bp, Homo sapiens
  misc_feature: GZ8MTXP02JZMJR.22.6.A06.1.454.CMB.2.raw
  modified_base (306)..(306): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgaccaaatcaatatgctttttggtatcaacagagccaggccacgcccctgtcttaatgatatataaagacagtgagaggccctnagggatctctgagcgattctctgcctcagctcgagggacaacattcactattgaccatcagtagaagtccaggcagaagatgaggctagactagttattgtacaatacaactagaacagtagtaggaaaatagtggtaggttaattcgggcggacggggaccaaacgtcgaaccgttcgaggtacacgcccaaggcctcgcccccg

SEQ ID NO: 428175 - DNA, 519 bp, Homo sapiens
  misc_feature: GZ8MTXP02H17XE.22.6.A06.1.454.CMB.2.raw
  modified_base (211)..(211): a, c, t, g, unknown or other
  modified_base (391)..(391): a, c, t, g, unknown or other
  modified_base (417)..(417): a, c, t, g, unknown or other
tcagacatacgcgtcacgaccggtgctcgatttagatctactgacagggggtgggtccaggaggcagaactctgggtgtctcaccatggcctggatccctctacttctcccctcctcactctctgcacagactctgaggccgcctatgagctgacacagccaccctcggtgtcagtcgtcccaggacagacggcagatcactgctctgganatgcactgaccaaatcaatatgtctttttggatcaacagaggcaggccacgccctgtacttaatgatatataaagacagtgagaggccctgagggatctctgagcgtattctctcgcctcagctcgagggacaactattacacattcgaccatcagtgaagtccaggcagaagatgaagntagacttattattgataatcaaacanacgaagtagtaggaaaatgtacgtggtattcggacggaacgggtaccaaaacgtcgaccgtaaccgtaggtaccacggacccaaggtccgtacgtacccccg

SEQ ID NO: 428176 - DNA, 627 bp, Homo sapiens
  misc_feature: GZ8MTXP02IC2O1.22.6.A06.1.454.CMB.2.raw
  modified_base (209)..(209): a, c, t, g, unknown or other
  modified_base (256)..(256): a, c, t, g, unknown or other
  modified_base (303)..(303): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggcagaatcacctgctntggagatgcactgaccaaaatcaaatatgtcttttttggatcaaacngaggccaaggccaacgcccctgtcttaaatgataataataaaagaanagagagacggccgtcgaggatctctgagacgtacttctctcgcctccacgctcgaacgggaacaaactaattactactaattacgtaactaactactaagtagaaacgtaaccgaacggacgaaggaaaagaaagtagaggtacgtagtaacttaaatttaatttagttactaaactaacaaaacgaaacgaaacgaaagtaaggtaagggtaaaagttaaagttaggttagggttaggttacgggtacggggaacggggaaaccgaaaacgtaacgaaccgtaaccgtacggtacgacgaccgaacggacgtaccgtcccccg

SEQ ID NO: 428177 - DNA, 581 bp, Homo sapiens
  misc_feature: GZ8MTXP02HDBE5.22.6.A06.1.454.CMB.2.raw
  modified_base (237)..(237): a, c, t, g, unknown or other
  modified_base (314)..(314): a, c, t, g, unknown or other
  modified_base (343)..(343): a, c, t, g, unknown or other
  modified_base (463)..(463): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtcgtccccaggacagacggccagaatcacctgctctggagatgcactgaccaaatcaatntgtctttttggatcaacagagccaggccacgcccctgtcttaatgatatataaagacagtgagacggccctgagggntcgtctgagtcgtacttctctcgcctccngctcgacggggaacaaactattccaactattacgaaccctatacgaaggtagtaaacgtccgaggacaaggaaagagtggacgtcgtagtaaccttaattttatagtactaataccaaanaacgtaagaaggtaggtaaggtaaatagttcggaggtttaagtcggggacgggaacgggaacctaaacgtcggaaccgtcggtacgtacgacgacccgaaggccgtaccgtcccccgg

SEQ ID NO: 428178 - DNA, 574 bp, Homo sapiens
  misc_feature: GZ8MTXP02GV2I2.22.6.A06.1.454.CMB.2.raw
  modified_base (276)..(276): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctggtgtcagtcgtccccaggacagacggccagaatcacctgctctggagatgcactgaccaaatcaattatgtcttttggtatcaacagagcaggccacgccctgtctangatatataaagcagtgagacggccctgaggatctcgtgagcgtacttctctcgcctcagctcgaggacaactattcactattacgaccatacagtagaacgtccgagcaagaacgtagtaggaggtactagtaacttagtttaattgtactaaacttacaaaacgtagtaacgtaagttaagggtaaagggtaaaattaggttaggtagggtttagtacggggacggtaaacgggacctaaaacgtcggtaaccgtaacgtacgacgtacgaccgtaacggtccgtaccgtcccccgg

SEQ ID NO: 428179 - DNA, 574 bp, Homo sapiens
  misc_feature: GZ8MTXP02HUQ13.22.6.A06.1.454.CMB.2.raw
  modified_base (284)..(284): a, c, t, g, unknown or other
  modified_base (316)..(316): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtcgtccccaggacagacggccagaatcacctgctctggagatgcatgaccaaatcaattatcgttctttttggtatcaacaggacgccaggccaccgccctgtactangatataataaagcagtagagacgcctagaggntctctagagcgtacttctctcgaccctcacgctcgaaggacaatcttacactattcgacctatacagttacgaatcccgaaggcaaaggaatagaggacggtacttaggtaaactttaagtttattacgtaactaaacgtacaaaacgtagaacgtaaggttaaggtaaggtaaaattagttggtaacggttagtaccgggaggtaacgaccaaacgtcgacgtaacgtcggacacgacgaacgccgtaccgtccccg

SEQ ID NO: 428180 - DNA, 636 bp, Homo sapiens
  misc_feature: GZ8MTXP02FYLU9.22.6.A06.1.454.CMB.2.raw
  modified_base (252)..(252): a, c, t, g, unknown or other
  modified_base (282)..(282): a, c, t, g, unknown or other
  modified_base (308)..(308): a, c, t, g, unknown or other
tcagacatacgcgtcacgaccggtgctcgatttagatctactgacaggggtgggtccaggaggcagaactctgggtggtctcaccatggcctggatccctctacttctccccctccctcactctctgcacagactctgaggccgcctatgagctgacacagccaccctcggtgtcagtgtccccaggacagacggccagaatcacctgctctggagatgcactgccaaatcaatatgtcttttggtatcaanagagccagccacgcccctgtctaatgatanataaagacagtgagaggcctcgaggngtctctgagcgattctctgcctccgacgctaccgaggacgaaactacttacagtacttgaaccaacttcaacgagtaaggtacccgaggacgaaggtaaagaagtaggacgggacgttacggtaactttaaagttttactttaggttacaaaagttaaccgtaaacgaaacgttaagaacgttaaggtaagggggtaaaagttaaagtaggtttgggttaaggtttaacggtaccgggggacgggtaaaccggaaaccgttaacgtaaccccggccgtttaaacggggtaccctacggtaccccacggtacccggcttaaccccccgg

SEQ ID NO: 428181 - DNA, 601 bp, Homo sapiens
  misc_feature: GZ8MTXP02F4W27.22.6.A06.1.454.CMB.2.raw
  modified_base (173)..(173): a, c, t, g, unknown or other
  modified_base (216)..(216): a, c, t, g, unknown or other
  modified_base (253)..(253): a, c, t, g, unknown or other
  modified_base (278)..(279): a, c, t, g, unknown or other
  modified_base (283)..(283): a, c, t, g, unknown or other
  modified_base (315)..(315): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtntcagtcgtccccaggacagacggcagaatcacctgctctgganatgcactgaccaaatcaatatgttcttttggatcaanagaggcaggccacgccctgtctaannatanataaagacagtagagacggccctgaggatctngagcgtattcctctcgtcctcagctacggagggaacaaaactcttacaactagttacaaaccctatccgaaggttacgaacgtacccgaaggacaaaggaaacgtagtaggaggtactagtaactttaatttatagtaaacaagtaacccaaagagtaacgtaaggtaggtaaaggtaaaattgttagggttagggtttagttccggggacgggtaaacgggaaacctaacggtcggtaaccgtaacggttacgacggaacgccgtaacgcctacccgtcccccgg

SEQ ID NO: 428182 - DNA, 646 bp, Homo sapiens
  misc_feature: GZ8MTXP02HNKV9.22.6.A06.1.454.CMB.2.raw
  modified_base (428)..(428): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctggtgtcagtcgtccccaggacagacggccagaatcacctgctctggagatgcactgaccaaatcaattatgttctttttaggatacaacagacggccaggcccaccgccccttgtacttaatgaatataataaagacagtagagacgcctagaggtatctcgtagagtcgtacttcctctcgtcctcgacgtctcgacgggaacaactacgttacaactattacgacctatccgagtagaacgtccgagtacgaagaagngtagacggtactagtaactttaatttagttacgtaactaaatacgaaaacgtagaaacgtaggttaaggtaagggtaaaagttcgttacgggttaggttacggttaccgggggaacgggtaaacggtaaaccgtaaacggttaccggaacccggttaaccggtttacggaccgtaaccgggaaccccgtaacgggtcccgttacccggtaccccccgg

SEQ ID NO: 428183 - DNA, 584 bp, Homo sapiens
  misc_feature: GZ8MTXP02H8YFW.22.6.A06.1.454.CMB.2.raw
  modified_base (215)..(215): a, c, t, g, unknown or other
  modified_base (252)..(252): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctgganatgcatgaccaaatcaatatgtctttttggatcaacngaggccaggccacgcccctgtctaatgataataataaagacagtagagacggccctagagggatctctagagcgtactctctcgcctcacgctcgaacgggaacaaactattaccaacgtaatttacgaaccctataccgtaagttagaaacgtcccgaaggacaaaggaaagagtaggaaggctaggtaacttatttagttgtacaaatacaaactagaactaggtaagtaggtaaaatagttaggtaggttagtcggacgggaacggaaccgtaaacgtcgaaccgtaacgtacggacacggaacccgtaacggccgttacccgcccccg

SEQ ID NO: 428184 - DNA, 586 bp, Homo sapiens
  misc_feature: GZ8MTXP02IVOCV.22.6.A06.1.454.CMB.2.raw
  modified_base (321)..(321): a, c, t, g, unknown or other
  modified_base (353)..(353): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctggtgtcagtcgtccccaggacagacggccagaatcacctgctctggagatgcactgaccaaatcaatatgttctttttggtatcaacagaggccaggccaccgccctgtcttaatgatatataaagacagtagagaggccctgagggatctcgngagcgattctctcgcctcagctcgaggacaanactcactattacgaccattacgagtacgaacgtccgaggacaagaagataggagtctagtacttatttagttacgactaaagtacaaacagtaacgtaagtaaggtaaggaaaattgtacggttaggttaacggttacgggaaccgggggaaacggtaacccgtaaaacgtacggtaacccgttcgttaacggacgaaccggacccgaaacggtcccgtaccggtacccccgg

SEQ ID NO: 428185 - DNA, 547 bp, Homo sapiens
  misc_feature: GZ8MTXP02HNRT6.22.6.A06.1.454.CMB.2.raw
  modified_base (276)..(276): a, c, t, g, unknown or other
  modified_base (303)..(303): a, c, t, g, unknown or other
  modified_base (335)..(335): a, c, t, g, unknown or other
  modified_base (348)..(348): a, c, t, g, unknown or other
  modified_base (364)..(364): a, c, t, g, unknown or other
  modified_base (433)..(433): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctggtgtcagtgtccccaggacagacggccagaatcacctgctctggagatgcactgaccaaatcaatatgtctttttggatcaacagagcaggccacgccctgtcttaangatatataaagacagtagagagcctanagggtatctctgagctagttctctcgcctcanctcgaggacaacnttacacattcgaactnacagtacgaacgtacgagacgaagaaagagtagagtatagtaattatttagtatacaaataacaagaanaagtaaggtaggtaagtaaaagtagtggttaacggttagtaaccggacgggaacgaaccgtaactaacggccgttaacgtacggacgaccgacaccggccgttcccggcccccg

SEQ ID NO: 428186 - DNA, 578 bp, Homo sapiens
  misc_feature: GZ8MTXP02GX5ZA.22.6.A06.1.454.CMB.2.raw
  modified_base (253)..(253): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctggtgtcagtcgtccccaggacagacggccagaatcacctgctctggagatgcactgaccaaatcaaatatgtcttttggatcaanagagcagccacgccctgtactatgataatataaagacagtagaagacggcctacgaggatctgtagacgtcgtacttctcgtcgcctcgacgctcgaacgggacaaactattacaactattacgacctatcgaagtagaaacgtccgaagacaagaaagtagaggagtacgataacttatttaagtgtaaccaagtacaaacagaacgaagttaggaaggtaaatagttggtaaggttagttacgggacggtaaacggaaccgttaacgaccgtaacgtcgaacggttacgaaccgaccggaacggtcccgtaccgtacccccgg

SEQ ID NO: 428187 - DNA, 683 bp, Homo sapiens
  misc_feature: GZ8MTXP02FOIXN.22.6.A06.1.454.CMB.2.raw
  modified_base (143)..(143): a, c, t, g, unknown or other
  modified_base (282)..(282): a, c, t, g, unknown or other
  modified_base (289)..(289): a, c, t, g, unknown or other
  modified_base (294)..(294): a, c, t, g, unknown or other
  modified_base (317)..(317): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccncctatgagctgacacagccaccctcggtgtcagtgtccccaggacagacggccagaatcacctgctcgtggagatgcactgaccaaatcaatatgttcttttggtatcaacagagccaggtccacgcccctgtactaangatatanaaganagtgagacggcctagaggatctntgagcgtacttctactcgcctacagctcgagggacaaatattcaactattacgacccatacgagtacgaaacgtaccgacggaccaaaggaagaataggaacggtacgttaacgggtaaacttaaggtttttaaacctttagggtaacccttaaaaacgtaaaccgtaaacgtaaacggtaacggtaaagggttaagggtaaaaggggttaaaacgttaaggtttaaggggttaacgggttacgggttaacggggtaaacgggggtaaaccggtaaacccggtaaaccggtaccggttaaccggtaaccgtaacgggtaaccgaaccggtacccggtaacggtaccccggtacccggttcccccgg

SEQ ID NO: 428188 - DNA, 591 bp, Homo sapiens
  misc_feature: GZ8MTXP02FPQZC.22.6.A06.1.454.CMB.2.raw
  modified_base (217)..(217): a, c, t, g, unknown or other
  modified_base (255)..(255): a, c, t, g, unknown or other
  modified_base (282)..(282): a, c, t, g, unknown or other
  modified_base (424)..(424): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtcgtccccaggacagacggccagaatcacctgctctgganatgcactgaccaaatcaatatgttcttttaggatcaanagacgcaggccacgccctgtacttaangatataataaagacagtgagacggcccctagagggtatctcgtggaagtcgtactttccgtctcgtcccctcacgtctcgaacgggaactaaactacttacaactattacgaacctatacgagtagaacgtcagcaaggaangtagaggtatagtaaactttagttatgtaactaaactacaaaacgagtaagtaaggtaaggtaaggtaaaattcggtaggttaggttacggtacgggaggggaaacgaacctaaacgtcggaacccgtccgtaagtacgaccggacgaacggtcctaccggtccccg

SEQ ID NO: 428189 - DNA, 592 bp, Homo sapiens
  misc_feature: GZ8MTXP02I4W1A.22.6.A06.1.454.CMB.2.raw
  modified_base (252)..(252): a, c, t, g, unknown or other
  modified_base (275)..(275): a, c, t, g, unknown or other
  modified_base (280)..(280): a, c, t, g, unknown or other
  modified_base (315)..(315): a, c, t, g, unknown or other
  modified_base (412)..(412): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgaccaaatcaattatgtcttttggatcaangagcaggccacgccctgtctaangatanataaagacagtgagaggccctgagggatcgtctgngtcgattctctcgaccttcacgtctcgacgggaacaaactacttacaactattacgaacccattaccagttagaaacgtaccgaggcaaagggaaanagtaggaacgtagtagtaaacttatttattacgtaacaaagtaccaagtacgaacgtaaggttaggtaaggtaaagttaggtggttacgggttacgtacggggtaacggaacggtaaccgtaaacgtacgacccggtaacgtacggtaccgacgacccgacggtcccgtaccgtaccccg

SEQ ID NO: 428190 - DNA, 598 bp, Homo sapiens
  misc_feature: GZ8MTXP02JDQFW.22.6.A06.1.454.CMB.2.raw
  modified_base (251)..(251): a, c, t, g, unknown or other
  modified_base (281)..(281): a, c, t, g, unknown or other
  modified_base (312)..(312): a, c, t, g, unknown or other
  modified_base (360)..(360): a, c, t, g, unknown or other
  modified_base (366)..(366): a, c, t, g, unknown or other
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccacctcggtgtcagtgtccccaggacagacggccagaatcacctgctctggagatgcactgaccaaatcaatatgtcttttggatcaacngagcacggccacgccctgtacttatgatanataaagacagtgagacggcctcgaggatcgntgagtcgattctctgcctcagctgacgggaacactacttcacgtattnaacctntacgaagtaggtaacgcccgaaggacaaaggaagtaagtaggcggtaacgtagtaacttagtttaattacggtactaaataccgaaaacgaacggtaacgtaaggttaacggtaaagggtaaaagtaggttagggtaggttacggtacggggaacgggtaaacggaaaccgtaaaccgtcgtaaccgttaacgtacggacgaaccgaccgtaacggtccgtaccgtaccccg

SEQ ID NO: 428191 - DNA, 569 bp, Homo sapiens
  misc_feature: GZ8MTXP02JZKK2.22.6.A06.1.454.CMB.2.raw
tcagacatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagcccaccctcggtgtcagtgtccccaggacagacggccagaatcacctgctctggagatgcactgaccaaatcaatatgtctttttggatcaacagagccaggccacgcccctgtactaatgatatataaagacagtagagaggcccctcgagggtatctctggagcgtacttcctcgtcgcctccacgctcgagggaccaactattacaactagttacgacccattacacggttagaacgtccaagggacaaggtaaagataggagcgtacgtaatagttattgtactaaatacaaacaaggactaaggttaggaggtaaaatagttggtacggtagttcgggaacggtacggaaccgtaaacgtcgaccgtaacgtacggacgacgacccgaagcgtccgtacccccg

SEQ ID NO: 428192 - DNA, 600 bp, Homo sapiens
  misc_feature: GZ8MTXP01CR0MI.44.85.H08.1.454.CMB.2.raw
  modified_base (234)..(234): a, c, t, g, unknown or other
  modified_base (257)..(257): a, c, t, g, unknown or other
  modified_base (265)..(265): a, c, t, g, unknown or other
  modified_base (284)..(284): a, c, t, g, unknown or other
  modified_base (578)..(578): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcgtggtttcgcgttaggctcttttaagaggtgtccagtgtcaggtgcagctggtggagtgtggggaggcgtggtcgagccgtggnggtccgtgagctctcctgtgcgngcgtctgntctactctacgtactatgnatgctacgtcggtccgccgacgccgtccgacggacggacgggtacggtggtaggtgggtcggtaccgtagttagtagtagtagtaagtaagtaagtaaagtaaagtaaataactaagtagacgacgtacgtacgtacggaacggtacgtacgtactactactactacacgaacgaactaactaacgaaacgaaacgaacgtactacgtactacgtacgaacgaaactaacgtaacgacgacgtacgaacgaacggacggaacggacgacggtacgttgttgttagtaagtgtgngagttacgtaagttaagttaag

SEQ ID NO: 428193 - DNA, 524 bp, Homo sapiens
  misc_feature: GZ8MTXP01E2ASZ.44.85.H08.1.454.CMB.2.raw
  modified_base (301)..(301): a, c, t, g, unknown or other
  modified_base (346)..(346): a, c, t, g, unknown or other
  modified_base (402)..(402): a, c, t, g, unknown or other
  modified_base (407)..(407): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcgtctggattcaccttcagtacctatggcatgcacgtgggtccnccaggctccgagggcaagggggctgggagtggggtggccacttanagtggtatgatggaaagtaaataaatactatgcagactcgtgagggcatcacatcncaganacatacaaggacacgctgtatctgacaaatgaacagcctggaagacggacccggaaggaccgaacgggcttgttggttaacttaacgtggtggcggagggactaattaagtttaagg

SEQ ID NO: 428194 - DNA, 579 bp, Homo sapiens
  misc_feature: GZ8MTXP01DPKPM.44.85.H08.1.454.CMB.2.raw
  modified_base (234)..(234): a, c, t, g, unknown or other
  modified_base (258)..(258): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcgtggtttcgcgttaggctctttaagaggtgtccagtgtcaggtgcagctggtggagtgtggggaggcgtggtcgagccgtgggnggtccctgagactctcctgtgcgngcgtctgatctacctctagtactatgcatgcgacgtcggtccgccgacgcgtccgacggacggacgggcgtggtaggtggggtcggtaccgtacgttagtagtaggtagtaagtagtaaggtaaagtaaataaataactagtagacgacgtacgtacgtaggacggacgtactactactactactacgacgacgaacaactaacaacgaacgacgtactacgtactacgtacgaacaaatagtaacgacgacgagaagacggacggacggacgacggtcgttgttgttagttaagtgtcgacgagacgtaagttaagtaag

SEQ ID NO: 428195 - DNA, 523 bp, Homo sapiens
  misc_feature: GZ8MTXP01ETIGW.44.85.H08.1.454.CMB.2.raw
  modified_base (270)..(270): a, c, t, g, unknown or other
  modified_base (297)..(297): a, c, t, g, unknown or other
  modified_base (338)..(338): a, c, t, g, unknown or other
  modified_base (472)..(472): a, c, t, g, unknown or other
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcgtctggattcaccttnagtacctatggcatgcactgggtcccnccaggctccgaggcaagggggctgggagtgggtgcacttanagtggtatgatggaagtaaaataaatctatgacagactcgtgaaggccatcacatctcagagacaactacaagaacacgctaggtactctagacaaatcgaaacagcctagagacgccgaaggaacacgggttntgttgtattcgttgcgacgaagataagtatagttactaaccgttaacgtcg

SEQ ID NO: 428196 - DNA, 546 bp, Homo sapiens
  misc_feature: GZ8MTXP01DRZNL.44.85.H08.1.454.CMB.2.raw
  modified_base (275)..(275): a, c, t, g, unknown or other
  modified_base (305)..(305): a, c, t, g, unknown or other
  modified_base (429)..(429): a, c, t, g, unknown or other
  modified_base (511)..(511): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctcctgtgcagcgtctggattcaccttnagtacctatggcatgccacgtggggtcccnccgaggcctccgagggcgaagggggctgggaggtggggtgccattatagtgggtataggaattggaaagttaaactaaatactagtgacagactcgtaggaacggccgattcacatctccaganacaatacccaaggaacacgctagtactctgacaaaatgaaacagcctaggaagacggacgacgggacacgggtcttaggttnttattcgtagtgacgaggactaagttaagtttaag

SEQ ID NO: 428197 - DNA, 592 bp, Homo sapiens
  misc_feature: GZ8MTXP01D0T7L.44.85.H08.1.454.CMB.2.raw
  modified_base (276)..(276): a, c, t, g, unknown or other
  modified_base (281)..(281): a, c, t, g, unknown or other
  modified_base (307)..(307): a, c, t, g, unknown or other
  modified_base (312)..(312): a, c, t, g, unknown or other
tcagacagtatatacacgaccggtgctcgatttagtatcactcagtcgcggggggagaggagcccagcactagaagtcggcggtgtttccattcggtgatcagcactgaacacagaggactcaccatggagtttgggctgagcgtggttttcgcgttagctctttaagaggtgtccagtgtcaggtgcagctggtggagtcgtgggggagcgtggtccagcctgggaggtccctgagctctcctgtgcagcgtctggatcactcagtacctatggnatgcncgtcggccgcgcgcgcgagacgaggngtggnggtggtgctactatagtgtagtagagtagtaagtaaaataaataatatagacgacgtacgtacgtacggaacggtacgtactacactactactacgaacgaacgaactaactaaccgaaacgaacgaacgtacgtacgtactacgtacgaacgaaactaacgaacgacgacgtacgtacgacggacggacggaacgacgttcgtacgttagttacgttacgttagttcggacggaaggtaagtaagttagttacgttacgttaaccgttaaccgtaaccg

SEQ ID NO: 428198 - DNA, 552 bp, Homo sapiens
  misc_feature: GZ8MTXP01CHLGI.44.85.H08.1.454.CMB.2.raw
  modified_base (300)..(300): a, c, t, g, unknown or other
  modified_base (339)..(339): a, c, t, g, unknown or other
  modified_base (459)..(459): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcacttcagtacctatggcatgcactgggtccncaggctccagggcaagggggctggagtggtgccacttanagtggtatgaatggaaagtaaactaaatactatgacagactccgtagaacgggccgattcacatctaccagagaacaattacccaaaggaacacgctagtactctgacaaaatcgaaacncgcctggaacgacgcccggaagggaccgaacgggtcttagggttgttaacgttaacgtaggttggaccggagggaactaagttaagtttaagg

SEQ ID NO: 428199 - DNA, 539 bp, Homo sapiens
  misc_feature: GZ8MTXP01EMOZ6.44.85.H08.1.454.CMB.2.raw
  modified_base (305)..(305): a, c, t, g, unknown or other
  modified_base (347)..(347): a, c, t, g, unknown or other
  modified_base (374)..(374): a, c, t, g, unknown or other
  modified_base (387)..(387): a, c, t, g, unknown or other
  modified_base (406)..(406): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcgtctggattcaccttcagtacctatggcatgcacgtggggtcccnccaggcctccgaggcgaagggggctggagtgggtgccattanagtggtatgaatggaaataaataaatntatgcagactcgngaggcatcacatcacaganacaataccaaggacacgctagtatctgactaaagtgaaactacgcctggaacgacggcccggaaggaccgaacgggtcttaggttggttaattaaccgtggtcgacggagggttactaagtttaacgtttaag

SEQ ID NO: 428200 - DNA, 681 bp, Homo sapiens
  misc_feature: GZ8MTXP01AEI3F.44.85.H08.1.454.CMB.2.raw
  modified_base (259)..(259): a, c, t, g, unknown or other
  modified_base (272)..(272): a, c, t, g, unknown or other
  modified_base (300)..(300): a, c, t, g, unknown or other
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagacctctcctgtgcagcgtntggattcaccttnagtacctatggcatgccactcgggtccnccgaggcctccgaggcgaagggggctgggagtggggtgctacgttatagtcggtatgaagtagggaaagttaaaaattaaactaacgtatacgctaacggtaccgttcccgggtaagggaaacgggtacccgtaatttaccaacccgtagttaccctacccgaagaacgaacctaaacgttaacccgaaagaaacctacggtaccttaggtaactacgtagaacctaaatacgaacagtaccctggaacggacgaacccggaggaacccgtaacgggttccgtttacgggttagtttaaacgtttaaccgttggttcgggaccgtaagggtaacctaagtttaagttacggttaacgtttaacccttaacccgtaacccgg

SEQ ID NO: 428201 - DNA, 525 bp, Homo sapiens
  misc_feature: GZ8MTXP01APE8K.44.85.H08.1.454.CMB.2.raw
  modified_base (304)..(304): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcgtctggattcaccttcagtaccctatggcatgcacgtggggtcccnccaggcctccgagggcaagggggctgggagtggggtggccacttatagtggtatggatggaaagtaaataaatactatgcagactccgtagaagggccgattcacatctccagagacaattaccaaggaacacgctgtatctgacaaatcgaacagcctgaagacgccggaggaccgacgggcttgttgttataacgtgtggcgaggactaagttgttaag

SEQ ID NO: 428202 - DNA, 630 bp, Homo sapiens
  misc_feature: GZ8MTXP01EQ0FS.44.85.H08.1.454.CMB.2.raw
  modified_base (269)..(269): a, c, t, g, unknown or other
  modified_base (297)..(297): a, c, t, g, unknown or other
  modified_base (338)..(338): a, c, t, g, unknown or other
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttnagtacctatggcatgcacgtgggtcccncaggctccgaggcaagggggctgggagtgggtgctacttanatggtatgatggaaagtaaaataaatctatgacagactccggtagaacgggtccgaattccaccatcctaccgaagtacgaactaaacgttacccgaaagaaccaacgtccgttaggggtaacttacgttacggaacctaaaagttcgaaacacggtacccgtagggaacggacggacccgggaagggaaccgaccggggttacttacgggttacgttaagtttaaccgttgggttcggaccggaaggaactaagttagtttacggttacgttaacccttaacccgtaaccg

SEQ ID NO: 428203 - DNA, 527 bp, Homo sapiens
  misc_feature: GZ8MTXP01DRGX2.44.85.H08.1.454.CMB.2.raw
  modified_base (303)..(303): a, c, t, g, unknown or other
  modified_base (403)..(403): a, c, t, g, unknown or other
  modified_base (408)..(408): a, c, t, g, unknown or other
  modified_base (429)..(429): a, c, t, g, unknown or other
  modified_base (445)..(445): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttcagtacctatggcatgcacgtgggtcccncgaggctcgaggcgaaggggctgggagtgggtgcacgttatagtggtatgatggaaataataaatctatgacagtactccgtgaaggcgtattcacatcncaganacatacaaggacacgctgtanctagacaaatgaaacngacctggaagacgaccggaggttaccgacggcttgttgttacgttaacgtggtcgcggtacgggataagttaagtttaacgg

SEQ ID NO: 428204 - DNA, 586 bp, Homo sapiens
  misc_feature: GZ8MTXP01BJ0IL.44.85.H08.1.454.CMB.2.raw
  modified_base (305)..(305): a, c, t, g, unknown or other
  modified_base (351)..(351): a, c, t, g, unknown or other
  modified_base (416)..(416): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcgtctggattcaccttcagtacctatcggcatgcacgtgggtcccncaggcctccgaggcaagggggctgggagtggggtggcctacgttanagtgggtatggatgggaaataaactaaatctagtgacagactccgtagaacgggcgattcaaccntctccagacgacaacttaccaaggaacacgctagtatccgtagaccaaatcgaaacacgtccctaggaaggaaccggccggaaacgggaaccgaccgggtaccgttacggttagttacgtttaacggtggttaacggaccggtaacgggactaacgttaacgtttaacgg

SEQ ID NO: 428205 - DNA, 524 bp, Homo sapiens
  misc_feature: GZ8MTXP01DQ3BV.44.85.H08.1.454.CMB.2.raw
  modified_base (253)..(253): a, c, t, g, unknown or other
  modified_base (302)..(302): a, c, t, g, unknown or other
  modified_base (452)..(452): a, c, t, g, unknown or other
  modified_base (455)..(455): a, c, t, g, unknown or other
  modified_base (458)..(458): a, c, t, g, unknown or other
  modified_base (460)..(460): a, c, t, g, unknown or other
  modified_base (468)..(468): a, c, t, g, unknown or other
  modified_base (502)..(502): a, c, t, g, unknown or other
  modified_base (507)..(507): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtgtccagcctgggagtccctgagactctcctgngcagcgtctggattcaccttcagtacctatggcatgcactggggtcccncgaggcctccgagggcaagggggctgggagtggggtgcacttatagtggtatgatgggaaataaataaatctatgacagactcgaggacgggcctattcaacatctacagacacaattacccaaagggtaaacacgctagtaactcgtanaanaananacacgcgngaagacgacgacgacgacgtcgttgttgttagtntgtgngagataagttaagtaag

SEQ ID NO: 428206 - DNA, 567 bp, Homo sapiens
  misc_feature: GZ8MTXP01AJTPG.44.85.H08.1.454.CMB.2.raw
  modified_base (304)..(304): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggagtccctgagctctcctgtgcagcgtctggattcaccttcagtacctatggcatgcacgtggggtcccncaggcctccgagggcgaagggggctgggagtggggtgcctacttagagtgggtatggatgggaaagttaaataaatctatgacagactcgtaggaacgggccgtattcaccatctaccaagacgaacaacttaccaaaggaacacgtacctagtaactcgtagacaaatacgaaacacgtccgtaggaacgacggaccggaagggaccgaacgggtcttggttgttacttaacgtggtcgacggaggactaagttaagttaag

SEQ ID NO: 428207 - DNA, 554 bp, Homo sapiens
  misc_feature: GZ8MTXP01ECN1N.44.85.H08.1.454.CMB.2.raw
  modified_base (305)..(305): a, c, t, g, unknown or other
  modified_base (351)..(351): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgagactctcctgtgcagcgtctggacttcaccttcagtacctatggcatgcacgtgggtccnccaggcctccgagggcgaagggggctggagtggggtgcctacttanagtgtatgaatgggaaataaataaatctatgcagactcgtagaggcattcacatcctacagacgaactaatccaaggaacacgctagtactcgtgaactaaatcgaacagacccgtaggaacgacggaccggaaacggacgaaccggtgttaggttcgttaaagtttcgtgttcggacggtaggactaagtttaacgtttaag

SEQ ID NO: 428208 - DNA, 511 bp, Homo sapiens
  misc_feature: GZ8MTXP01C0QT1.44.85.H08.1.454.CMB.2.raw
  modified_base (160)..(160): a, c, t, g, unknown or other
  modified_base (303)..(303): a, c, t, g, unknown or other
  modified_base (346)..(346): a, c, t, g, unknown or other
  modified_base (355)..(355): a, c, t, g, unknown or other
  modified_base (378)..(378): a, c, t, g, unknown or other
  modified_base (408)..(408): a, c, t, g, unknown or other
  modified_base (441)..(441): a, c, t, g, unknown or other
  modified_base (443)..(443): a, c, t, g, unknown or other
  modified_base (446)..(446): a, c, t, g, unknown or other
  modified_base (448)..(448): a, c, t, g, unknown or other
  modified_base (450)..(450): a, c, t, g, unknown or other
  modified_base (452)..(452): a, c, t, g, unknown or other
  modified_base (454)..(454): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcgtggtttccncgttagctctttaagaggtgtccagtgtcaggtgcagctggtggagtcgtgggggagcgtggtccagccgtggggagtccctgagctctcctgtgcagcgtctggacttcaccttcagtacctatggcatgcactggggcccncaggcctcgaggcgaagggggctgggagtgggtggcctattanagtgggtangaatggaaataataaatactagngacagactcgtagaagggccattcacatcncagacacaatccaagggaacagtctgatcgtananaanananancngaagacgacgacgacgacgtgttgttgttacgtgtgtgagagagtaagttaagtaag

SEQ ID NO: 428209 - DNA, 535 bp, Homo sapiens
  misc_feature: GZ8MTXP01EGLJ4.44.85.H08.1.454.CMB.2.raw
  modified_base (410)..(410): a, c, t, g, unknown or other
  modified_base (413)..(413): a, c, t, g, unknown or other
  modified_base (435)..(435): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttcagtacctatggcatgccacgtcggggtcccgccaggcctccgagggcgaagggggctgggagtggggtgacctacttatgtggtatgaatgggaaataaataaatctatgacagactcgtagaacgggcatcacntcncagacacaatccaaggacacgntcgtatctgacaaaatgaacagcctggaagacgaccgaggaccgacgggtcttagttgttacttaacgtagtcggacgaaggactaagtttaagttaacg

SEQ ID NO: 428210 - DNA, 544 bp, Homo sapiens
  misc_feature: GZ8MTXP01AY9VE.44.85.H08.1.454.CMB.2.raw
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccgtggggagtccctgagctctcctgtgcagcgtctggattcacttcagtacctatggcatgcacgtgggtccgccagggctccgagggcgaagggggctgggagtggggtgcacttatagtggtatgatggaaagtaaataaatactatgacagactccgtagagggcgattcgacctatctccagacgacaattaccaagaacacgctacgtatcctgacaaatcggaaactagacctggaagacggaccggaaggaccgacggtcgttagttgttacttaacgtgtcgcggaggactaagttaagtttaacg

SEQ ID NO: 428211 - DNA, 552 bp, Homo sapiens
  misc_feature: GZ8MTXP01BND07.44.85.H08.1.454.CMB.2.raw
  modified_base (305)..(305): a, c, t, g, unknown or other
  modified_base (351)..(351): a, c, t, g, unknown or other
  modified_base (498)..(498): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagcctgggagtccctgagctctcctgtgcagcgtctggattcaccttcagtacctatggcatgcacgtggggtcccnccgaggcctccgagggcaagggggctgggagtggggtgcccattanagtggtatgaatgggaaataaataaatctatgcagactcgaggaaggccgattcacatctacagacgacaacttaccaaaggaacacgctagtatcctagacaaaatgaaactgacctgaacgacggaccggaggacgaaccgggtnttaggttgttagttaaccgtggtaacgacggagaacgtaagttaagtttaaggg

SEQ ID NO: 428212 - DNA, 523 bp, Homo sapiens
  misc_feature: GZ8MTXP01CGO2X.44.85.H08.1.454.CMB.2.raw
  modified_base (303)..(303): a, c, t, g, unknown or other
  modified_base (363)..(363): a, c, t, g, unknown or other
  modified_base (371)..(371): a, c, t, g, unknown or other
  modified_base (399)..(399): a, c, t, g, unknown or other
  modified_base (405)..(405): a, c, t, g, unknown or other
  modified_base (499)..(499): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggagcgtggtccagcctggggagtccctgagactctcctgtgcagcgtctggattcaccttcagtacctatggcatgcactgggtccncaggctccgaggcaagggggctggagtgggtgccacttgtatggtatgatggaaataaanaaatacangacagactcgtagaggcgattcacatcnccaganacattaccaaggacacgctagtatctgacctaaatcgaaacacgtccgtaggaacgagaccgggaagacgtaacggcttagttgttattaacgngtgcgaggactaagttgtttaacg

SEQ ID NO: 428213 - DNA, 614 bp, Homo sapiens
  misc_feature: GZ8MTXP01ERPI1.44.85.H08.1.454.CMB.2.raw
  modified_base (308)..(308): a, c, t, g, unknown or other
  modified_base (355)..(355): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggttgtccagtgtcaggtgcagctggtggagtcgtgggggagcgtggtccagccgtgggacgtccctgagctctcctgtgcagcgtctggacttcaccttcagtacctatggcatgcacgtgggtcccncaggctccgaggcgaagggggctgggagtggggtgacctacgtttanagtggtatagatgggaaataaataaatactagtgactacgacgtcggtaggaacggggcctaattccaacctatcctaccgaagaacgaactaaacttacccaaagggaacctacggtacctagttaactctagaacctaaaagtcgaaacacgacctggaacgacggacccgggaaagggaccgtaaccgggggttcttaggttacgtttacgttaacgtaggtaacggacggaaggttacttaagtttaagttaacg

SEQ ID NO: 428214 - DNA, 559 bp, Homo sapiens
  misc_feature: GZ8MTXP01D0MXN.44.85.H08.1.454.CMB.2.raw
  modified_base (306)..(306): a, c, t, g, unknown or other
  modified_base (411)..(411): a, c, t, g, unknown or other
  modified_base (414)..(414): a, c, t, g, unknown or other
  modified_base (419)..(419): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggtccagccgtgggagtccctgagctctcctgtgcagcgtctggattcaccttcagtacctatggcatgcacgtgggtcccncaggcctccgagggcgaagggggctgggagtgggtgccattatagtggtatagattgggaaataaactaaatctatgacagactacgtagaacggcgattcactntcncaganacaactaccaagaacacgtactagtactctagacaaatcgaaacacgcctaggaacgaacgccggaaacggacgtaaccgggtcttaggttcgttaacttaacgtggtaacggacggtagttaactaagttaagttaacg

SEQ ID NO: 428215 - DNA, 611 bp, Homo sapiens
  misc_feature: GZ8MTXP01BE8C8.44.85.H08.1.454.CMB.2.raw
  modified_base (280)..(280): a, c, t, g, unknown or other
  modified_base (308)..(308): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggccgtggggagtccctgagactctcctgtgcagcgtctggattcaccttnagtacctatggcatgcacgtgggtcccncgaggcctccgagggcgaagggggctggggaggtggggcgcctacgtttatagtgggtatggaatgggaaagttaaataaatactagtcgacaagtaccgtaccggtaggaacgggccgtattccgaaccctactctaccgaagaacgaactaaacttaccgaaaggaactacgtccttagtactcgtagaactaaatcgaaacacgccgtaggaacggacggacccggaagggaccgaacgggtcttaggttgttacgttaacgtggtaacggacggtaggttactaagtttaacgttaagg

SEQ ID NO: 428216 - DNA, 656 bp, Homo sapiens
  misc_feature: GZ8MTXP01BWV8Q.44.85.H08.1.454.CMB.2.raw
  modified_base (270)..(270): a, c, t, g, unknown or other
  modified_base (295)..(295): a, c, t, g, unknown or other
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagactctcctgtgcagcgtctggattcacttnagtacctatgcatgcacgtgggccncgaggctcgaggcaagggggctgggagtgggtgctacgttatagtcgggtatggaagttagggaaaagttaaaaataaaatcgtatacggactaaggtaccttccggggtagaaaccggggtcccgtattaccgaaccctattccctacccgaaagaacgaacctaaacgttacccgaaacgaaaccgacgtccgttagggtaacttccgtaagaacccgtaaaagtacgaaaccgaggtaccctaggacgaacggcccgggaaaggaaccgaccgggttgtcggttagtaacgtttacttgggttacggaccggtaaggtactaagtttacgtcggttaaacgtcccttaaccgtaaccg

SEQ ID NO: 428217 - DNA, 504 bp, Homo sapiens
  misc_feature: GZ8MTXP01EWK0V.44.85.H08.1.454.CMB.2.raw
  modified_base (347)..(347): a, c, t, g, unknown or other
  modified_base (435)..(435): a, c, t, g, unknown or other
  modified_base (480)..(480): a, c, t, g, unknown or other
  modified_base (486)..(486): a, c, t, g, unknown or other
  modified_base (490)..(490): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgagctctcctgtgcagcgtctggattcaccttcagtacctatggcatgcactggggtcccaggcctccagggcaagggggctggagtggggtgccctactttanagtggtatgaagtggaaagtaaataaatctaatgcagactcgtgaagggcatcacatcacagacacaataccaagaacacgctagtanctgacaaatgaacagcctgaagcgacggagacgacgggcttgttnttattngtgngagatgttgttaag

SEQ ID NO: 428218 - DNA, 752 bp, Homo sapiens
  misc_feature: GZ8MTXP01CAG7C.44.85.H08.1.454.CMB.2.raw
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggaggcgtggtccagccgtgggacgtccctgagactctctgtgcagcgtctggacttccaccttcagtacctagtcggctagtcgacctacgttcgggtccccgacgacggcctacccggagggacggaaaggggggtccttagggggaggttgggggtacggtacctaagtttagtaagttggtaataggtaagtaaaggggtaaaacttaaaaaaattaaaactaactaagttacgaaccgtaacggtaacccgttaccgggtaaagggaaacccggggtaccctaacgtttacccaaccgtacttacccgtaaccgaaacggaaacgtaaactaaaccttaacccgaaaaacgtaacccgaaccggtacctttaagggttaacttacgttaacgaaactaaaacgtacggaaactacggtaccgtagaacggacggaccggaagggaaccgtacggttcgttagttagtttaaacgttcgttggttcggacgtaaggtactaagttaagttgttaacgttaacccttaaccgtaaccg

SEQ ID NO: 428219 - DNA, 584 bp, Homo sapiens
  misc_feature: GZ8MTXP01BPG60.44.85.H08.1.454.CMB.2.raw
  modified_base (248)..(248): a, c, t, g, unknown or other
  modified_base (300)..(300): a, c, t, g, unknown or other
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggtttcctcgttgctcttttaagaggtgtccagtgtcaggtgcagctggtggagtcgtgggggagcgtggtccagccgtgggagtccctgagctctcctgtncagcgtctggattcaccttcagtacctatggcatcgcacgtcggggtccccncaggcctccgagggccgaagggggctagggaggtggggtgactattatagtggtatagaatagggaaataaaactaaatctataggactaagtaccgtccggtagaacgggccctaattaccaacctattaccaccgaaaggacaaactaaacgtacccaaaagaaccaacgtctaggtaactcctagaacaaataagaacacgaccgagagacgacgacggaacgacgcgtgttgtatagttgttgacgaagagtaatattagttacgtaacttaactaaccg

SEQ ID NO: 428220 - DNA, 594 bp, Homo sapiens
  misc_feature: GZ8MTXP01CAOLE.44.85.H08.1.454.CMB.2.raw
  modified_base (259)..(259): a, c, t, g, unknown or other
  modified_base (305)..(305): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggagcgtggtccagccgtgggagtccctgagactctcctgtgcngcgtctggattcaccttcagtacctatggcatgcacgtgggtcccnccgaggcctccgagggcgaagggggctgggaggtggggtgcctacttagtagtggtatgaatgggaaattaaataaatactatcgacagacgtcgtaggaacgggtcgattcaacctatctaccagacgaacaacttaccgaaagaacacgtctacgtactctagaactaaaagtcgaaactacgtaccgtaggaaggacggaccggaacgggttacgaaccgggtcgttaggttgttaactttaaccgtggtaacggacggagggttacctaagttaacgtttaacgg

SEQ ID NO: 428221 - DNA, 614 bp, Homo sapiens
  misc_feature: GZ8MTXP01CDRAB.44.85.H08.1.454.CMB.2.raw
  modified_base (308)..(308): a, c, t, g, unknown or other
  modified_base (358)..(358): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtgggagtccctgagactctcctgtgcagcgtctggattccacctttcagtacctatggcatgcacgtgggcccncaggcctccgagggcgaagggggcttgggaggtggggtcgacctatttanagtggtaatggaattgggaaattaaactaaatctagtgacagtactcgaggaacgggcctattccgaactactctaccaagtacgaacctaacttacccaaagggaacctacggtcttagtactcgtacgaactaaaatcgaaaccgagcctagggaaacggacggacccggaaagggaacccgaccggggttcttaggttacgttaacttaacggtcggtaacggaccggaagttactaagtttaaggtttaacg

SEQ ID NO: 428222 - DNA, 559 bp, Homo sapiens
  misc_feature: GZ8MTXP01DEWFX.44.85.H08.1.454.CMB.2.raw
  modified_base (179)..(179): a, c, t, g, unknown or other
  modified_base (310)..(310): a, c, t, g, unknown or other
  modified_base (357)..(357): a, c, t, g, unknown or other
  modified_base (419)..(419): a, c, t, g, unknown or other
  modified_base (424)..(424): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagnggtgtccagtgtcaggtgcagctggtggagtcgtgggggagcgtggtccagccgtggggacgtccctgacgctctcctgtgcagcgtctggattcaccttcaagtacctatggcatgcacgtggggtcccncaggcctccgagggcgaagggggctgggagtggggtgccacgtttangtggtatgaagtgggaaataaataaatactatgacagactcgtagaagggccattcacatcncaganacaataccaagaacacgctgtactcgtagactaaatcgaaactacgccgtaggaacgacggacccggaggaccgtaacgggtcttaggttgttaacttcgtggtcggcggaggttacctaagttaagtttaacgg

SEQ ID NO: 428223 - DNA, 535 bp, Homo sapiens
  misc_feature: GZ8MTXP01ENH3S.44.85.H08.1.454.CMB.2.raw
  modified_base (276)..(276): a, c, t, g, unknown or other
  modified_base (304)..(304): a, c, t, g, unknown or other
  modified_base (346)..(346): a, c, t, g, unknown or other
  modified_base (396)..(396): a, c, t, g, unknown or other
  modified_base (399)..(399): a, c, t, g, unknown or other
  modified_base (404)..(404): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtggggagtccctgagctctcctgtgcagcgtctggattcaccttnagtacctatggcatgcacgtgggtcccncgaggcctccgagggcaagggggctggagtgggtgccattangtggtatgatggaaataaataaatctatgcagactcgtagaggcatcacntcncaganacaatcaaggacacgctagtactctagacaaagtgaaacacgtccgaggaagacgacccggaaggaccgacggtcgttagttgttacgttaacgtggtcggacggaaggttactaagtttaagtttaacgg

SEQ ID NO: 428224 - DNA, 646 bp, Homo sapiens
  misc_feature: GZ8MTXP01DL3WI.44.85.H08.1.454.CMB.2.raw
  modified_base (159)..(159): a, c, t, g, unknown or other
  modified_base (253)..(253): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcgtggtttcncgttagctctttaagaggtgtccagtgtcaggtgcagctggtggagtcgtgggggagcgtggtccagccgtgggagtccctgagactctcctgngcagcgtctggattcaccttcaacgtacctagtggctagtcgctacgtggggtcccacaggcctccgaaggggccgaagggggtcttaggggagtgggggtcgaccacgtttatagtgggtatgaattgggaaattaaactaaaatctaatcggacaagtactacggtggaacgggcctattaccaactactcctccaagaacgaactaaacgttacccgaaaagggtaaacctacgtacttagtaactcgtaagtaacgtaaactaacgtaaacgaacgaccgtacggaacggaacggaccggaaccggaacggaccggtacgttacggttacgttaacgttaacgttacggtaacggacggtaacggttaacgtaacgttaacgtttaacg

SEQ ID NO: 428225 - DNA, 648 bp, Homo sapiens
  misc_feature: GZ8MTXP01BTKUZ.44.85.H08.1.454.CMB.2.raw
  modified_base (293)..(293): a, c, t, g, unknown or other
  modified_base (314)..(314): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtggggacgtccctgacgtactctcctgtgcagcgtctggacttcaccttcagtacctanggcatcgcacgtcgggtcccncgaggcctacgagggcgaagggggctagggaggtgggtcgacctacgttagtagtggtaataggaattaagggaaattaaataaattctatgacagaccgtcgtaggacgggcctaattccaaccctataccctaccgaagtaaaccgaactaaacttacccgaaacggtaaccaccggtactacggttaactaccgtacgaactaaacgacgaaacgtacgcccgtaaggaaacggacggacccggaaacggaccgtacgggtacgtttacggttagtttacgttaacgtgggttaagaccgggtaaggaaccttaagtttaaccgtttaagg

SEQ ID NO: 428226 - DNA, 551 bp, Homo sapiens
  misc_feature: GZ8MTXP01DSV0D.44.85.H08.1.454.CMB.2.raw
  modified_base (267)..(267): a, c, t, g, unknown or other
  modified_base (435)..(435): a, c, t, g, unknown or other
  modified_base (513)..(513): a, c, t, g, unknown or other
  modified_base (522)..(522): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagcgtggtggagtcgtgggggagcgtggtccagccgtgggacgtccctgagactctcctgtgcagcgtcnggacttcaccttcagtacctatcggcatgcacgtcgggtccgccgaggcctaccgagggccgaagggggctagggaggtggggtggacctacgtttagagttggtatagaagtaagggtaaataaataaatactatggacagactcgtagaacggcatcacatcacanagacaagtaccaaggaacacgctgatctagacaaagtgaaacagccagaacgacgcgacggaccaagggtcttagttnttagttaanggtgaccggtagactaagttaattaacgg

SEQ ID NO: 428227 - DNA, 576 bp, Homo sapiens
  misc_feature: GZ8MTXP01CSFY0.44.85.H08.1.454.CMB.2.raw
  modified_base (304)..(304): a, c, t, g, unknown or other
  modified_base (502)..(502): a, c, t, g, unknown or other
  modified_base (535)..(535): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcgtctggattcaccttcagtacctatggcatgcacgtgggtcccnccgaggctccgagggcgaagggggctggaggtggggtggcctacgtttatagtgggtatggaattgggaaattaaataaattctatgacagactccgtaggaacgggccattccgaacctatcctacccgaagacgaactaacgtttacccgaaaggaactaaccggtctaggttatccgtagaccaaaatgaaaccngtacctaggaaggacgcggaacggacgaccggnttgttgttacttaagtgtaagcgaggactaagttgttaacg

SEQ ID NO: 428228 - DNA, 579 bp, Homo sapiens
  misc_feature: GZ8MTXP01EZ26L.44.85.H08.1.454.CMB.2.raw
  modified_base (305)..(305): a, c, t, g, unknown or other
  modified_base (341)..(341): a, c, t, g, unknown or other
  modified_base (414)..(414): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtctagccgtgggagtccctgagactctcctgtgcagcgtctggattcaccttcagtacctatggcatgcacgtggggtcccncaggcctccgagggcgaagggggctgggagtggggngacctacttagtagtggtatgataagggaaataataaatctagtgacagactcgtagacgggcattcacatcncagacgacaataccaaggactacgctagtactcgtagaactaaagtcgaaacacgtcccgtaggaacgacggaccgggaacggaaccgtacgggtcgttaggttacgttaacgtttaacggtaggttcggaccgggtaggttacctaagtttaacgtttaaccgg

SEQ ID NO: 428229 - DNA, 599 bp, Homo sapiens
  misc_feature: GZ8MTXP01CLZ2Y.44.85.H08.1.454.CMB.2.raw
  modified_base (196)..(196): a, c, t, g, unknown or other
  modified_base (307)..(307): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtncagctggtggagtcgtgggggagcgtggtccaggccgtggggagtccctgagactctcctgtgcagcgtctggattcaccttcagtacctatggcatgcacgtcgggcccnccaggcctaccgagggcgaagggggctgggagtggggtgcctacttagtagtggtataggaagttggaaagttaaataaatactatcgactacgacctcggtaggaacgggccgtaattccaacctacgtcctaccgaagacgaactaacttacccaaaggaacctacggtacttacgtactcgagaacaaagtcgaaacacgaccgtagaacggacgacccggaaggaccgacgggtcttaggttgttaacgttcgtgggtcgacggacggttactaagttaagtttaacg

SEQ ID NO: 428230 - DNA, 590 bp, Homo sapiens
  misc_feature: GZ8MTXP01AT6VP.44.85.H08.1.454.CMB.2.raw
  modified_base (307)..(307): a, c, t, g, unknown or other
  modified_base (423)..(423): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggaggcgtggtccagccgtggggagtccctgagctctcctgtgcagcgtctggattcaccttcagtacctatggcatgcacgtcggggtccnccaggcctccgagggccgaagggggctgggagtggggtcgcctattatagtggtatagactgggaaattaaactaaatctatgacaagacctcgtaggaacgggccattcaacctntaccacaagacaactaataccaaacggacacgtctagtactcgtagaactaaagtacgaaccgacgtccgaggaacgacggaccggtaacggaccgtacggtcgttaggttacgttaatttaacggtcggtaacggaacggacggttaactaagtttaacgttaacg

SEQ ID NO: 428231 - DNA, 510 bp, Homo sapiens
  misc_feature: GZ8MTXP01D4F73.44.85.H08.1.454.CMB.2.raw
  modified_base (296)..(296): a, c, t, g, unknown or other
  modified_base (337)..(337): a, c, t, g, unknown or other
  modified_base (360)..(360): a, c, t, g, unknown or other
  modified_base (368)..(368): a, c, t, g, unknown or other
  modified_base (457)..(457): a, c, t, g, unknown or other
  modified_base (481)..(481): a, c, t, g, unknown or other
  modified_base (497)..(497): a, c, t, g, unknown or other
tcagacagtatatacacgaccggtgctcgatttagtatcactcagtcgcggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttcagtacctatggcatgcacgtgggtcccnccaggctccgaggcaagggggctgggagtgggtgctattanatggtatgatggaataaataatnttatgtanattcgtagaacgggcatcacatctcagagactaattacgaagaacacactatagtactaggaaatgaatagcctagagacgccgagacncggctgttctacttacgtgtgcgngagaagtgggctcggngataacgaagtaa

SEQ ID NO: 428232 - DNA, 784 bp, Homo sapiens
  misc_feature: GZ8MTXP01EUW8P.44.85.H08.1.454.CMB.2.raw
  modified_base (262)..(262): a, c, t, g, unknown or other
  modified_base (312)..(312): a, c, t, g, unknown or other
tcagacagtatatacacgaccggtgctcgatttagtatcactcagtcgcggggggggagaggagcccagcactagaagtcggcggtgtttccattcggtgatcagcactgaacacagaggactcaccatggagtttgggctgagcttgggtttcctcgttgcttcttttaagaggtgtccagtgtcaggtgcagctggtggagtcgtgggggaggcgtggtccagccgtggggacgtccctgagactctcctgtgcagcgtntggacttcaccttcacgtacctagtggcagtgccgacggtcgggtccccnccgaggcctaccgagggacggaagggggcgtaggggacggtgggggtcgacctaagtttagtagttgggtaataggtaagtaagggtaaaacgttaaaaaataaaacgttctaaagtcgaccgtaacggtaccgttaccggggaagggaaacggggaccctaattaccgaaccctacgtacctaccgaaacgaacgtaaacctaaacttaaccgaaaacgtaaaccgaaccgtaccgttaaggttaacgttaccgttaaccgaaacgtaaaacgtaaccggaaaccgtaccggttaacccgagggaaaccgggaacccggtaacccgggaaacggaacccgggttacggttaccggtttaaggttaccgtttaaggtttaaccgttaggggttcggttaaccgggtaagttaaccgttaagtttaacggttaacggttaacccgtttaacccgttaaccccgttaacccggg

SEQ ID NO: 428233 - DNA, 582 bp, Homo sapiens
  misc_feature: GZ8MTXP01D2LHP.44.85.H08.1.454.CMB.2.raw
  modified_base (557)..(557): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgagactctcctgtgtagcgtctggattcaccttcagtacctatggcatgcacgtggtccgccaggctccgaggcaagtgggctgggagtggggtgccactttagtagtggtataggaatgggaaattaaactaaatactatcgactagacgtccggtaggaacggggcctagttaccaaccctattccctaccgaagaacgaactaaacttaccaaacggggtaaaccacgtacttagtactcgtagaacaaaatcgaaacctagccgtagaagcggaccggaaggacgacgggtcttggttcttattaacgngtaagcgaggactaagttaattaag

SEQ ID NO: 428234 - DNA, 499 bp, Homo sapiens
  misc_feature: GZ8MTXP01EJM3Q.44.85.H08.1.454.CMB.2.raw
  modified_base (302)..(302): a, c, t, g, unknown or other
  modified_base (341)..(341): a, c, t, g, unknown or other
  modified_base (367)..(367): a, c, t, g, unknown or other
  modified_base (396)..(396): a, c, t, g, unknown or other
  modified_base (401)..(401): a, c, t, g, unknown or other
  modified_base (403)..(403): a, c, t, g, unknown or other
  modified_base (418)..(418): a, c, t, g, unknown or other
  modified_base (421)..(423): a, c, t, g, unknown or other
  modified_base (425)..(425): a, c, t, g, unknown or other
  modified_base (428)..(428): a, c, t, g, unknown or other
  modified_base (430)..(430): a, c, t, g, unknown or other
  modified_base (432)..(432): a, c, t, g, unknown or other
  modified_base (437)..(437): a, c, t, g, unknown or other
tcagacagtatatacacgaccggtgctcgatttagtatcactcagtcgcgggggagctctgggagaggagcccagcactagaagtcggcggtgtttccattcggtgatcagcactgaacacagaggactcaccatggagtttgggctgagcgtgggtttcctcgttgctctttaagaggtgtccagtgtcaggtgcagctggtggagtcgtgggggagcgtggtccagcctgggagtccctgagactctcctgtgtagcgtctggatcaaccttcagtacctatggcatgcacgtcggtccnccaggctccaggcaagtgggctggagtgggtgccattanagtggtatgatggaaataataaactntatgcagactcgtagagggcatcacatcncagananatacagaacagactntannnanaanananacgcngaagacgcgacgacgacgcgttgttgttattaagtgtggcggaggacgtaagttaagttaag

SEQ ID NO: 428235 - DNA, 550 bp, Homo sapiens
  misc_feature: GZ8MTXP01ESPKT.44.85.H08.1.454.CMB.2.raw
  modified_base (305)..(305): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggccagcctggggagtccctgagactctcctgtgcagcgtctggattcaccttcagtacctatggcatgcacgtcggggtcccnccgaggcctaccgagggcgaagggggctgggagtggggtgcctacgttatagtggtatagatgggaaataaataaatactatgacagactcgtagaacggcattcacatctacagacaacaataccaaaggaactacgctagtatccgtagacaaatcgaaactacgacctggaagaacgaccggaaggaccgtaacggcttaggttgttattaacgtgtcgagaggactaagttaagtttaacg

SEQ ID NO: 428236 - DNA, 539 bp, Homo sapiens
  misc_feature: GZ8MTXP01ACMKU.44.85.H08.1.454.CMB.2.raw
  modified_base (306)..(306): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggagcgtggtccagcctggggagtccctgagactctcctgtgcagcgtctggattcaccttcagtacctatggcatgcacgtggggtcccncaggctccgagggcgaagggggctgggagtggggtggcctacttatagtggtatgatggaaagtaaataaagtactatgcagactcgagacggcattcacatctacagagaacaattaccaaggaacacgctagtatctagacaaatcgaacagcctggaacggacgccggaggaccgacgggtcttggttgttacttaacgtgtcgacggaggactaagttaagtttaacgg

SEQ ID NO: 428237 - DNA, 693 bp, Homo sapiens
  misc_feature: GZ8MTXP01DLAMS.44.85.H08.1.454.CMB.2.raw
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctgggtggagtcgtgggggagcgtggtccagccgtgggagtccctgagctctcctgtgcagcgtctggattcaccttcaagtacctatggcatgcacgtgggtcccaccaggcctccgagggcgaagggggctgggaggtggggtggcccaacgtttagtagttgggtaattaggaagttgggaaaagttaaattaaaagttactaagttggaccgaacggtaaccgttcccgggtaggaaacgggggtcctaacgtttaccaaccctattaccctacccgaagaaacgaaacctaaactttaccccgaaaggggaaaccctaacggtaccttacgtactcctaggaacctaaaatacggaaacctaggacccctaggaaacggaacggacccgggaaagggaaccgaaccggggtccgttaggttagttaacgtttaaccgttagggtaacggtaccgggtaagggttaacctaagttttaagtttaaccggg

SEQ ID NO: 428238 - DNA, 541 bp, Homo sapiens
  misc_feature: GZ8MTXP01E10HT.44.85.H08.1.454.CMB.2.raw
  modified_base (474)..(474): a, c, t, g, unknown or other
  modified_base (479)..(479): a, c, t, g, unknown or other
  modified_base (520)..(520): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagttgggctgagctgggttttcctcgttgctcttttaagaggtgtccagtgtcaggtgcagctggtggagtcgtgggggagcgtggtccaggcctggggagtccctgagactctcctgtgcagcgtctggattcaccttcagtacctatggcatgcactgggtccgcaggctccgaggcaagggggctgggagtggggtgcctacttagtagtggtatgaagttggaaagtaaataaatactataggacagactcggtaggaacgggccattacaccattccaccaagacgaacaaattaccaaagggaacacgacctagtatctagacaaatcgaanacgcngaagacgcggacgttacgacggcttggttgttatttaaggngtcgagagactaagttgtaag

SEQ ID NO: 428239 - DNA, 697 bp, Homo sapiens
  misc_feature: GZ8MTXP01BLRF4.44.85.H08.1.454.CMB.2.raw
  modified_base (197)..(197): a, c, t, g, unknown or other
  modified_base (315)..(315): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtncagctggtggagtcgtgggggagcgtggtccaggccgtggggacgtccctgacgtactctcctgtgcagcgtctggattcaccttcagttaccctatggactatgcacgtgggtcccncaggcctcgagggcgaagggggctgggagtgggtgccctacgttatagtgggtatgaagttgggaaattaaattaaatacttagtagacgaagtaccgttaccggtaggaaacgggggtcctaacttcccgaaaccattacccgtacccgaaagtaacgaacctaaactttaaccccgaaagggggtaaacctaccccgggtactaggttacttaccgtaacggtaacctaaaaagttccgaaaaccacggtacccctagggaaaccggaaccggacccggggaaacggttaccggaaacggggtcccttaagggttcgtttaaacgtttaacgtagggttcggaccggtaaaggggacttaagtttaacgtttaaaccggg

SEQ ID NO: 428240 - DNA, 577 bp, Homo sapiens
  misc_feature: GZ8MTXP01C8N1B.44.85.H08.1.454.CMB.2.raw
  modified_base (311)..(311): a, c, t, g, unknown or other
  modified_base (551)..(551): a, c, t, g, unknown or other
  modified_base (570)..(570): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttctttttaagaggtgtccagtgtcaggtgcagctggtggagtcgtgggggaggcgtggtccaggccgtggggacgtccctggagctctcctgtgcagcgtctggattcacttcagtacctatggcagtgcacgtgggtcccnctaggcctccgagggccaagggggctagggagtggggtgccctacttagtagtggtatagatgggaaagttaaacttaaagtactagtgacgaagacttccgtaggaacgggcctattccaactatctaccagagaactaattaccccgaaagaaaccacggtacctagtactcctgaccaaaatcgaacaagccgtaggaacgacgaccgagggaccacggtcttgttgttattaacgngtcgtacgagactaagttntttaagg

SEQ ID NO: 428241 - DNA, 764 bp, Homo sapiens
  misc_feature: GZ8MTXP01B94A5.44.85.H08.1.454.CMB.2.raw
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagtcttgggttttcctcgttgcttctttttaagaggtgtccagtgtcaggtgcagctggtggagtcgtgggggagcgtggtccagcctgggagtccctgagactctcctgtgcagcgtctggacttcgaccttcagtaccctagtggacagtgcctacgtcgggtcccgccgaggtcctcccgaaggcgaagggggcgtaggggtaggtgggggtagcctaagtttagtagttgggtaatggtaaagtagggtaaattaaaaaaacgttaaaattaacgtaagttacggacctaaacgggtaaccgtttccccggggtagggaaaaccggggtccctaagtttaccccaaaccgtacttacccgtacccgaaagtaacgtaaacctaaacgttaaccccgaaaagtaaaccctacggtacccttaagggtaacctttcgtaacgaaccttaaaagtaccgaaaaccgacgttaacccgtagggaaacgaacgggacccggaaagggaacccgtacgggttactttagggttaccgtttaaagttaccggttaggttagggaccgtaaagggtaaccttaagtttacgttacggttaacgttaacccttaaccccgttaaccgg

SEQ ID NO: 428242 - DNA, 603 bp, Homo sapiens
  misc_feature: GZ8MTXP01BP7N8.44.85.H08.1.454.CMB.2.raw
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcgtggtttcgcgttaggctctttaagaggtgtcagtgtcaggtgcagctggtggagtcgtgggggagcgtggtccagcttgggagtcctgacgactctcctgcgcagcgtcgtgactctaccttactacgtacgtagtgtcatcgcgtcgtcggtccgccgacggcgtacgacggacggacgggcggtggtaggtggtcggtaccgtacgtagtagtagtagtaagtagtaaggtaaagtaaataaatatagtagacgacgtacgtacgtacggacggacgtactactactactactacgacgacgaactaactaacgaacggaacgtacgtacgtacgtactacgtacgaacgaacgtaacgtaacgacgacgagaacgacggacggacggacgtacggtacgttagttgttagtaagtgtaacggacggtacgttacgtaagttaagttaag

SEQ ID NO: 428243 - DNA, 599 bp, Homo sapiens
  misc_feature: GZ8MTXP01A7BHC.44.85.H08.1.454.CMB.2.raw
  modified_base (179)..(179): a, c, t, g, unknown or other
  modified_base (307)..(307): a, c, t, g, unknown or other
  modified_base (508)..(508): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagnggtgtccagtgtcaggtgcagctggtggagtcgtgggggagcgtggtccagccgtggggagtccctgagctctcctgtgcagcgtctggattcaccttcagtacctatggcatgcacgtggggtcccnccagggcctccgagggccgaaggggggtctagggggaggtgggggtacgccctaacgtttatagttgggtataggaagttggggaaaacttaaataaatactatgacagtactccggtagaacgggcctattcgacctatcctaccagacgacaattcccaaaggaacacgtctagtaatccgtagaactaaatcgaaacncgacctggaacgacggacccggaggaaccgaacgggtcttaggttgttacttaacgtggtaacggcgaaggttactaagttgtttaaccgg

SEQ ID NO: 428244 - DNA, 578 bp, Homo sapiens
  misc_feature: GZ8MTXP01BUOXO.44.85.H08.1.454.CMB.2.raw
  modified_base (307)..(307): a, c, t, g, unknown or other
  modified_base (348)..(348): a, c, t, g, unknown or other
  modified_base (379)..(379): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggtccagccgtgggagtccctgagactctcctgtgcagcgtctggattcaccttcagtacctatggcatgcacgtgggtcccncaggcctcgaggcgaagggggctggagtgggtgccagttanagtggtatgatggaaataaataaatctatgntagactcgagaggcgattcactactctaccgagacgacaaacttaccaaaggtaaccacgtactacgtaatcctgaacaaatacgaaacgtacgaccgtaggaacgaacggacccggaaacgggaccgtaacggtcgttaggttcgttacgtttaacgtggtaacggacggtacggttaactaagtttaagtttaacgg

SEQ ID NO: 428245 - DNA, 685 bp, Homo sapiens
  misc_feature: GZ8MTXP01DMODC.44.85.H08.1.454.CMB.2.raw
tcagacagtatatacacgaccggtgctcgatttagtatcactcagtcgcggggaggctctgggagaggagcccagcactagaagtcggcggtgtttccattcggtgatcagcactgaacacagaggactcaccatggagtttgggctgagctgggttttcctcgttgctctttttaagaggtgtccagtgtcaggtgcagcgtggtggagtcgtgggggagcgtggtccagccgtgggagtccctgacgctctcctgtgcagcgtctggattccaccttcacgtacctatcggctagtcgcctacgtcggggtcccgccaggcctccgagggaccgaagggggctgggaggtggggtacggacctacgtttaagtagtgggttaatagaagtaagggtaaaacttaaaattaaacgttactaagtcgacaacggtaccttacccggtaggaacggggccttaacttacccgaaccccttatacctaccccgaaaggtaacaaactaaacttacccgaaaagggaaactaccggtcttaagtactaccggtaagaaactaaaactcgaaaccacgtaccgtaaggaacggaaccgacccggaaacggaccgtaacgggttcttaggttacgtttaacttaacggtgtaaccggaacgtaaggttaactttaagttaacgttaaccg

SEQ ID NO: 428246 - DNA, 621 bp, Homo sapiens
  misc_feature: GZ8MTXP01BZ7UF.44.85.H08.1.454.CMB.2.raw
  modified_base (311)..(311): a, c, t, g, unknown or other
  modified_base (576)..(576): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggtccagccgtgggacgtccctgagctctcctgtgcagcgtctggacttcaccttcagttaccctatcggcatgcacgtgggtcccncaggcctcgagggcgaagggggtctgggacggtggggtcgacctacgtttagtagtggtataggaagtgggaaagttaaataaatactagtcgacaacgtactccggtaggaacggggtcctacttaccgaacctatcctacccgaagtacgaaactaacttaacccgaaacggaaccgtacggtacctaggtaactcgtacgaactaaaagtcgaaactacgcctaggaacggacggaccggaggaccgacggtcttagggttnttacgttaacgtgtcggacggaggttactaagttaacgttaacgg

SEQ ID NO: 428247 - DNA, 562 bp, Homo sapiens
  misc_feature: GZ8MTXP01B1PSJ.44.85.H08.1.454.CMB.2.raw
  modified_base (306)..(306): a, c, t, g, unknown or other
  modified_base (353)..(353): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccgtgggacgtccctgagctctcctgtgcaggcgtctggattcaccttcagtacctatggcatgcacgtgggtcccncgaggcctcgagggcgaagggggctgggagtggggtgccacgtttanagtggtataggagttaaggggaaattaaactaaagtactagtgactagactcgaggaacgggcattcaccatcctacagacgacaattaccaagaacacgctagtactctagacaaagtcgaacacgtcctaggaacgaggccggaggacgaacggtcttaggttcgttagttaacgtcgtaagcggaaggactaagttaagtttaacg

SEQ ID NO: 428248 - DNA, 654 bp, Homo sapiens
  misc_feature: GZ8MTXP01CHYPK.44.85.H08.1.454.CMB.2.raw
  modified_base (261)..(261): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggttgtccagtgtcaggtgcagctggtggagtcgtgggggagcgtggtccagccgtgggagtccctgagactctcctgtgcngcgtctggattcacttcagtacctatcggcatgcctacgtcgggtcccgccaggcctaccgagggacgaagggggcttagggaggtggggtgacctacgtttagtagtagggtataaggaagttaagggaaaagttaaaactaaaattacgtaatacggacaacgtaccgttaccggtagggaaacgggtcccgtaattccaacctataccgtaccaagtacgaaactaacttacccgaaaggtaactacggtccttagtaactcctagaaactaaaacgtcgtaaaacgcgtacccgtaggaacggaccggaccgggtaacgaaccgtaaccgggtcgttagttcgttacttaagtcggtaaggacgaggttacctaaggttaatttaacgg

SEQ ID NO: 428249 - DNA, 548 bp, Homo sapiens
  misc_feature: GZ8MTXP01CMC3Z.44.85.H08.1.454.CMB.2.raw
  modified_base (293)..(293): a, c, t, g, unknown or other
  modified_base (303)..(303): a, c, t, g, unknown or other
  modified_base (342)..(342): a, c, t, g, unknown or other
  modified_base (399)..(399): a, c, t, g, unknown or other
  modified_base (448)..(448): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggtttttcctcgtttgcttctttttaagaggtgtccagtgtcaggtgcacctggtggagtcgtgggggagcgtgtccagcctgggagtccctgagctctcctgtgagcctctggtatttagtcagtagttctggcatgcncgtgggtccncaggcctcgaggcgaagggggccgagtggttgcaggttnagccatatgatggaaactttcaagattatatgcagactcgtagaaggccattcgacntctcagacgacacttccgacactcgtacgtaccgtaggaaactgtaacncgacgaccgtggaggacggcggcggtaaccgtcgggcttacgttggtaacttcgttgttcggacggtaagtaggtccgggaagtgggactaagcgtaacg

SEQ ID NO: 428250 - DNA, 658 bp, Homo sapiens
  misc_feature: GZ8MTXP01AMZBO.44.85.H08.1.454.CMB.2.raw
  modified_base (323)..(323): a, c, t, g, unknown or other
tcagacagtatatacacgaccggtgctcgatttagtatcactcagtcgcgggggagctctgggagaggagcccagcactagaagtcggcggtgtttccattcggtgatcagcactgaacacagaggactcaccatggagtttgggctgagcttgggttttcctcgttgcttcttttaagaggtgtccaggtgtcaggtgcagcgtgggtggaggtcgtggggggaggcgtggtccaggcccgtggggacgtccctgacgactctcctgtgcagcgtctggacttcaccttcagtacctagtggcatgctacgtgggggtcccncaggcctccgagggccgaaggggggctagggggaggtggggtcggacctacgtttagtagtgggtataggaagtaaggtaaagtaaataaatactatgacacgtacgtccggtaggaacgggcctaacgttacaaccctatcctaccgaaggaacaacgtaacttaccgaaacggtaaccacggtcttagtactcctaggaactaaacgtacgaaacgacgtacccgtaggaacggacggacccgggaacggaccggtaacgggtcttagggttacgttaacgtttccggtagggttcggaacgggtaaggacttaacgtttaacgtttaacggg

SEQ ID NO: 428251 - DNA, 706 bp, Homo sapiens
  misc_feature: GZ8MTXP01BHPRN.44.85.H08.1.454.CMB.2.raw
  modified_base (279)..(279): a, c, t, g, unknown or other
tcagacagtatatacacgaccggtgctcgatttagtatcactcagtcggcgggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggccgtggggacggtccctgacgactctcctgtgcagcgtctggtattcaccttnagtacctatggcatcgcacgtgggtcccgcaggcctcgaggcgaagggggctgggacggttggggtcgactacgttagtatggtatggaagtagggaaattaaaagtaaaatctaagtcgactaacgaccgttccggaaggtaacgggacccgtaattacccgaacctacttcctaccaaacgtacgtaaacaaacttaccgaaaacgaaaccgacggtaccttagggtaacttaccgttacgaaactaaaacgtacggaaacctaacggacccgttaagaacgggacggacccgggaacgggaaaccgtcgggttaccgttacgggttagtttaaacgttaaccggttggttcggaccggggtaaacgttaacgtaagttttaacgttaacgggtttaccggttaaacctttaaccccgtaaccgg

SEQ ID NO: 428252 - DNA, 760 bp, Homo sapiens
  misc_feature: GZ8MTXP01AMF09.44.85.H08.1.454.CMB.2.raw
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggagtccctgagactctcctgtgcagcgtctggacttcaccttcagttacctagtggcatcgctacgtcgggtcccgccgacggcctacccgaggcgaagggggtcgtagggaggtgggggtcggcctaacgtttagttagtggtaagtaggtaagttaagggtaaacgttaaaaaataaaatttaacgtaagtaggacctaaggtacccgttaccgggtaagggtaaaccgggtcccgtaactttacccgaaccctatacccgtaccgaaagaacgtaaacctaaacgttaacccgaaaacgaaacctacgtaccgttaacgggttaactacccggttaaagaaaccgtaaagtaccgaaaccgtacgtaccgtaacggaaccggaaccggaacccgggaacggtaacccggtacgggttacgtttacggttaacgtttaacgtttacggttagggttacgttaacgggtaaacgtaacgttaagtttaacggtttacggttaacccgttaacccgttaacccgtaaccgg

SEQ ID NO: 428253 - DNA, 730 bp, Homo sapiens
  misc_feature: GZ8MTXP01CEJQJ.44.85.H08.1.454.CMB.2.raw
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggttgtccagtgtcaggtgcagctggtggagtcgtgggggagcgtggtccagccgtgggacgtccctgacgactctcctgtgcagcgtctggacttccaccttcagttacctatcggcagtcgactaccggtcggggtccccgccgaggccctaccggaacggggacggaaacggggggtcgttagggggtagggttcgggggtacgtaccccttaacgtttagttagttaggggttaatagggaaaggtttaagggaaaacgtttaaataaaagttactaaggttcgactaaacgggtaccgtttacccggaagggaacgggtacccgtaacgtttacccaaccgtactttaccgaccgaaggaactaaactaaccgttaaaccgaaaacggaaaccgtacggtaccttagtaacctactaacgaaccaaagtacgaaaccacgtaccgtaaggaacgaaccggaccggaacggacccgaaggttcgttaggttacgttaccgtttgacggtaacgacgggtaaggttacctaagtttaacgtttaacgg

SEQ ID NO: 428254 - DNA, 658 bp, Homo sapiens
  misc_feature: GZ8MTXP01AL0HD.44.85.H08.1.454.CMB.2.raw
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctgggtggagtcgtgggggagcgtggtccaggtccgtggggacgtccctgagtacctctcctgtgcaggtcgtctggacttcaccgtttcaagttaccctatcggctagtgctacgtcgggtcccgcaggcctccgagggccgaagggggtctggggacggtggggtcgccctaacgtttagtaagttgggtaatagaagttaagggaaaagtaaattaaaacttcgttaagtgaccgtaacggtacccgttaccggttaacgggaacggggtacccgtaattccgaacctacttaccacgaagaacgaactaacgttaacccaaacgggaaccacggtcctagtacttccgtagaaccaaagtcgaaacgtacgtccgtaggaacgaccggccgaacggaccgtacgggtcttgttggttacttaagtgtaaggaacgaggttactaagttgttaacg

SEQ ID NO: 428255 - DNA, 663 bp, Homo sapiens
  misc_feature: GZ8MTXP01B7L9D.44.85.H08.1.454.CMB.2.raw
  modified_base (239)..(239): a, c, t, g, unknown or other
  modified_base (309)..(309): a, c, t, g, unknown or other
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggagtcgtgggggagcgtggtccagccgtgggacgtcccngagctctctgtgcagtcgtcgtggtacttctaccttcacgtacctagtggcatcgccacgtcgggtcccnccgacggctccgagggacgagggggtctagggaggtggggtagctacgttagtagtggtatagtagtaggaaacgtaaaattaaataacgtatcgactagaccgttaccggtaggaacgggtccgtattaccactactccaccgaaggaacaactaaacttaccgaaagaacacgtacttacgggtacttacgtacgtaaactaaagaacgaacgacgtaccgaggaacggacggaccggaacgggtaaccgaacggttcgttagttacgtttacgttacggttggttcgggaacgtaacgggtaacttgtttaacgttacggttaacgttaaccccgttaaccgttaacccgg

SEQ ID NO: 428256 - DNA, 693 bp, Homo sapiens
  misc_feature: GZ8MTXP01DNC40.44.85.H08.1.454.CMB.2.raw
  modified_base (304)..(304): a, c, t, g, unknown or other
tcagacagtatatacacgaccggtgctcgatttagtatcactcagtcggcggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcggtgggggaggcgtggtccagccgtggggagtccctgagactctctgtgcagcgtctggacttcacttcagtacctatgcatcgcacgtggtcccncgaggcctccgaggcgaagggggctgggaggtggggtgactacttagtagtggtatagaagtaggtaaaacgttaaaattaaatcgtaatcggactaacgaccgtaccgggtaggaaaccggggtccctaatttacccaacctacttcccgaaccgaaagtaacgaaacctaaacgttaaccaaaacggaaccacggtaccttaagggtacttaccggtaaacgaaactaaaacgtacgaaaccacggtaaccgagggaacggaccggaaccggaaggtaaccggtacgggttagttacggttacgttaacgtttacggttcggttacggaacggtaaggtaacttaagtttaacgttacgttaaccgttaaccgttaacccgtaacgg

SEQ ID NO: 428257 - DNA, 633 bp, Homo sapiens
  misc_feature: GZ8MTXP01BONWH.44.85.H08.1.454.CMB.2.raw
  modified_base (287)..(287): a, c, t, g, unknown or other
  modified_base (307)..(307): a, c, t, g, unknown or other
tcagacagtatatacacgaccggtgctcgatttagtatcactcagtcggcgggggggagaggagcccagcactagaagtcggcggtgtttccattcggtgatcagcactgaacacagaggacctcaccatggagtttgggctgagctgggttttcctcgttgctcttttaagaggtgtccagtgtcaggtgcagctgggtggagtcgtgggggagcgtggtccagccgtgggacgtccctgagactctcctgtgcaggcgtctggaattcaccttcaggtaccctanggcatgcctactgggtcccncgacggctccgaggcgaaggggctgggagtgggtgctacttatagtggtatggagtaggaaagtaaataaatctatgcagactcgtggaaacgggcgtattcgaccagtcctaccaagacgtaacaacttaccgaaaagaccaacgtacctaggggttaactcgtacgaacctaaagtcgtaaacgacgttacccgaggtaacggaccgacccgggaaggtaaccgtaacggggttccttagggttagttacgttaaccggttgggttccggagaacgggtacgaatttacgtagttaacggttaacccttaacccgttaacccgg

SEQ ID NO: 428258 - DNA, 592 bp, Homo sapiens
  misc_feature: GZ8MTXP01ATHU9.44.85.H08.1.454.CMB.2.raw
  modified_base (246)..(246): a, c, t, g, unknown or other
  modified_base (289)..(289): a, c, t, g, unknown or other
  modified_base (306)..(306): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcagctggtggagtcgtgggggagcgtggtccagccgtgggacgtcccngagactctcctgtgcagcgtctggattcaccttcagtacctanggcatgcacgtggtccncaggctccgaggcaagtggctgggagtcgggtgctagttagatcggtaaatggaatagggaaataaataaatactatgacaagtacttaccggaggaacgggcctaagttaccaacctatccgtaccagacgaaactaaacttaccgaaagaaccgtacgtctagtactctaggaaacctaaagtcggaaactagccctaaggaacgaccggacccggaaggtaaccgaacccgggttcgttgttacggttaactcgtggacgacggttagtaacgttaagttaag

SEQ ID NO: 428259 - DNA, 715 bp, Homo sapiens
  misc_feature: GZ8MTXP01DU7P3.44.85.H08.1.454.CMB.2.raw
tcagacagtatatacacgaccggtgctcgatttagtatcactcagtcgcggggggggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcagcgtgggtggaggtcggtgggggaggcgtgggtccaggccgtggggacggtccctggacgtactctcctgtcgcacggcgtcgtggtacttccaacccttcacgttacctagtcggactagtcggaccgtacggttccgggggtcccccaccgtaacgggccctacccgggaagggggaccggaaaggggggggtcctaggggggtacgggttgggggtagtaccttaagtttagtagttaggtataggtaagtaggtaaaattaaaactaaatctagtcgaacagtaccgtcgggtagggaaccgggtctacttccaacctactcctaaccgaaagactaactaaactaaccaaaacgaacgtactacttaaggtacttacggaacaaactaaagaacgaacgacgacgacggaacggacggaccggacggaacggtacggttgttagttagttagttacgttaggttggacggtaaggtaataagttagttagttaacttaaccgttaaccttaaccg

SEQ ID NO: 428260 - DNA, 664 bp, Homo sapiens
  misc_feature: GZ8MTXP01EX648.44.85.H08.1.454.CMB.2.raw
  modified_base (198)..(198): a, c, t, g, unknown or other
  modified_base (324)..(324): a, c, t, g, unknown or other
tcagacagtatatacacgaccggtgctcgatttagtatcactcagtcgcgggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtncagctgggtggagtcgtgggggagcgtggtccaggccgtggggacgtccctggacgacttcgtcctgtgcagtcgtctggattccgaccttcagttaccctatggccatgccacgtcggggtcccnccgaggcctaccgacgggcgaacgggggctagggtcggtggggtgccgtactttagtagtggtactagaagttaaggaaagttaaactaaatacgtatcggactagtaccgttcggtaagacgggtcctaattcacccgactcctaccgaagtacgaactaacttaccgaaagtaaccacgtctagatacctagaactaaagtacgaacgacgtcgaggaacggaacgacccgggaaaggttaccgaaacgggtccttagggtttaacgttaccgtttaaaggtttggaacgttaacccgggaacggggttaacttaaggttttaaacccgttttaaggg

SEQ ID NO: 428261 - DNA, 545 bp, Homo sapiens
  misc_feature: GZ8MTXP01CCGT4.44.85.H08.1.454.CMB.2.raw
  modified_base (247)..(247): a, c, t, g, unknown or other
  modified_base (257)..(257): a, c, t, g, unknown or other
  modified_base (261)..(261): a, c, t, g, unknown or other
  modified_base (270)..(270): a, c, t, g, unknown or other
  modified_base (298)..(298): a, c, t, g, unknown or other
  modified_base (340)..(340): a, c, t, g, unknown or other
  modified_base (369)..(369): a, c, t, g, unknown or other
  modified_base (455)..(455): a, c, t, g, unknown or other
  modified_base (487)..(487): a, c, t, g, unknown or other
  modified_base (501)..(501): a, c, t, g, unknown or other
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggtttttcctcgttgcttcttttaagaggtgtccagtgtcaggtgcagctggtggagtcgtgggggagcgtggtccagccgtgggacgtcctgagctctcngtgcagcgtntggnttcaccttnagtacctatggcatgcacgtgggtcccnccaggctccgaggcgaagggggctgggagtgggtgcacgttnagtcggtatgagtggaagtaaaataaatntatgacagactcgtagaacgggcattcacatctacagagacaattccgaagaacacgtcctagggtatctgaaccaaatcgaaacngaccctaggagacgtccgaaggaaccgacggnttgttgtattacgngttgcgtaaggactaagtattaggttactcttaaccgtaaccgg

SEQ ID NO: 428262 - DNA, 533 bp, Homo sapiens
  misc_feature: GZ8MTXP02HOSGQ.44.85.H08.1.454.CMB.2.raw
  modified_base (278)..(278): a, c, t, g, unknown or other
  modified_base (304)..(304): a, c, t, g, unknown or other
  modified_base (495)..(495): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctggtggagtcgtgggggagcgtggtccaggcctgggaggtccctgagactctcctgtgcagcgtctggattcaccttnagtacctatggcatgcacgtggtccnccaggcctccgagggcaaggggctgggagtggggtgcctacttatatggtatggatggaaagtaataaactactatgacagactcgtagaaggccgattcaccatcctaccagacgaactaaacttaccaaaagaaccacgcttagtattccagacaaatcgaacagctagagacgccgagacgacggtcncgttagacttaacgtgtagacggagacattacgtttag

SEQ ID NO: 428263 - DNA, 500 bp, Homo sapiens
  misc_feature: GZ8MTXP02FWXOY.44.85.H08.1.454.CMB.2.raw
  modified_base (300)..(300): a, c, t, g, unknown or other
  modified_base (342)..(342): a, c, t, g, unknown or other
  modified_base (349)..(349): a, c, t, g, unknown or other
  modified_base (408)..(408): a, c, t, g, unknown or other
  modified_base (449)..(449): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcgtctggattcaccttcagtacctatggcatgcactgggtccnccaggctccagggcaaggggctgggagtgggtggccacttanatggtangatgggaaataataaatactatgacagactccgtgaagggccgattcacatctccaganacaattccaaagacagctagtatctgacaatagaacagacngacgagacgacggacgacgcgtgtgtattaagtgtgcgagacgatatttag

SEQ ID NO: 428264 - DNA, 519 bp, Homo sapiens
  misc_feature: GZ8MTXP02HFLYD.44.85.H08.1.454.CMB.2.raw
  modified_base (308)..(308): a, c, t, g, unknown or other
  modified_base (350)..(350): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcctggggaggtccctgagactctcctgtgcagcgtctggattcaccttcagtacctatggcatgcacgtggggtcccnccaggcctccgagggcaaggggctgggagtgggtgccattantggtatgatgggaaataaataaatactatgacaagactccgtaggaacgggccgattccaccatctaccagacgacaattaccaaagaacacgctagtatctagacaaatgaacagcctagacgacgccgacggacacggctgtgtataacgtgtcgcgagacatatag

SEQ ID NO: 428265 - DNA, 535 bp, Homo sapiens
  misc_feature: GZ8MTXP02G9WTZ.44.85.H08.1.454.CMB.2.raw
  modified_base (307)..(307): a, c, t, g, unknown or other
  modified_base (463)..(463): a, c, t, g, unknown or other
  modified_base (465)..(465): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggtccagcctgggaggtccctgagactctcctgtgcagcgtctggattccaccttcagtacctatggcatgcacgtgggcccnccaggcctccgagggcgaaggggctggggagtggggtgcctattatagtggtatgatgggaaattaaataaatactatgacagtactccgtagaacggccgattcacatctacaagagacaaataccaaagaactacgctagtatctagactaaananaacagacacgacgacgacgacgacgacgacgtacgtagtagtaacgtagtacgacgagacgtactagtag

SEQ ID NO: 428266 - DNA, 520 bp, Homo sapiens
  misc_feature: GZ8MTXP02JU39I.44.85.H08.1.454.CMB.2.raw
  modified_base (300)..(300): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcatggtccagcctgggagtccctgagactctcctgtgcagcgtctggattcaccttcagtacctatggcatgcactgggtccnccaggcctccgaggcaaggggctggggagtggggtcgcacttagtatgggtatggatgggaaacgttaaataaatactaatgaccagactccggtagaacggggccattcaccatctccagacgacaattaccaagaacacgctagtatctagacaaatgaaacagcctagagagccgaggacacggctgtagtaattacgtgtcgacgaggactattag

SEQ ID NO: 428267 - DNA, 522 bp, Homo sapiens
  misc_feature: GZ8MTXP02FTX4U.44.85.H08.1.454.CMB.2.raw
  modified_base (302)..(302): a, c, t, g, unknown or other
  modified_base (349)..(349): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagactctcctgtgcagcgtctggattcaccttcagtacctatggcatgcacgtggtccnccaggctccgaggcaaggggctggggagtggggtggccctacgttanagtgggtatggatgggaaataaataaatactatgacagactccgtagaaggcgatcacatctcagagacaataccaaagaacacgctagtatctagacaaatacgaacagcctagacgagaccggacggacgacggctagtgtattaacgtgtgacgaggactatagtttacg

SEQ ID NO: 428268 - DNA, 520 bp, Homo sapiens
  misc_feature: GZ8MTXP02G324P.44.85.H08.1.454.CMB.2.raw
  modified_base (300)..(300): a, c, t, g, unknown or other
  modified_base (375)..(375): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcgtctggattcaccttcagtacctatgccatgcactgggtccncaggctccgaggcaaggggctggagtggggtgcaattatatcagaagatgggaaattgaaagaacacgtacgganactccgagaagggccgatcaccgtctaccagagacatccaagaacacactgacatcctgacaaatgtacaacctcaacaagtcgaaggacacggctagtactattattgtgtacgacgacgcccccgtcgacgaccggtcccccg

SEQ ID NO: 428269 - DNA, 586 bp, Homo sapiens
  misc_feature: GZ8MTXP02FVMPJ.44.85.H08.1.454.CMB.2.raw
  modified_base (304)..(304): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcgtggttttcctcgttgctcttttaagaggtgtccagtgtcaggtgcagctggtggagtcgtgggggagcgtggtccagccgtgggagtccctgagactctcctgtgcagcgtctggattcaccttcagtacctatggcatgcacgtcgggtccnccaggcctccgagggcgaagggggctggggagtggggtggcctacgttatagtggtaatggagtggggtaaataaattaaaattactatgaccagtacgttccggtaggaacgggccgtacgttaccacctactcctaccgagaacgactaaattacccaaagaaccaacgctagtatctagacaaagtacgaacacgaccgtagacggacggacccggaaggaaccgtacggtcgtacgtagttaagttaacgtgtaggacgaaggactagttatttacgg

SEQ ID NO: 428270 - DNA, 576 bp, Homo sapiens
  misc_feature: GZ8MTXP02HBOK5.44.85.H08.1.454.CMB.2.raw
  modified_base (177)..(177): a, c, t, g, unknown or other
  modified_base (302)..(302): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccagcctggggagtccctgagctctcctgtgcagcgtctggattcaccttcagtacctatggcatgcactgggtcccncaggctccagggcaaggggctgggagtggggtgccacttagtatggtatgatgggaaagtaaataaagtacatgacagaccgtcgtaggaacgggccgagttccaccgtactcctacccaagacgaactaaacttacccaaagaacctaacgccttagtactcgtagacaaaagtagaaacagacctaggaacggacgaccggaacggaccgacggtccgtacgttaggttaacttaacgtggtaggaccggaaggtactacgttactttacgg

SEQ ID NO: 428271 - DNA, 575 bp, Homo sapiens
  misc_feature: GZ8MTXP02G6MGE.44.85.H08.1.454.CMB.2.raw
  modified_base (303)..(303): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggagtccctgagactctcctgtgcagcgtctggattcaccttcagtacctatggcatgcacgtgggtccncaggctccgagggcaaggggctgggaggtgggtgcctacttatagtggtatggatgggaaattaataaatactatgacagactcgtagaacggcgtatcacagtctaccgagacgacaaattacccaaagaccacgccttagtaactccgtagaactaaatcgaaaccacgacctaggaacgacggaccggaacgggaaccgaaccgggtcgtacggttaggtttaaacttcgtaggtacggaccggaaggtacctaagtttagtttaacgg

SEQ ID NO: 428272 - DNA, 514 bp, Homo sapiens
  misc_feature: GZ8MTXP02HF6XT.44.85.H08.1.454.CMB.2.raw
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcgtctggattcaccttcagtacctatggcatgcactgggtccgccaggctccgaggcaaggggctgggagtggggtgcctacttatatggtatgatgggaaataataaatactaatgacagactccgtgaacgggccgattcacatctaccagacgacaattaccaaagaacacgactgtaactctagacaaatgaacagcctagacgagccggaggacgtacggctgtgtataacgtgtgcgaggactatatttag

SEQ ID NO: 428273 - DNA, 530 bp, Homo sapiens
  misc_feature: GZ8MTXP02JV5F2.44.85.H08.1.454.CMB.2.raw
  modified_base (298)..(298): a, c, t, g, unknown or other
tcagacagtatatacacgaccggtgctcgatttagtatcactcagtcgcggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtacctatggcatgcacgtgggtcccnccaggctccaggcaaggggctgggagtggggtgctacttatagtggtatgatggaaataataatctatgacagactcgtagaacgggccgtattccaccatctaccagacgacaataccaaagaacacgctagtatctagacaaatgaacacgcctagagacgacgaggacacggctgtgtagttacgtgtcgacgaaggtactattacgttagtacgtacctaccgtaccg

SEQ ID NO: 428274 - DNA, 649 bp, Homo sapiens
  misc_feature: GZ8MTXP02GVJZZ.44.85.H08.1.454.CMB.2.raw
  modified_base (312)..(312): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagccgtggggagtccctgagctctcctgtgcagcgtctggattccacctttcagtacctagtggcatgcctacgtcggggtcccnccaggcctccgagggacgaaggggctgggaggtggggtcgacctacgtttatagtgggtatggaagttaggggaaaacttaaaataaaataccgttaagtgaccgaaagtaccgttacccggtaaggaaacggggcccgtaacttacccgaaccctacttaccgtacccgaaaggtaacgaaaccctaaaattaccccgaaaaaggaaccctaacggtacttaaggtaactaccgtagaacctaaaagtgaaaaccgtcgacctaggaacggacggacggaacggtacgaccggcgttagtacgttataacgtggtagacgtagactattagttacg

SEQ ID NO: 428275 - DNA, 544 bp, Homo sapiens
  misc_feature: GZ8MTXP02G67SA.44.85.H08.1.454.CMB.2.raw
  modified_base (306)..(306): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcgtctggattccaccttcagtacctatggcatgctacgtcggggtcccnccaggcctccgagggcaaggggctgggaggtggggtggcctacttatatggtatggatgggaaataaataaatactatgacagactcgtaggaacgggccgtaatccacactcctaccaagagaacaaattaccaaagaacacgactagtatctagaactaaatagaaacagacctggaacgacgccggacggtacgacggtctacgtgtacgtgtggacgacgagactagtagttag

SEQ ID NO: 428276 - DNA, 532 bp, Homo sapiens
  misc_feature: GZ8MTXP02JC83J.44.85.H08.1.454.CMB.2.raw
  modified_base (307)..(307): a, c, t, g, unknown or other
  modified_base (415)..(415): a, c, t, g, unknown or other
tcagacagtatatacacgaccggtgctcgatttagtatcactcagtcgcgggagctctgggagaggagcccagcactagaagtcggcggtgtttccattcggtgatcagcactgaacacagaggactcaccatggagtttgggctgagcgttgggttttcctcgttgcttcttttaagaggtgtccagtgtcaggtgcagctggtggagtcgtgggggaggcgtggtccaggcctggggagtccctgagactctcctgtgcagcgtctggattcaccttcagtacctatggcatgcacgtgggcccncaggcctccgaggcgaaggggctggggagtggggtcgcctacttatagtggtatgatgggaaattaaataaatcatgacagactcgtgaaggcgatcacatcacaganacatacaaagacacgctgtatcgtgacaaatcgaacgagcaggaacgacggaccgacggaaccgacggtcgtcggttagtaacttaacgtcgtggacggtagacgtattacgtttag

SEQ ID NO: 428277 - DNA, 564 bp, Homo sapiens
  misc_feature: GZ8MTXP02G2HR7.44.85.H08.1.454.CMB.2.raw
  modified_base (195)..(195): a, c, t, g, unknown or other
  modified_base (375)..(375): a, c, t, g, unknown or other
  modified_base (378)..(378): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggtccagccgtgggagtccctgagactctctgtgcagcgtctggacttcaccttcagtacctatggcatgcacgtggtcccgccaggcctcgagggcaaggggctaggggagtggggtgcctacgttatagtgtatgatgggaaataataaatntangacagactcgtagacggcatcacatctcagacgactaaacttccaaagtaacgacgtacgtagtaactaccgtagaacctaaagtacgaacacgtccgtaggaacgacggaccggaacggaccgacggtcgttacgtagtttaacgttaacgtggtacggacggaggtactaagttacgtttaagg

SEQ ID NO: 428278 - DNA, 601 bp, Homo sapiens
  misc_feature: GZ8MTXP02HA8GW.44.85.H08.1.454.CMB.2.raw
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttcagtacctatggcatgcacgtggtcccgccaggcctccgaggcgaaggggctgggaggtggggtggcctacgttatatggtatgatgggaaagtaaataaatactatgacaagactccgtagaacgggcgattcgacctacgtcctacccgaagacgaactaaacttacccgaaaacgaaccaacgaccttaggtaacttctacgacctaaaatacgaaactacgacctaggaacgacgacccggaacgggaccgaacgggtccgttacggttacgttaagttaaccgttaggtacggaccggaagggtacctagttaagtttacgg

SEQ ID NO: 428279 - DNA, 596 bp, Homo sapiens
  misc_feature: GZ8MTXP02GOZAD.44.85.H08.1.454.CMB.2.raw
  modified_base (304)..(304): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtctagccgtgggagtccctgagctctcctgtgcagcgtctggattccaccttcagtacctatggcatgcacgtggtccncaggctccgaggcgaaggggctgggagtggggtgcctacttatagtggtatggaagtggggaaaattaaactaaattactagtcggactaagacgtccgtaggaacgggtccgtattccacctatacctaccgaagacgaactaaacttacccgaaaagaaccacgacttagtaactcgtagactaaagtacgaaacacgacctaggaacgacggaccgaagggaccgacgggacttaggtagttaacgttaacgtaggtcgaccggaggtaacctagtttacgtttaacgg

SEQ ID NO: 428280 - DNA, 642 bp, Homo sapiens
  misc_feature: GZ8MTXP02FS6Q0.44.85.H08.1.454.CMB.2.raw
  modified_base (304)..(304): a, c, t, g, unknown or other
tcagacagtatatacacgaccggtgctcgatttagtatcactcagtcgcgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggagtccctgacgactctcctgtgcagcgtctggatcaccttcagtacctatggcatgcacgtcgggtccnccaggcctccgagggcaaggggctgggagtggggtgctaccttatgtggtatgagtgggaagtaaataaatactatgacaggtactccggtaggaacgggtaccgattaccacctacgtcctaccgaagacgaaactaactttacccgaaaaggaaaccaccggtacttacggttaaacttccgttaacggaacctaaaagttcgggaaaacctaggaccccgttaaagggaacggaacggacccgggaagggaacccggaacggtccgttacggttagtacgtttaaccgtggttaccggaggtacggtacgtaagttacgtttacggtttaaaccg

SEQ ID NO: 428281 - DNA, 570 bp, Homo sapiens
  misc_feature: GZ8MTXP02HHD8E.44.85.H08.1.454.CMB.2.raw
  modified_base (298)..(298): a, c, t, g, unknown or other
  modified_base (311)..(311): a, c, t, g, unknown or other
tcagacagtatatacacgaccggtgctcgatttagtatcactcagtcgcggggagctctgggagaggagcccagcactagaagtcgacggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattccaccttcagtaccctagtggcatgacncgtcggggtcccncaggcctccgagggcgaaggggctgggagtggggtgcctattatagtggtatggatgggaaagttaaataaagtactatgactagactcgtaggaaggccgatccacatctaccagacgactaattaccaaagaactacgactgtatacctagaactaaatacgaacagacctaggaacggacggaccggaacggaccgacggtcgtagtacgttacgttaacgtggtacgacggtaaggtactatttaacgtttacgg

SEQ ID NO: 428282 - DNA, 598 bp, Homo sapiens
  misc_feature: GZ8MTXP02JT1N0.44.85.H08.1.454.CMB.2.raw
  modified_base (311)..(311): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggccgtgggaggtccctgagactctcctgtgcagcgtctggacttcacctttcagtacctatggcatcgcacgtcgggtcccnccaggcctccgagggcgaaggggctggggacggtggggtggacctagttagtagtggtatgatcggggaaattaaataaatacgtatggactagactccggtaggaacgggcattccacatctaccaagacgaacaaacttacaaagactacgctagtatctagtacaaaatcgaaacacgaccgtaggaacggacggaccggaacggaccgaccggtacgttagggttaacgttaacgttccgtaggttacgtaccgggaaggtactaacgtttaatttaaccggg

SEQ ID NO: 428283 - DNA, 540 bp, Homo sapiens
  misc_feature: GZ8MTXP02JNIBJ.44.85.H08.1.454.CMB.2.raw
  modified_base (307)..(307): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcgtctggattcaccttcagtacctatggcatgcacgtggggtcccnccaggctccgagggccaaggggctggggaggtggggtgcctacgttatatgggtatgagtgggaaataaataaatactatgacaagactcgtagaagggccgattcaccatctaccagacgactaataccaaagaaccacgctagtactctagacaaatgaacacgcctagaagacgaccggacggacgacggctaggtacgtattaacgtagtgacgaggactagtatttag

SEQ ID NO: 428284 - DNA, 549 bp, Homo sapiens
  misc_feature: GZ8MTXP02JPHGN.44.85.H08.1.454.CMB.2.raw
  modified_base (296)..(296): a, c, t, g, unknown or other
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggtttcctcgttgctcttttaagaggtgtccagtgtcaggtgcagctggtggagtcgtgggggagcgtggtccagccgtgggagtccctgagactctcctgtgcagcgtctggattcaccttcagtacctatggcatgcacgtgggtccnccaggctccgaggcgaaggggctgggagtgggtgcatatagtggtatgataggaataataatctatgacagactcgtgaacgggcattcacatctccagacaacaataccaagaaacacgctagtactaccgtagacaaatacgaacacgtccaggaacgaccggacgacggacgtacggtctaggttacgtaagttacgcggtacggacgtaaggactaagttagttacggtaactaaccctacgtacccgg

SEQ ID NO: 428285 - DNA, 552 bp, Homo sapiens
  misc_feature: GZ8MTXP02G4BCS.44.85.H08.1.454.CMB.2.raw
  modified_base (276)..(276): a, c, t, g, unknown or other
  modified_base (305)..(305): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgagactctctgtgcagcgtctggattcaccttnagtacctatggcatcgcacgtcgggtccnccaggcctccgagggcgaaggggctggggagtggggtgcctacgttatatggtatggatgggaaataaataaatctatgacagactcgtagaacggcgattcactatctaccagacgacaaatccaaagacacgacttagtatctagacaaatcgaaacacgacctaggaacgacgaccggaaggaccgaacgggcttacggtagtagttaacgtgtacggcggaaggtactaagttacgtttaagg

SEQ ID NO: 428286 - DNA, 546 bp, Homo sapiens
  misc_feature: GZ8MTXP02IBGPE.44.85.H08.1.454.CMB.2.raw
  modified_base (298)..(298): a, c, t, g, unknown or other
  modified_base (322)..(322): a, c, t, g, unknown or other
tcagacagtatatacacgaccggtgctcgatttagtatcactcagtcgcggggggagaggagcccagcactagaagtcggcggtgtttccattcggtgatcagcactgaacacagaggactcaccatggagtttgggctgagcgtggttttccgcgtaggctctttaagaggtgtccagtgtcaggtgcagctggtggagtcgtgggggagcgtggtccagccgtgggacggtccctgagactctcctgtgcagcgtctggattcacttcagtacctatggcatgcacgtgggtcccncgagcctcgaggcgagggctgggnggtgggcgactattagtagtcgtatgagtaggaaattaaactaatcgtatgacacgtaccgtcgaggaacgctatcactactcacgagacaactaactaccaacgacacgtcgtagtactactagacaatacgaacgacgacgacgacgacgacgacgacgacgtcgtcgtagtacgtacgtcgtcgacgaagtacgtacgtacttacgtacgtacgtactacg

SEQ ID NO: 428287 - DNA, 496 bp, Homo sapiens
  misc_feature: GZ8MTXP02FKN1Q.44.85.H08.1.454.CMB.2.raw
  modified_base (300)..(300): a, c, t, g, unknown or other
  modified_base (403)..(403): a, c, t, g, unknown or other
  modified_base (446)..(446): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggccagcctgggagtccctgagactctcctgtgcagcgtctggattcaccttcagtacctatggcatgcacgtgggtccnccaggctccgaggcgaaggggctgggagtggggtgcctacttatagtggtatgatggaaataataaatactatgcagactcgtgaaggcatcacatctcaganacaatccaaagacacgctagtatctagacaaatcgaacagccngacgagcgaggacacggctagtgtataagtcgtgacgagactatagttag

SEQ ID NO: 428288 - DNA, 529 bp, Homo sapiens
  misc_feature: GZ8MTXP02JJ1VM.44.85.H08.1.454.CMB.2.raw
  modified_base (305)..(305): a, c, t, g, unknown or other
  modified_base (346)..(346): a, c, t, g, unknown or other
  modified_base (411)..(411): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtctgggggagcgtggtccagcctggggacgtccctgagactctcctgtgcagcgtctggattcacctttcagtacctatggcatgcactggggtccnccaggcctccagggcaaggggctgggagtgggtgccattanagtggtatgatgggaaataataaatactatgcagtactcgtagaagggccattcacatctcaganacaattccaaagacacgctagtatctagacaaatgaaacagtcctaggacgacgccggaacggacgaacgggctgtacgtacttaacgtggtacgcggaggactagttactttaacgg

SEQ ID NO: 428289 - DNA, 566 bp, Homo sapiens
  misc_feature: GZ8MTXP02JFMZ9.44.85.H08.1.454.CMB.2.raw
  modified_base (262)..(262): a, c, t, g, unknown or other
  modified_base (300)..(300): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggtttcctcgttgctctttaagaggtgtccagtgtcaggtgcagctggtggagtcgtgggggagcgtggtccagcctggggagtccctgagactctcctgtgcagcgtcnggattcacttcagtacctatggcatgcacgtgggtccnccaggctccgagggcaaggggctgggagtggggtgccctacttatagtggtatgatggggaaataaactaaatactatgactagactcggtagaacgggtcagttcacatctaccagacacaaatcaaagaactcgactagtactcgtagactaaagtacgaacaggaccaggaacgacggacccggaaagggaccgacggggtaccttacggtagttaccttaacggtgtcggacggtaacggacgtaacgtttagtttaaccgg

SEQ ID NO: 428290 - DNA, 506 bp, Homo sapiens
  misc_feature: GZ8MTXP02FKZX4.44.85.H08.1.454.CMB.2.raw
  modified_base (307)..(307): a, c, t, g, unknown or other
  modified_base (348)..(348): a, c, t, g, unknown or other
  modified_base (479)..(479): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgatcttttaagaggtgtccagtgtcaggtgcagctggtggagtcgtgggggaggcgtggtccagcctgggaggtccctgagactctcctgtgcagcgtctggattcacctttcagtacctatggcatgcacgtggggtcccnccaggcctccgaggcaaggggctggagtggggtgccattanatggtatgatggaaagtaaataaatactatgcagactccgtagaaggccgatcacatcacagagacaataccaaagaacacgctagtatctgacaaatgaacagcctagagagccgaaggacacggctgtntataacgtgtcgcgaggacagtattag

SEQ ID NO: 428291 - DNA, 600 bp, Homo sapiens
  misc_feature: GZ8MTXP02JC9T9.44.85.H08.1.454.CMB.2.raw
  modified_base (306)..(306): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccgtgggaggtccctgagactctcctgtgcagcgtctggacttcaccttcagtacctagtggcatgcacgtggtccncaggctccgagggcaaggggctgggagtggggtgcctagttatagtggtatcggattggggaaattaacgtaaattactagtagcaacgtacgtacgtacgtagggaccggtacgtactacccactccgtacacgaagacgtaactaacctaacgaaaccgacgtaccgtacgtacgtactacgtacaaactaacgacgaacgtacgtacgaggaacggaccggaacgggaacgacggtaccgtacggtgttagttaacgtcgtaggtacggacggaacaactttagttaacgg

SEQ ID NO: 428292 - DNA, 549 bp, Homo sapiens
  misc_feature: GZ8MTXP02G7WM9.44.85.H08.1.454.CMB.2.raw
  modified_base (306)..(306): a, c, t, g, unknown or other
  modified_base (335)..(335): a, c, t, g, unknown or other
  modified_base (378)..(378): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctgggtggagtcgtgggggagcgtggtccagccgtgggacgtccctgacgctctcctgtgcagcgtctggattcacttcagtacctatggccatcgcacgtgggccnccaggcctccgagggcaaggggctggggngtggggtgcctacttatatggtatgatgggaaattaataaatntatgacagtactcgtagacggccagttcactctctaccagacacaattaccaaagaaccacgtactagtactaccagactaaagtgaaacacgaccgttagacggacgaccggaacggacaacggtcgtagtcgttaagtaacgtggtacgacgtagactagtagtttacg

SEQ ID NO: 428293 - DNA, 617 bp, Homo sapiens
  misc_feature: GZ8MTXP02FW0U2.44.85.H08.1.454.CMB.2.raw
  modified_base (303)..(303): a, c, t, g, unknown or other
  modified_base (343)..(343): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctcctgtgcagcgtctggattcaccttcagtacctatggcatgcacgtgggtcccncaggcctccaggcgaaggggctgggagtgggtgcctattnatggtatgatgggaaataataaatactatgacagtactccgtaggaacgggccgtaattccaccacttctacccgaagaacgtaactaaacttaccccgaaaaggaaacccctacggtaccttacggttaacttacccgtaggaaacctaaaagttacgaaaccgaacgtaccgtaggaaacggacggacccggaagggaaccgaacgggtcgttaggtcgttaattaaccgtaggtacggacggtaaggtaacctaaggttacgtttaaacgg

SEQ ID NO: 428294 - DNA, 575 bp, Homo sapiens
  misc_feature: GZ8MTXP02H4TW0.44.85.H08.1.454.CMB.2.raw
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtctgggggaggcgtggtccagccgtggggaggtccctgagactctcctgtgcagcgtctggattcaccttcagtacctatggcatgcactgggtcccgccaggctcccgagggcgaagggggctaggggaggtggggtggcctacgtttatagtgggttatggattggggaaagttaaactaaaattactatggacctaagaaccttccgagaacggggcctatccactatctacccgaagtacgaacaatttacccaaagaaactaccgctagtaatctagactaaaatgaaccagccctaggacgacgccgaaggaccacgggactgttagtacttaacgtggagtacggaggactaattagtag

SEQ ID NO: 428295 - DNA, 534 bp, Homo sapiens
  misc_feature: GZ8MTXP02F00ZN.44.85.H08.1.454.CMB.2.raw
  modified_base (300)..(300): a, c, t, g, unknown or other
  modified_base (343)..(343): a, c, t, g, unknown or other
  modified_base (350)..(350): a, c, t, g, unknown or other
  modified_base (395)..(395): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctgggctcaccgtcagcagcaactacatgagttggtccnccaggctccgagggagggctgggagtgggtctcagtctattanactggtntatttcactatactacgcagtactccgtgaacggccatcacatcnccgaggacaattccagaaactacggttactcgttacaaatacgaaacaaccgtgaacgacggcgacgacacggcctacgtattactgtagcgagtaacagtcggcgtcgtacggtacgtggtttatacgtttcgtttag

SEQ ID NO: 428296 - DNA, 589 bp, Homo sapiens
  misc_feature: GZ8MTXP02ISKPU.44.85.H08.1.454.CMB.2.raw
  modified_base (306)..(306): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggtccagcctgggagtccctgagctctcctgtgcagcgtctggattcaccttcagtacctatggcatgcacgtggggtcccnccaggcctccgagggcaaggggctgggaggtggggtgccctacgttatagtggtatggatggggaaataaataaatactatgacaagactcgtaggaacggcgattcaccatctcgaagtacgaactaaacttccaaaagaaccacgtactagtaactccgtagactaaaagtacgaaacacgaccgtaggaacggacggacccggaaggtaaccgacggggtcttaggtcgtttaaagttaacgtggtacgaccggtaaggtactaagtttacgtttaacgg

SEQ ID NO: 428297 - DNA, 565 bp, Homo sapiens
  misc_feature: GZ8MTXP02IKEIU.44.85.H08.1.454.CMB.2.raw
  modified_base (309)..(309): a, c, t, g, unknown or other
  modified_base (353)..(353): a, c, t, g, unknown or other
  modified_base (521)..(521): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggtccagccgtggggagtccctgagactctcctgtgcagcgtctggattcacctttcagtacctatggcatgcacgtgggtcccnccaggcctccgagggcgaaggggctgggagtggggtgccattanatggtatgatgggaaataaataaagtactatgacagacctcggtaggaaacggggccctaattccgaacctatactaccagaacgactaaattacccaaaagaaccacgtctagtactcgtgaactaaaatcggaaactacgccgtagaacgagacccgaggtaaacncgggactggtatagttaactggtcgacggagactatatttacgg

SEQ ID NO: 428298 - DNA, 706 bp, Homo sapiens
  misc_feature: GZ8MTXP02HFTPU.44.85.H08.1.454.CMB.2.raw
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcgttgggttttcctcgttgcttcttttaagaggtgtccagtgtcaggtgcagctgggtggagtcgtgggggagcgtggtccaggccgtggggacgtccctgagtctctccgtgtgcagtcgtcgtggtacttccgaccctttcacgttaccctagtcggctagtcggccgtacggtcggggtccccgaccgacggggccctaccggagggaccggaaagggggtcgtagggggtaggtcgggggttcggacccgttaaacgtttagttaaggttgggttaatgggtaagttagggggtaaaattaaaacgtaaaattacgtaagtcggaaactacggtaaccgttaccgggtaaggaaaccggggtacccgtaacttacccaaccgtacttacctaccgtaaagaacgtaaacctaaacgttaacccgaaaacggaacctaccggtacttacggtaactcctaggaactaaagacgaaacacgtacgtacgaacgacggacggacgacgacgggtcgtacgtagtacgtgtagacgacgagtactaagttacgtacg

SEQ ID NO: 428299 - DNA, 716 bp, Homo sapiens
  misc_feature: GZ8MTXP02GYVF3.44.85.H08.1.454.CMB.2.raw
  modified_base (257)..(257): a, c, t, g, unknown or other
  modified_base (259)..(259): a, c, t, g, unknown or other
  modified_base (307)..(307): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacgtccctgagctctcctgtncngcgctggacttcaccttcagtacctatggcatgctacgtcgggtcccnccgaggcctaccgagggaccgaagggggtctaggggacggtggggtacggacccctagtttaagtagttaggggttaatggaagttacgggggtaaaatttaaaagttaaaattacgtaagttcggacctaaaggtacccgttccggtaacggggaaacggggtacccgtaacgtttacccgaaccgttacttccgttaaccccgaaaggaaccgtaaaacctaaaactttacccccgaaaaaggtaaacccctaacggtacccttaaggttaactaccgtaagtaaaccaaaagtacgaaaccgtacgtacccgtaggaacggaacgaccggaaacggaccgacgggtacgttaggttaacgttagttaacgtggtacggacggtaggtaactacgttagtttaacgg

SEQ ID NO: 428300 - DNA, 577 bp, Homo sapiens
  misc_feature: GZ8MTXP02H7AH1.44.85.H08.1.454.CMB.2.raw
tcagacagtatatacacgaccggtgctcgatttagtatcactcagtcgcgggagctctgggagaggagcccagcactagaagtcggcggtgtttccattcggtgatcagcactgaacacagaggactcaccatggagtttgggctgagcttgggttttcctcgttgctcttttaagaggtgtccagtgtcagtgcagctggtggagtcgtgggggaggcgtggtccagccgtgggaggtccctgagactctcctgtgcagcgtctggattcaccttcagtacctatggcatgcacgtgggtcccgccgaggcctccgagggcaaggggctagggaggtggggtgccacttagtagtggtatggatggaaagttaaataaaagtactaatcggacaagacctacgtggaaacgggccgtaataccgacctatcctacccgaagacgaaacctaaacttacccgaaagaaacctacgctacgtaactactaaacaaatacgaaacacgacgtagacgacgaccgaggacacggctagtacgtattacgtgtcgacgtaggactagtagtttacgtaacg

SEQ ID NO: 428301 - DNA, 569 bp, Homo sapiens
  misc_feature: GZ8MTXP02IHTV0.44.85.H08.1.454.CMB.2.raw
  modified_base (177)..(177): a, c, t, g, unknown or other
  modified_base (253)..(253): a, c, t, g, unknown or other
  modified_base (273)..(273): a, c, t, g, unknown or other
  modified_base (300)..(300): a, c, t, g, unknown or other
  modified_base (524)..(524): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttggctgagctgggttttcctcgttgcttcttttaagnggtgtccagtgtcaggtgcagctggtgagtctgggggagcgtggtccagcagtgggagtccctgagctctcctgtncagcgtctggattcaccttnagtacctatggcatgcactgggtcccncaggcctcccgaggcgaaggggctggggacgtgggtcggactacgtttagagtgggtatgagttagggaaagttaaataaaagtctatagacagtactccgtagaacggccaattcgacctatctaccagacgaaacaaacttacaaacgtaacaccgtacttagtaactcgtagaactaaaagtagaaacagtacctagacgacgccggaaaggacgaccggnttacgtagtaagttaacgtggttacgacggtagaacgtatttaag

SEQ ID NO: 428302 - DNA, 633 bp, Homo sapiens
  misc_feature: GZ8MTXP02JRKJW.44.85.H08.1.454.CMB.2.raw
  modified_base (303)..(303): a, c, t, g, unknown or other
  modified_base (583)..(583): a, c, t, g, unknown or other
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccgtgggacgtccctggacgactctcctgtgcagcgtctggattcaccttcagtacctagtggcatcgcacgtgggtccnccaggcctcgaggcgaaggggctagggaggtgggtcgactaacttagtagtaggttataggaacgttaaggggtaaaattaaataaacttacgtagtcggacctaaacgaccgttaccggtagggaaacccgggaccgtacttaccgacctactcctaccgagacgaactaacttaccaaacgtaacaacgtctagttactacgtagaacaaactacgaacacgtaccgaggacgacggaccgaacggacgtacgggtctacggttagttacgtttacgnggtacgacggtaaggactaacgttagttacgtacgtaccgtaccgtaacg

SEQ ID NO: 428303 - DNA, 544 bp, Homo sapiens
  misc_feature: GZ8MTXP02GU6N7.44.85.H08.1.454.CMB.2.raw
  modified_base (296)..(296): a, c, t, g, unknown or other
  modified_base (367)..(367): a, c, t, g, unknown or other
tcagacagtatatacacgaccggtgctcgatttagtatcactcagtcgcggggggagaggagcccagcactagaagtcggcggtgtttccattcggtgatcagcactgaacacagaggactcaccatggagtttgggctgagctgggtttcctcgttgctcttttaagaggtgtccagtgtcaggtgcagctggtggagtcgtgggggagcgtggtccagcctgggaggtccctgagactctcctgtgcagcgtctggattcaccttcagtacctatggcatcgcacgtgggtccncaggctccgaggcaaggggctgggaggtgggtgctacttatagtggtatgatagggaataaataaatctangacagactcgagaacggcatcacatctcagacacaactacaagaacagctagtatctagactaaatacgaacacgtccgagagacggacggaagggaccacgggtctacgttagttaacgttacgtggtacgacggaaggaactaagttacgttaggtaacgtaccttaacctaccg

SEQ ID NO: 428304 - DNA, 601 bp, Homo sapiens
  misc_feature: GZ8MTXP02IRDO7.44.85.H08.1.454.CMB.2.raw
  modified_base (259)..(259): a, c, t, g, unknown or other
  modified_base (267)..(267): a, c, t, g, unknown or other
  modified_base (308)..(308): a, c, t, g, unknown or other
  modified_base (406)..(406): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcctggggaggtccctggagactctcctgtncagcgtcnggattccacttcagtacctagtggcatgcacgtgggtcccnccgaggcctaccgaggccgaaggggcgttgggaggtggggtcgacctaacgtttataggtaggttatggaatggggtaaattaaataaagtacttagngactacgaccgtcggtaggaaacggggcctattaccgacctacttacctacccgaaaggacaacctaaacgttacccgaaaagaacctacgaccttaggacttaccgagaacaaaagtgaaacagacctagacgtacggcgaacggaccgcgtacgtaggtctatcgtggtacgcggaagactagttagttaacg

SEQ ID NO: 428305 - DNA, 644 bp, Homo sapiens
  misc_feature: GZ8MTXP02HG9TJ.44.85.H08.1.454.CMB.2.raw
  modified_base (197)..(197): a, c, t, g, unknown or other
  modified_base (265)..(265): a, c, t, g, unknown or other
  modified_base (307)..(307): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtncagctggtggagtcgtgggggagcgtggtccagccgtgggagtccctgagctctcctgtgcagcgtcnggtacttccaccttcagtacctatggcatgctacgtggcccncgaggcctccgaggccgaaggggctgggaggtggggtgaccctagtttagtagtggttataggaagtaggtaaaacgttaaaataaaagttactaaatcggaactaaagtacctacccggtaaggaaacgggcccgtaattacccaacctaacttccaaccgaagaacgtaaacctaaacgttaccaaaagaaacctacgacttagtaacttacgtaacggaactaaaagtacgaaacgtacgacccgaaggacgaacggacccggaggtaaaccgacgggtcttacggtacgttataacgtggttaacgacggaagtaactaagtttagttaacgg

SEQ ID NO: 428306 - DNA, 567 bp, Homo sapiens
  misc_feature: GZ8MTXP02HEY3L.44.85.H08.1.454.CMB.2.raw
  modified_base (177)..(177): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccagcctgggaggtccctggagctctcctgtgcagcgtctggattcaccttcagtacctatggcatgcacgtcggggtcccgcaggcctacccgagggcgaagggggctggggagtggggtgccacgttatatggtatggacgtgggaaagttaaataaatactaatgacaagactccgtaggaaacgggccgtattccgacactcctaccgaagacgaactaaacttacccaaagaaccacgactagtatctagacaaatcgaactagaccgtagaacggacgaccggacggaacgaccggcgtacgtgttataaccgtgtacgcggtagactatacgttag

SEQ ID NO: 428307 - DNA, 609 bp, Homo sapiens
  misc_feature: GZ8MTXP02HURX5.44.85.H08.1.454.CMB.2.raw
  modified_base (170)..(170): a, c, t, g, unknown or other
  modified_base (188)..(188): a, c, t, g, unknown or other
  modified_base (257)..(257): a, c, t, g, unknown or other
  modified_base (301)..(301): a, c, t, g, unknown or other
  modified_base (483)..(483): a, c, t, g, unknown or other
tcagacagtatatacacgaccggtgctcgatttagtatcactcagtcgcggggggagaggagcccagcactagaagtcggcggtgtttccattcggtgatcagcactgaacacagaggactcaccatggagtttgggctgagctgggttttcctcgttgctcttttaagnggtgtccagtgtcaggtncagctggtggagtcgtgggggagcgtggtccagccgtgggacgtcctgagctctcctgtgcagtcgtcnggtacttcaccttcagtacctatggcatcgctacgtgggtcccncgaggcctccgaggcgaacggggctgggaggtggggtggctaaccttagtagtgggtataggtaataggggtaaacttaaagtaaacttagtattagacgtagtaaccgtccggtagaacggggccctattacccacctatcctaccgaagacgaactaacttaccgaaagtaaccaccgtnttacgtatctagacaaatacggaacaggtaccaggaacgacggacccggaagaccgacgggcgttacgtagttactacgtgacggacgtaaggaactaggttacttggaaccttacgtacctaccg

SEQ ID NO: 428308 - DNA, 525 bp, Homo sapiens
  misc_feature: GZ8MTXP02GY3OW.44.85.H08.1.454.CMB.2.raw
  modified_base (299)..(299): a, c, t, g, unknown or other
  modified_base (343)..(343): a, c, t, g, unknown or other
  modified_base (405)..(405): a, c, t, g, unknown or other
  modified_base (413)..(413): a, c, t, g, unknown or other
  modified_base (490)..(490): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtcctgagctctctgtgcagcgtctggattcaccttcagtacctatggcatgcacgtgggtccnccaggctccgagggcaaggggctgggagtggggtgcctacttanatggtatgaattagggaaattaaataaactacatgcaagactcgtagaaacggccatcaccntcacaganactaaatccaaagaacagctagtatctagacaaaatgaaacagaccagaagacgaccggaagtaccgaggctaggtnttaataacgtgacgacgaagacaattactttaagg

SEQ ID NO: 428309 - DNA, 534 bp, Homo sapiens
  misc_feature: GZ8MTXP02IUDO1.44.85.H08.1.454.CMB.2.raw
  modified_base (294)..(294): a, c, t, g, unknown or other
  modified_base (328)..(328): a, c, t, g, unknown or other
  modified_base (336)..(336): a, c, t, g, unknown or other
  modified_base (361)..(361): a, c, t, g, unknown or other
  modified_base (391)..(391): a, c, t, g, unknown or other
  modified_base (430)..(430): a, c, t, g, unknown or other
tcagacagtatatacacgaccggtgctcgatttagtatcactcagtcgcggggggagaggagcccagcactagaagtcggcggtgtttccattcggtgatcagcactgaacacagaggactcaccatggagtttgggctgagctgggtttcctcgttgctcttttaagaggtgtccagtgtcaggtgcagctggtggagtcgtgggggagcgtggtccagcctgggagtccctgagctctcctgtgcagcgtctggattcaccttcagtacctatggcatgcacgtgggtcccncaggcctccgaggcgaaggggctgggagtggggngctattantggtatgatagggaaataataaatntatgcagactcggagacggcatacacatcncagacacataccaagaacacgactgtactcgagaataanaacgaacacgtcgagacgacgacggaacggacgacggtctggtagttacgttcgtagtcgacggtaaggtaactagttacgttacgtaactaccgtaccctacg

SEQ ID NO: 428310 - DNA, 631 bp, Homo sapiens
  misc_feature: GZ8MTXP02IP3P2.44.85.H08.1.454.CMB.2.raw
  modified_base (179)..(179): a, c, t, g, unknown or other
  modified_base (311)..(311): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagnggtgtccagtgtcaggtgcaggctgggtggagtcgtgggggagcgtggtccagcctggggagtccctgagcctctcctgtgcagcgtctggattcaccttcagtaccctatggcatgcacgtggtcccgccnggcctccgagggcgaaggggctggaggtgggtggcctacgttatagtggtatgaagtgggaaattaaataaatactagtgacagtaccgtcgtaggaacgggccgtaatttaccgacctacttaccgtacccgaagaacgtaacctaaacttacccgaaaacgaacccgaccgtacgttacgttaactccgttagaacctaaaagtacgaaactaacgtaccctagggacgaacgggaccgaaacgggaccgaacgggtctaggttacgttaacttaacggtggtacggtaccggtaaggaacttaagttactttaacgg

SEQ ID NO: 428311 - DNA, 640 bp, Homo sapiens
  misc_feature: GZ8MTXP02JDK0U.44.85.H08.1.454.CMB.2.raw
  modified_base (315)..(315): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcggtgggggaggcggtggtccagccgtgggacgtcctgagctctctgtgcagcgtctggattccaccttcagtacctatggctagtcgctacgtcggggtacccnccgacggcctccgaagggccggaaggggctaggggacggtggggtcgcctacttagtacgtggtatgaagtaggggtaaataaataaacttacgtaatcgactaaggtacctccggaggaacggggtacctagttacccgactactcctaccaaggacaacgtaaacttacccgaaaacggtaaccacgtacgttacgtactacgtacgaactaaagtacgaaacgacgtaccgaggaacgacgaaccggaacggacgtacggacgttggttacgttacgttaacgtaggtaccggtaggtaacgaacgtagttacgtttaacgg

SEQ ID NO: 428312 - DNA, 595 bp, Homo sapiens
  misc_feature: GZ8MTXP02HK1OT.44.85.H08.1.454.CMB.2.raw
  modified_base (306)..(306): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacggtcctgagactctcctgtgcagcgtctggattccacctttcagtacctatggcatgcacgtggcccncaggctcgaggcgaaggggctaggggaggtggggtggccctaacgtttagtagttgggtatggaagttaggggaaaattaaagtaaatactatgacagactaccgtaggaaacgggccgtacttcaaccgatcctaccaaagacgaaactaaattaccaaagaacgacgactagtaatcgtagaactaaaagtacggaaacacgaccgtagaacggacggaccggaacgaccgaacgggctacggtagtattaacgtgtacggacgaaggtactaagttagtttaacgg

SEQ ID NO: 428313 - DNA, 626 bp, Homo sapiens
  misc_feature: GZ8MTXP02JYQLM.44.85.H08.1.454.CMB.2.raw
  modified_base (305)..(305): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcctgggagtccctgagactctcctgtgcagcgtctggattcaccttcagtacctatggcatgcacgtgggtcccnccaggctccgagggccgaaggggctggggagtggggtgcctacttatagtggtatgagtgggaaattaaataaatactatgacagacgtcgtagaacgggcgtatcaccatcctaccagacgtaacaattacccgaaagtaaccgacgtaccttagtacttccgtacgaacctaaaagtacggaaacctacggacccgtaggaacggaacggacccgggaaacgggaacccgaccggggtacgttacggtttacggttaaacgtttaaccggtaggttacgggaccgggtaacggtaactaaggtttaacgttttaacggg

SEQ ID NO: 428314 - DNA, 609 bp, Homo sapiens
  misc_feature: GZ8MTXP02IEO5Z.44.85.H08.1.454.CMB.2.raw
  modified_base (310)..(310): a, c, t, g, unknown or other
  modified_base (350)..(350): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggtttcctcgttgcttcttttaagaggtgtccagtgtcaggtgcagctggtggagtcgtgggggaggcgtggtccagccgtggggacgtccctgagctctcctgtgcagcgtctggactcaccttcagtacctagtggcatgctacgtggggtcccnccgaggcctccgagggcgaagggggctggggaggtggggngcctactttagagtggtatggagtagggaaataaataaatactagtgactagtaccgtcgaggtaacgggccgtaattccacctactctacccgagaacgactaaacttacccgaaaacgaacctaccgacttagtaactaccgtagaactaaagtacgaaacacgtaccgtaggaacggacggaccggaacggaccggaacggcttacggttagttaagttaacgtggtacggacgtaaggactaagttatttaacgg

SEQ ID NO: 428315 - DNA, 559 bp, Homo sapiens
  misc_feature: GZ8MTXP02H9VZJ.44.85.H08.1.454.CMB.2.raw
  modified_base (233)..(233): a, c, t, g, unknown or other
  modified_base (257)..(257): a, c, t, g, unknown or other
  modified_base (288)..(288): a, c, t, g, unknown or other
  modified_base (291)..(291): a, c, t, g, unknown or other
  modified_base (477)..(477): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcgtggtttcgcgttagctctttaagaggtgtccagtgtcaggtgcagctggtggagtgtggggaggcgtggtccagccgtgggnggtcctgagactctcctgtggccngcgtcgtgtatctactctactactagtgcangcncgtcggccgccgacggccgtaccgacggacggacgggtcggtggaggtgggtggaccgtacgttagtagtaggtagtagtagtaggtaaagtaaataaatatatgacagtacgtacgtaggaacggacgactacacactcacgacgacgaactaactaacaacgaacgacgtactacgtatacganacaagacaacacgacgagacgacggacgacggacgacgtacgtacgtagttagttaacgtgtcgacgagacgtactagttag

SEQ ID NO: 428316 - DNA, 587 bp, Homo sapiens
  misc_feature: GZ8MTXP02GMKFH.44.85.H08.1.454.CMB.2.raw
  modified_base (308)..(308): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgatcttttaagaggtgtccagtgtcaggtgcagctggtggagtcgtgggggaggcgtggtccagccgtggggacgtccctgagactctcctgtgcagcgtctggacttcaccttcagtacctatggcatgcacgtcggggccnccaggcctccgagggcgaaggggctaggggagtggggtgacctacttagtagtggtatgagtggaaataaataaatactatgacagactccgtaggacgggctatcaccatcctaccagacgactaaacttaccaaagaacacgtactagtactcgtagaactaaagtacgaaaccgacgaccgtaggaacggacggaccggaacgggaccgacggacgttaggtacgttacgttaaccgtggttacggacggaaggtaacctagttaacgtttaacgg

SEQ ID NO: 428317 - DNA, 552 bp, Homo sapiens
  misc_feature: GZ8MTXP02HO418.44.85.H08.1.454.CMB.2.raw
  modified_base (301)..(301): a, c, t, g, unknown or other
  modified_base (402)..(402): a, c, t, g, unknown or other
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgagactctcctgtgcagcgtctggattcaccttcagtacctatggcatcgcacgtgggtcccncaggcctccgaggcgaaggggctgggaggtggggtgactattagtagtggtatgataggaaagtaaataaatctatgacagactcgagacggcatcactanctcagacacaacttacaaagaacacgactagtacttcgtagactaaatacgaaacacgtccgtaggagacgacggaacggactacgggtcttaggtacgttacttacgtggtacgacggaaggactagttactgtaactacctacctacg

SEQ ID NO: 428318 - DNA, 606 bp, Homo sapiens
  misc_feature: GZ8MTXP02IIWA6.44.85.H08.1.454.CMB.2.raw
  modified_base (180)..(180): a, c, t, g, unknown or other
  modified_base (309)..(309): a, c, t, g, unknown or other
tcagacagtatatacacgaccggtgctcgatttagtatcactcagtcgcgggggagctctgggagaggagcccagcactagaagtcggcggtgtttccattcggtgatcagcactgaacacagaggactcaccatggagtttgggctgagcttgggttttcctcgttgcttcttttaagnggtgtccagtgtcaggtgcagctgggtgagtcgtgggggagcgtggtccagccgtgggagtccctgacgtctctcctgtgcagcgtctggacttcaccttcagtacctatggcatgcacgtggtccccncaggcctccgaggcgaaggggctgggacgtgggtgccctagtttatagtggtatgagttgggaaacttaaataaattactagtgacaagactcggaggaacggccgtaattccaaccgtactctaccgaagtacgactaaacgttaccaaaagaacctacgtctagtactccgtagaactaaagtacgaacagtaccgtagaacggacgaccggaacggaacgaaccggtcgttacggttagttaacgttaacggttacggtacggacggtaaaggtacttaagttacgtttaacgg

SEQ ID NO: 428319 - DNA, 630 bp, Homo sapiens
  misc_feature: GZ8MTXP02I78UB.44.85.H08.1.454.CMB.2.raw
  modified_base (278)..(278): a, c, t, g, unknown or other
  modified_base (312)..(312): a, c, t, g, unknown or other
tcagacagtatatacacgaccggtgctcgatttagtatcactcagtcgcggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggccgtgggacgtccctgacgtactctccgtgtgcagcgtctggtacttcaccttnacgtacctagtggcatcgactacgtcgggtcccncgaggcctacgaggcgaggggctgggaggtgggcgactacttagtgtaggtatagtagtaggtaaattaaataaatcgtagtcgactaacgtaccgtaccggtaagggaaaccgggtaccgtacgttacccaacctacgtaccctaccgaacgaaccgaaacgtaacttaaccgaaacgtaacaccggtactagtacttcgtaacgactaaaagtacgaaacgtacgaccgaggaaggacgaccggaaggaccgacggtagtagtacgttacgttacgtgtcgagaacgtatagttacttagtacgtacctacgtacg

SEQ ID NO: 428320 - DNA, 597 bp, Homo sapiens
  misc_feature: GZ8MTXP02HQ7C2.44.85.H08.1.454.CMB.2.raw
  modified_base (160)..(160): a, c, t, g, unknown or other
  modified_base (238)..(238): a, c, t, g, unknown or other
tcagacagtatatacacgaccggtgctcgatttagtatcactcagtcgcggggagctctgggagaggagcccagcactagaagtcggcggtgttccattcggtgatcagcactgaacacagaggactcaccatggagtttgggctgagcgtggttttccncgttaggcttcttttaagaggtgtccagtgtcaggtgcagctggtggagtcgtgggggaggcgtggtcgagccgtggnggcctgagactctcctgtgcgcgcgtcgtgtactctacctactacgtactagtgcgatcgcgcgtcggtccgcgcgcgcgacggacggagggcggtggtaggtggtggaccgtacgttagtagtagtagtagtagtaggtaaagtaaataaataagtaatagacgacgtacgtacggtacggacggacgtactactactactactacgacgacgaactaaactaacaaacgaacgtaacgtacgtacgtactacgtagaacaaactaacgaacgacgacgacgaacgacggacggacgacgacgtacgtacgttacgttacgttaacgtacgtacgacgacgtacgtaacgttagtacg

SEQ ID NO: 428321 - DNA, 566 bp, Homo sapiens
  misc_feature: GZ8MTXP02JSRWB.44.85.H08.1.454.CMB.2.raw
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgtggggaggtcccctgagactctcctgtgcagcgtctggattcaccttcagtacctatggcatgcacgtgggtcccgccaggcctccgagggcaaggggctgggagtggggtgccacttagtagtggtatgatggaaagtaaataaagtactatgacaggactccgtagaacgggccgattccgaccatcctccgaagacgaacaattaccaaagacacgctcgtatacgtgacaaatcgaaacacgtacctagacgacgaccggaacggaccgacggtacctaggttcgttaattaaccgtaggtacgacggtaggactaacgtatttacgg

SEQ ID NO: 428322 - DNA, 662 bp, Homo sapiens
  misc_feature: GZ8MTXP02G2BV2.44.85.H08.1.454.CMB.2.raw
  modified_base (322)..(322): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcggtgggggagcgtggtccaggccgtggggacgtccctgacgacttctcctgtgcagcgtctggattccacctttcacgtacctagtggactagtgctacgtggggtcccnccgagggcctccgaagggtcgaaggggctggggaggtggggtgcccctagttataggtgtagtgagtagggtaaagttaaataaattcctaagtcgacgagtaccgttccggtaggaaacggtccgtattacccgaacctactaccgtacccgaaaggaacctaactaaaacttacccgaaaacgaaccgtacgtacttaggttaactacccgtagaacctaaaagtacgaaacctacggtacccgtaggaaccggacggaccggaacggaaccgtacggtcctaggtacgtttagtaaccgttggacggtacgaaggtacttaacgttagtttaaccgg

SEQ ID NO: 428323 - DNA, 651 bp, Homo sapiens
  misc_feature: GZ8MTXP02GVJTS.44.85.H08.1.454.CMB.2.raw
  modified_base (307)..(307): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgacgactctcctgtgcagcgtctggtattccaccttcagtacctatggcatgcacgtcgggcccncgaggcctcgagggcgaaggggtctggggagtggggtcgcctacgttatagtggtatgagtgggtaaataaataaagtactagtcgactacgtacgtcggtaggaacgggccgtaacgttaccaaaccctactaccgtaccgaacgtaacgaacctaaacttacccgaaaaggtaacctaaccggtacttaacggttactacctaaggaacctaaaagtacgaaaccgaacgtacccgtaagggacggacggacccggaaacgggaccgaacgggtccgttaacggttacgtttaacgttaaccgtcggtacggacggaaggtactaaggtttaacgtttaagg

SEQ ID NO: 428324 - DNA, 720 bp, Homo sapiens
  misc_feature: GZ8MTXP02I348W.44.85.H08.1.454.CMB.2.raw
  modified_base (264)..(264): a, c, t, g, unknown or other
  modified_base (303)..(303): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagccgtgggaggtccctgagactctcctgtgaagcctntggatttagttcagtagttctggcatgcacgtgggtccnccaggcctccgaggccgaagggggcccggtaggtcgggttggctagttagtaggcctagtagtgaagttcggaaactttcgtagtattattatcgactaagtaccgttcccggtaggaaacggggtcccgtaatttacccgaaccctagttaccctacccgaaaggtaaccgtaaaccctaaaaccgtttcccccgggaaaacctaccgttaccgttaccgggttaaacccgtaaggggtaaaacttcggaaacttccgaaacggtccccgttaaggaaacgggacggggtaccggaaacggggtacccgttaccgggtccgtttaccgtttagggttaaacctttaccgtacggttcggaaccggtaagggtacggtttacgggggaaagttcggggaccgtaagggacctaaggg

SEQ ID NO: 428325 - DNA, 668 bp, Homo sapiens
  misc_feature: GZ8MTXP02GAGFP.44.85.H08.1.454.CMB.2.raw
  modified_base (243)..(243): a, c, t, g, unknown or other
  modified_base (275)..(275): a, c, t, g, unknown or other
  modified_base (300)..(300): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtcccngagctctctgtgcagcgtctggattcaccttnagtacctatggcatgcacgtggccncaggctccgaggcgaaggggctggggacgtggggtcgcctacttatagtggtataggaagttagggggaaaacttaaattaaaacgttacgttaagtagacccgtaaagaacccgttaccggtaaggaacgggggtacccctaatttcccgaaccctacttacctacccgaagaacgaacctaaaacgtttacccaaaacggaaccacggtaccgtttaagttacgttaccctaggaacctaaaattacggaaacaaacgggcccttaaggaaacggacgacccgggaaggaaccgacccgggtacttacgggttatttaaacgtccgtaggttaggaccgaacggtaactagtttaaactttacggg

SEQ ID NO: 428326 - DNA, 756 bp, Homo sapiens
  misc_feature: GZ8MTXP02JOAYR.44.85.H08.1.454.CMB.2.raw
  modified_base (256)..(256): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcgtggtttcgtcgtaggctctttaagaggtgtccagtgtcaggtgcagctggtggagtctgggggagcgtggtccagcctgggaggtccctgagactctcctggtcncgagtcgtcgtaggtacttccaccttcgaacgttacctagtcggtactagtcgaccgtacggtcgggtacccgaccggacggtccgtaccggacgggtaccggtaacggggtcgtaggggtacggtcggggtacggtaccccgttaacgttagttacggtacgggttaagtaggtaaggttaagggtaaaagttaaaacgttaaaacgttaacgtagtacgtaaccgtaacggtaacccgttaccgggtaaacggtaacgggtaccgttaacgttacccgaaccgtaccgtaccgtaaccgaaacgaaccgtaaaccgtaaacgtaaccgtaaacgaaaccgtaccgtaccgttacgtaacgtacgtacgtaacgtaaacgtaacgtaacgtaacgtacgtacggaacggacggaccggaacggacggtacggtacgttacggtacgttaacgttaacgttacgtacgtacggtaacggtaacgtaacgttaacgttacg

SEQ ID NO: 428327 - DNA, 586 bp, Homo sapiens
  misc_feature: GZ8MTXP02J24Y2.44.85.H08.1.454.CMB.2.raw
  modified_base (276)..(276): a, c, t, g, unknown or other
  modified_base (305)..(305): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggacgtccctgagactctcctgtgcagcgtctggattcaccttnagtacctatggcagtgcacgtcgggtccnccaggctccgagggcaaggggctggggagtggggtgccctactttagtagtggtatggattgggaaagttaaataaagtctaatcgacaacgacctaccggtagaacgggtccgtattccaccgactaccacgaacgtacaactaccgtaacgaaccacgcctagtactactacgacgtaaacagaacgacgacgacgagacggaccggacggacgtaccggacgtacgtagttacgttacctggtacggacgacgggtaactacgttacgttagtaaccg

SEQ ID NO: 428328 - DNA, 683 bp, Homo sapiens
  misc_feature: GZ8MTXP02JBRDT.44.85.H08.1.454.CMB.2.raw
  modified_base (276)..(276): a, c, t, g, unknown or other
  modified_base (309)..(309): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctcctgtgcagcgtctggacttcaccttnagtacctatggacagtgctacgtcggggtcccnccgaggcctccgagggcgaagggggtctggggacggtggggtcgaccctaacgtttagtagttggggttatagggaattagggggtaaaattaaaactaaaagttacctaagttcgaacgtacggtaacccgttccgggtaaggaaaccggggtcctaactttaccgaaaccctactacccgtacccgaaagggaaaccgtaacctaaaacgtttaaccccgaaaacggtaaccctaaccgtaccgttaggtaacttaccgtagaacctaaaatacggaacacgtacgagaacggacgaccggaacggaaacgcggtactacgttagttaacgttccgtaggtacggacgaaggtactaagtttaacgttaacg

SEQ ID NO: 428329 - DNA, 569 bp, Homo sapiens
  misc_feature: GZ8MTXP02HQKZ2.44.85.H08.1.454.CMB.2.raw
  modified_base (281)..(281): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggccgtgggacggtccctgagactctcctgtgcagcgtctggattcaccttnagtacctatggcatcgctacgtcggtcccgccaggcctccgaggccgaaggggctagggaggtgggtggccctacgttatagtgggtatggagtggaaagttaagaaatactatagcacgactacgtaggaggaccgacgtactacactactacacgagaacaacttacaaacaacgtacgactacgtactactacgtacaaacgtacgaacgaacgacgacgagacgaccgacgacgtacgacgtacgttagtacgtaacgtgtacgacgaggactaacttattacg

SEQ ID NO: 428330 - DNA, 506 bp, Homo sapiens
  misc_feature: GZ8MTXP02FQ61X.44.85.H08.1.454.CMB.2.raw
  modified_base (305)..(305): a, c, t, g, unknown or other
  modified_base (349)..(349): a, c, t, g, unknown or other
  modified_base (405)..(405): a, c, t, g, unknown or other
  modified_base (421)..(421): a, c, t, g, unknown or other
  modified_base (427)..(427): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcgtctggattcaccttcagtacctatggcatgcacgtgggtccnccaggctccgagggcaaggggctgggagtggggtgcctacttanatggtatgatggaaagtaataaatctatgcagactcgtagaagggcattcacatcncagagacaactcaaanacacgntagtatctagacaaatgaacagcctagacgagccgaggacacggctgtagtataacgtgtcgacgagacagtattacgg

SEQ ID NO: 428331 - DNA, 566 bp, Homo sapiens
  misc_feature: GZ8MTXP02HWNDP.44.85.H08.1.454.CMB.2.raw
  modified_base (161)..(161): a, c, t, g, unknown or other
  modified_base (275)..(275): a, c, t, g, unknown or other
  modified_base (300)..(300): a, c, t, g, unknown or other
  modified_base (465)..(465): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtggagtcgtgggggagcgtggtccagcctgggagtcctgagactctctgtgcagcgtctggtattcacctttnagtacctatggcatgctcgtggccncaggcctccgaggcgaaggggtctgggaggtcggggtgacctacgttatagtggtatggatggaaagttaaataaatataagtgacagactaccgtaggaaggccgtatcgaccatcctacagacgaactaacttaccaaagacacgctagtatctagactaaanacgaacagtccgagacggacgaccgggacgaaaccgccgggtactacggttagttacttaacggtagtacggaccgtaaggtaactaagttagtttaacgg

SEQ ID NO: 428332 - DNA, 687 bp, Homo sapiens
  misc_feature: GZ8MTXP02IDCBK.44.85.H08.1.454.CMB.2.raw
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccagccgtgggacggtccctgagactctcctgtgcagcgtctggacttcacctttcacgtacctagtggccagtcgctacgtcggggtccccgcccgaggtcctacccgagggtaccgaagggggctaggggaggtggggtcgaccctactttagtagtaggtaatggaagttaggggtaaaagttaaaattaaaacgttacttaagtcgaactagtacccgttaccggaggaaacggggtccctaacgtttacccaacccgtacgttaccctacccgaaagggactaaaccgtaaaactttaacccgaaaacggtaacctaaccggtactttaggttaacttcccgtaaggaactaaaagtacgaaaccaggtaccctaggaacggacgaccgggaaacgaccgacggtacttcggttattagtaacgtgtaggtaccggaagtactagtttagttaacg

SEQ ID NO: 428333 - DNA, 702 bp, Homo sapiens
  misc_feature: GZ8MTXP02JOHI6.44.85.H08.1.454.CMB.2.raw
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgttggggaggcgtggtccagccgtgggagtccctgagactctcctgtgcagcgtcgtggtattccaccttcagttaccctagtggctatcgcacgtcgggtccgccaggctccgaggcgaaggggcgtagggacggtggggtggaccctacgtttagtagtgggtataggaagtaggggtaaaattaaagtaaactacgtaagtacgacaaggtaccgtcggtaaggtaaacgggacccgtatttcccaaaccgtactacctacccgaagaacgaaactaaacgttaacccgaaaagaaacccgtacgtaccgttaggtacttaccgtaagaaccctaaaagttcgaaaaccgtgacccgttaggaaaacgggacgacccgggaaacgggtaaaccgaccgggttaccgttaacggttagggtttaaactttaacggtacggttaacggggaccggtaaaaggggtaccttaaaggttacgttttaaaccggg

SEQ ID NO: 428334 - DNA, 593 bp, Homo sapiens
  misc_feature: GZ8MTXP02F98OH.44.85.H08.1.454.CMB.2.raw
  modified_base (563)..(563): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggagtccctgagctctcctgtgcagcgtctggattccaccttcagtacctagtgcatgcacgtgggtcccgccaggcctccgagggccgaagggggctggggaggtggggtcggacctacttagtagttggtatagagttaggggaaacttaaattaaaatacgtatagacgaacgtaccgtaccggtaggaaacggggtccgtaacttacctaacccaactcctaccgagaacgaactaaacttaaccaaacgaacctacgtacttaggtaatcctagaccaaagtacgaacagtaccgagaacgacgacggaacgacgcgactggtntacgtcgcgtgacggagtacattagttacg

SEQ ID NO: 428335 - DNA, 545 bp, Homo sapiens
  misc_feature: GZ8MTXP02HMT0D.44.85.H08.1.454.CMB.2.raw
  modified_base (437)..(437): a, c, t, g, unknown or other
  modified_base (458)..(458): a, c, t, g, unknown or other
  modified_base (463)..(463): a, c, t, g, unknown or other
  modified_base (465)..(465): a, c, t, g, unknown or other
  modified_base (468)..(468): a, c, t, g, unknown or other
  modified_base (470)..(470): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcgtggtttcgtcgtaggctctttaagaggtgtccagtgtcaggtgcagctggtggagtcgtgggggaggccgtggtccagccgtggggacggtccctgacgtctctccgtgtgcagtcgtctggattcacctttcagtacctagtggcatcgcacgtcgggtcccgccgaggcctaccgagggcgaaggggctgggaggtgggtgacctacttagtgtaggtatgaatgggaaattaaataaatactagtgactagactcggtagacgggctattacacatctcaganaacataccaagacagctgtancgtananaananacagacgagacgacgacgacgacgacgtcgtacgtagtagtaacgtcgtacgtacgtacgacgtacgttagtacg

SEQ ID NO: 428336 - DNA, 529 bp, Homo sapiens
  misc_feature: GZ8MTXP02JBYGZ.44.85.H08.1.454.CMB.2.raw
  modified_base (266)..(266): a, c, t, g, unknown or other
  modified_base (306)..(306): a, c, t, g, unknown or other
  modified_base (437)..(437): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctgggtggagtcgtgggggaggcgtggtccaggcctgggagtccctgagctctcctgtgcagcgtcnggattccaccttcagtacctatggcatgcacgtgggtccnccaggctccgagggcaaggggctgggagtggggtgcctacttatagtggtatgatgggaaataaataaatactatgacagactccgtagaacgggcgatcacatcacagacacaaataccaaagaacacgntacgtatactagacaaatcgaaacagactagacgacgaccggaggacacggctagtagtataacgtgtaggacggtagactagttatttacg

SEQ ID NO: 428337 - DNA, 542 bp, Homo sapiens
  misc_feature: GZ8MTXP02FKKQZ.44.85.H08.1.454.CMB.2.raw
  modified_base (304)..(304): a, c, t, g, unknown or other
  modified_base (352)..(352): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcctgggagtccctgagctctcctgtgcagcgtctggattcaccttcagtacctatggcatgcacgtggggtcccnccgaggcctccgaggcgaaggggctggggagtggggtgacctagttanagtggtatggatggaaataataaatcatgacagactcgtagaaggcgatcacatctcgagacgaacaaactaccaaagacacgctagtatcgtagacaaatgaaacagcctagaacgacgaccggaacggaccgacgggctaggtacgttaagtaacgtggtacgacggaagacgtacgtacgtttacgg

SEQ ID NO: 428338 - DNA, 511 bp, Homo sapiens
  misc_feature: GZ8MTXP02JWJJK.44.85.H08.1.454.CMB.2.raw
  modified_base (300)..(300): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcgtctggattcaccttcagtacctatggcatgcactgggtccnccaggctccaggcaaggggctggagtgggtggccacttatatggtatgatgggaaataaataaatactatgacagactccgtgaagggccgattcacatctccagagaacaaattaccaaagaacacgctagtatctagacaaaatgaaacagacctagagagccgaagggacaacggctagtgtattaacgtgtagcgaggacatattag

SEQ ID NO: 428339 - DNA, 719 bp, Homo sapiens
  misc_feature: GZ8MTXP02HWHHY.44.85.H08.1.454.CMB.2.raw
  modified_base (259)..(259): a, c, t, g, unknown or other
  modified_base (267)..(267): a, c, t, g, unknown or other
  modified_base (677)..(677): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgtcttcttttaagaggtgtccagtgtcaggtgcagctggtggagtcgtgggggagcgtggtccaggccgtggggacgtccctgagctctctgngcagcgtnggtattcaccttcagtacctagtggacagtcgacctacggtcggggtccccgacccgagggtccctacccggagggaccggtaaaggggggtcctagggggaagggtttcgggggtacggacccttaacgttttaagtacgtttaggggttaaattgggtaaagttacggggtaaaaaagtttaaaattaaaaagttaccgttaagtacgacgtaaacggtaacccgttaccgggtaaggaaaacggggtaaccgtaaactttacccgaaaccctactttaaccctacccgtaaaggaaaccgtaaaccctaaaacgttaacccgaaaacgtaaaacccgtacgtacttacgtactacgtagaactaaagtacgaaacacgtccgaggacgacggacggacgaacgacgngtacgtagttactaagtcgtagacgaagtactagttattacg

SEQ ID NO: 428340 - DNA, 584 bp, Homo sapiens
  misc_feature: GZ8MTXP02JL1LD.44.85.H08.1.454.CMB.2.raw
  modified_base (281)..(281): a, c, t, g, unknown or other
  modified_base (560)..(560): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggtccagccgtgggagtccctgagtctctcctgtgcagcgtctggattccacctttnagtacctagtggcatcgcacgtggggtcccgccgaggcctccggagggacgaaggggctgggaggtggggtagcctaacgtttatagtggtatggtataggggaaagttaaataaatacgtataggacacgtacgtacggtaggaacggctacttccgactactcctaccgaagacgaactaaactaccaaagaactaccgacttagactactagaactaaagtaggaaccagtccaggaacgacggacgacggacgaccgtcgtagtacgtataacgngtacgacgagtactagttattacg

SEQ ID NO: 428341 - DNA, 637 bp, Homo sapiens
  misc_feature: GZ8MTXP02GURKV.44.85.H08.1.454.CMB.2.raw
  modified_base (305)..(305): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctctgtgcagcgtctggattcacctttcagtacctagtggcatgcacgtcggggtccnccaggcctccgagggcgaaggggctggggaggtggggtggacctacgttatagtgggtatggagtagggtaaagttaaataaatactatgacaagtacctccggtaaggaacggggtccgtaacttacccaaccctacgtacctaccgaagaaacgaacctaaacgttacccgaaaacgtaaacctacgtaccttaggtaactcgttacggaactaaagtacgaaactacgaccgtaggaacggacggaccggtaacggaaccgacgggtcgttacggttacgttaacgttaacgtaggtacggacggtaaggtactaacgttagtttaacg

SEQ ID NO: 428342 - DNA, 637 bp, Homo sapiens
  misc_feature: GZ8MTXP02GUEP8.44.85.H08.1.454.CMB.2.raw
  modified_base (309)..(309): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctgggtggagtcgtgggggagcgtggtccagccgtgggacgtccctgagactctcctgtgcagcgtctggattcacctttcagtacctagtggcatgcacgtgggtcccnccaggcctccgagggcgaagggggctggggaggtggggtgaccctagtttagtagtggtatgaagttgggaaagttaaataaaattactaagtgacaagtacgtccggtaggaacggggccgtagttaccaccgtactcctaccgagtaacgaacctaaacttacccgaaaagtaacccaccgtaccttaggtacttacgtacgaacctaaagtacggaaacacggtcccgtaggaacggacggacccggaaacggaccggaaccgggtcgtacggttaggttacgttaacgtggtacggacggaggtactaagtttacgtttaacgg

SEQ ID NO: 428343 - DNA, 610 bp, Homo sapiens
  misc_feature: GZ8MTXP02JR5RK.44.85.H08.1.454.CMB.2.raw
  modified_base (319)..(319): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccagccgtggggacgtccctgacgactctcctgtgcagcgtctggattccacctttcagtaccctagtcggcagtcgctacgtcggggtcccnccgaggccctccgagggcgaaggggctggggaggtggggtgacctacgttagtgtggtataggagtagggaaattaaataaatactatcgacagactcggtaggacggcctataccacctactcctaccagacgaactaactaccaaagtaacccagtactagtactacgacgaaactaaagtacgaaacgacgtacccgaggaacggacgacccgggaacggaaccgaccgggtacgtggttaacgttagttaaccgtggtacggacgaaggtactacgttagtttaacg

SEQ ID NO: 428344 - DNA, 538 bp, Homo sapiens
  misc_feature: GZ8MTXP02F9PSK.44.85.H08.1.454.CMB.2.raw
  modified_base (304)..(304): a, c, t, g, unknown or other
  modified_base (345)..(345): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgacgactctcctgtgcagcgtctggattcaccttcagtacctatggcatgcacgtggtcccncaggctccgaggcaaggggctgggaggtgggtgcctattanagtggtatgatgggaaataaataaatatatgacagactcgtagaacgggcagttcacctatcctacagtaacgactaaacgttaccaaagaacacgtactagtactactagacaaatagaaacagcctaggacgacggaccgacgaacgacgtcgtagtgttaatcgtagtcgacgagactagttagttaacg

SEQ ID NO: 428345 - DNA, 547 bp, Homo sapiens
  misc_feature: GZ8MTXP02GGJ1S.44.85.H08.1.454.CMB.2.raw
  modified_base (195)..(195): a, c, t, g, unknown or other
  modified_base (523)..(523): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggtccagccgtgggacgtccctgagctctcctgtgcagcgtctggattccaccttcagtacctatcggcatgcacgtcggtcccgccaggcctccgagggcgaaggggctgggaggtggggtgcctattatagtggtatgatggaaataataaatactatgacagacgtcgtaggaacggccattaccactactcctacagacgaactaactaccaaagaacacgtcgtagtatctagactaagtacgaacacgacctagacgacgaccggaaacgaccgacggtctacgtgttattaacgnggtacgacgacgacgtatacgtag

SEQ ID NO: 428346 - DNA, 592 bp, Homo sapiens
  misc_feature: GZ8MTXP02GTX3Q.44.85.H08.1.454.CMB.2.raw
  modified_base (311)..(311): a, c, t, g, unknown or other
  modified_base (393)..(393): a, c, t, g, unknown or other
  modified_base (499)..(499): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccaggtgtcaggtgcagctgggtggagtcgtgggggagcgtggtccaggcctggggacgtccctgacgctctctgtgcagcgtctggattccaccttcagtacctatggcatgctacgtcgggtccnccgaggctccgagggcgaaggggctggggagtggggtcgcctacttatagtggtatggatggggaaattaaataaatctagngacagactaccggtaggaacggccattccaccagtcctaccaagacgaactaaacttacccaaaaggacaacggtctagtaactcctagaactaaaatcgaaaccngaccgtaggaacgacggaccggaaacggacgacggtcgttagttacgttaacttaacgtgtacggacgtaaggtactagtttacgtttaacgg

SEQ ID NO: 428347 - DNA, 580 bp, Homo sapiens
  misc_feature: GZ8MTXP02HY3AC.44.85.H08.1.454.CMB.2.raw
  modified_base (289)..(289): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagttttgggctgagcggtggtttcgtcgtagcgtctttaagaggtgtccagtgtcaggtgcagctggtggagtcgtgggaggcgtggtccgagccgtgggaggtccgtgagactctcctgtgcagcgtctggatcacttcacgtacctatggnatgcgacgtcggtccgccgacgcgtccgacggacggagggcgtggaggtgggtggaccgtacgtagtagtagtagtagtagtaggtaaagtaaataaagttaactatagacgacgacgtacgtacggacggcgtacgtacactactacgtacacgacgaactaactaacgaaacgaacgacgacgtacgtagtacgtacgtactaacgaacgaacgacgacgacgacgacgacgacggacgacgacgtacgtagttacgtaacgtcgtacgacgagtacgtaactagtacg

SEQ ID NO: 428348 - DNA, 553 bp, Homo sapiens
  misc_feature: GZ8MTXP02GVS23.44.85.H08.1.454.CMB.2.raw
  modified_base (297)..(297): a, c, t, g, unknown or other
tcagacagtatatacacgaccggtgctcgatttagtatcactcagtcgcggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtacctatggcatgcacgtgggtcccncaggcctccgaggcaaggggctgggagtggggtgctacgttatagtggtatgatgggaaataataaatctatgacagcctcggtagaacgggccattccacctatctaccgagacgactaattaccaaagaacacgctagtactcgtagactaaatagaaactcgacctaggagacgacggaaggaccacggggctacggtagtaacttacgtggtgacgtaaggactacgttattagtactaccgtaacctaccg

SEQ ID NO: 428349 - DNA, 641 bp, Homo sapiens
  misc_feature: GZ8MTXP02HW3ZI.44.85.H08.1.454.CMB.2.raw
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtgggagtccctgagctctctgtgcagcgtctggattcaccttcagtacctatggcatgctacgtcgggtcccgccaggtcctaccgagggcgaaggggctgggaggtggggtgcctacgttagtacgtggtatacgagtagggaaacgttaaaataaattactagtggactaaggtaccgtccggtaggaacggggtcctacgttacccgactacgttacctaccgaaggaacaacctaaagttacccaaaacgaaaccgtacgtacttagtaacgtctacgaactaaaagtacgaaacgtacgaccgtagaacggaccggaccggaacggaaccgacggtccgttaggttacgttaacgttaaccgtaggtaccgtaacggtagtaacgtacgtttaagtttaacg

SEQ ID NO: 428350 - DNA, 580 bp, Homo sapiens
  misc_feature: GZ8MTXP02GOQA3.44.85.H08.1.454.CMB.2.raw
  modified_base (308)..(308): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggagcgtggtccagccgtgggagtccctgagctctcctgtgcagcgtctggattcacctttcagttacctatggcatgcacgtcggggtcccncaggcctccgagggcgaaggggctggggagtggggtgcctacttatagtggtatggatgggaaattaaataaatactatgcagactccgtagacgggccgtattcacctatcctaccgaagacgaactaaacttaccaaagaacacgctagtactctagacaaatagaaacacgacctaggaacggacggaccggaacggaaccgacggtacgttacggtagttaagttaacgttggtacggtaccggaaggaactagtttaacgtttaagg

SEQ ID NO: 428351 - DNA, 578 bp, Homo sapiens
  misc_feature: GZ8MTXP02I7Q3A.44.85.H08.1.454.CMB.2.raw
  modified_base (278)..(278): a, c, t, g, unknown or other
  modified_base (289)..(289): a, c, t, g, unknown or other
  modified_base (309)..(309): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcggtgggggaggcgtggtccagccgtgggacgtccctgagctctctgtgcagcgtctggattcaccttnacgttacctanggcatgctacgtgggtcccncaggcctccgagggcgaaggggtctaggggagtggggtgcctacttagtagtggtatgagtgggaaacttaaataaatactagtcgactagacctcgtaggaacgggccgtatcactactctacaagacgaactaacttaccgaaagaacacgctagtaactcctagactaaagtacgaaactgaccgtagaggacgacggacgaacggacgtcgttacggtgttaacgttaacgtggtacgacggaaggtactaagttagtttaacgg

SEQ ID NO: 428352 - DNA, 605 bp, Homo sapiens
  misc_feature: GZ8MTXP02I9O8G.44.85.H08.1.454.CMB.2.raw
  modified_base (198)..(198): a, c, t, g, unknown or other
  modified_base (205)..(205): a, c, t, g, unknown or other
  modified_base (213)..(213): a, c, t, g, unknown or other
  modified_base (216)..(216): a, c, t, g, unknown or other
  modified_base (223)..(223): a, c, t, g, unknown or other
  modified_base (253)..(253): a, c, t, g, unknown or other
  modified_base (263)..(263): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcggtggtttcgcgtaggcgtctttaagaggtgtcagtgtcaggtgcagntggtggngtgtgggnggngtgtcgngcgtggacgtccgtgagctctcgtgtgcgngcgtcgtgtnttctactactagtactgtgcatgacgagtcggtccgccgacgcgtcgacggacggagggtcggtggtaggtgggtcgacgtacttagtagtagtagtagtagtagtaaagtaaataaatagtatagacgacgtacgtacgtaggaacggacgtactacctactactactacgaacgaacgaacgtaacgtaacgaaacgtaacgaccgtacgtagtacgtacgtacgaacgtaaagtaacgaacgacgacgtacgaacggacggaccggaacggaccggacggtacgtacgttagttaacgttaacgtgtacggacggtaagtacgtacgttaacgttaacg

SEQ ID NO: 428353 - DNA, 758 bp, Homo sapiens
  misc_feature: GZ8MTXP02HR2TW.44.85.H08.1.454.CMB.2.raw
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgagactctcctgtcgcagcgtctggtacttccacctttcacgttacctagtcggaccagtcgccgtacgtcgggtccccgcgaggtcctccgagggcgaaggggctaggggtagtggggtcgccctaacgtttagagttgggtatggaagttagggtaaaagttaaaattaaactacgttaagtcggaacctaacggtacccgtttaccgggaagggtaaaccggggtcccgttaagtttaaccccaacccgtacgttaccccgtaacccggaaagaaccgtaaacctaaacgtttaaaccccgaaaaggtaaacccgttaccggtacctttaacgggttaaaccttaccgttaacggaaaacctaaaaaggttaccggaaaaaccgtacggtaccccgtaaaggaccggaaccggtacccgggaaacggaccgtaacgggtccgttacggttagttaaacgttaaccggtaggaccggacgtaaaggtacctaaagttttacgtttaaccgg

SEQ ID NO: 428354 - DNA, 634 bp, Homo sapiens
  misc_feature: GZ8MTXP02GDSUM.44.85.H08.1.454.CMB.2.raw
  modified_base (309)..(309): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagccgtgggacgtccctgagactctcctgtgcagcgtctggattccaccttcacgtacctatggcatgcacgtcgggtcccnccaggcctacgagggcgaagggggctggggaggtgggtcggacctacgtttagatggggtatggaagttgggaaattaaataaaagttactagtacgacgaagtacgtaccggtaggaacggggtacgtattacccacctacttaccgtacccgaagaacgtaaacctaaacgttacccaaaacggaaaccgtaccgtacgttaacggttataccgtacgaactaaagtacgaaacaccgtaccgtaggaacggacggaccggaacggacgacggcgtacgttagtagttaacgtggtacgacgtaaggactagttacttaacgg

SEQ ID NO: 428355 - DNA, 701 bp, Homo sapiens
  misc_feature: GZ8MTXP02FVK1S.44.85.H08.1.454.CMB.2.raw
  modified_base (259)..(259): a, c, t, g, unknown or other
  modified_base (262)..(262): a, c, t, g, unknown or other
  modified_base (267)..(267): a, c, t, g, unknown or other
  modified_base (294)..(294): a, c, t, g, unknown or other
  modified_base (302)..(302): a, c, t, g, unknown or other
  modified_base (310)..(310): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgcttcttttaagaggtgtccagttgtcaggtgcagctggtggagtcgtgggggagcgtgggtccaggccgtggggagtccctgagctctcctgngcngctcngattccacttcagtcctatggcatgcncgtggccnccaggccncgaggccgaaggggtctggggagtggggtgacctactttaagtagtagggttatggtaagtacggggtaaaattaaaaagttaaaacttacgttaagttacgcctaaaacggtaccgttacccgggttagggaaaccggggtcccgtaaactttacccgaacccgtaacttacccgtaaccgaaacggtaaaccgaacgttaaaaccttacccgaaaacggtaaaccaccggtaccttaggttaacctcgtaaggtaaacaaacgttacggaaacaacggtacccgtaaggacggaaccgaccggtaacggaaccgtacccgggtacgtttcggtagttaaacgtttaaccgtaggttacggaccggtaaggtaacttagtagtttaaacg

SEQ ID NO: 428356 - DNA, 593 bp, Homo sapiens
  misc_feature: GZ8MTXP02H07QJ.44.85.H08.1.454.CMB.2.raw
  modified_base (199)..(199): a, c, t, g, unknown or other
  modified_base (262)..(262): a, c, t, g, unknown or other
  modified_base (302)..(302): a, c, t, g, unknown or other
  modified_base (309)..(309): a, c, t, g, unknown or other
  modified_base (336)..(336): a, c, t, g, unknown or other
  modified_base (476)..(476): a, c, t, g, unknown or other
tcagacagtatatacacgaccggtgctcgatttagtatcactcagtcggcggggggagaggagcccagcactagaagtcggcggtgtttccattcggtgatcagcactgaacacagaggactcaccatggagtttgggctgagcttgggtttcctcgttgcttcttttaagaggtgtccagtgtcaggtgcagctgggnggagtcgtgggggagcgtggtccaggccgtggggacgtccctgagactctcgtgtgcagcgtnggattccacttcagtacctagtggcatgcacgtgggcccncgagccnccgaggcgaaggggctgggaggtgggngactattagatggtatgagtaggaaattaaataaatcgttaatgaacctagtaaccgttaccgggagaaaccggggtccctaattaccgaccctatcccgaacccgaaggtaacaactaaaacgttaccgaaagaaaccncgtactagtactcgtagaactaaagtacgaaacagtccgaagaacggacgaccggaagccgaacggtctaggttagtactacgtgtagacgaagataatgtacgtactacttacacg

SEQ ID NO: 428357 - DNA, 637 bp, Homo sapiens
  misc_feature: GZ8MTXP02H9UMU.44.85.H08.1.454.CMB.2.raw
  modified_base (317)..(317): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggaggcgtggtcagcctggggagtccctgagactctccgtgtgcaggcgtctggattccaccctttcacgttacctatggcatcgctacgtcggggcccnccgaggcctaccgagggcgaaggggctggggaggtggggtggcctacgtttagtagtgggtataggaagtgggtaaaagttaaataaaatactatgacaacgtaccgtcgaggaacggggtccagtccaccgatcctacgacgtacgaactaaacttacccgaaaggaaactacgtacgtacgttaactccgtaggtaacctaaagtacggaaacctacggaccgttaaggaacggacgggacccggaaacggaccggacggtctacggttagtacgttaacgtgtacggaacggtacggtaactaggtttacttaacgg

SEQ ID NO: 428358 - DNA, 679 bp, Homo sapiens
  misc_feature: GZ8MTXP02ICWGH.44.85.H08.1.454.CMB.2.raw
  modified_base (314)..(314): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggtcagccgtgggacgtcctgagctctccgtgtgcagcgtctggattccaccctttcagtacctagtggacatcgactacgtgggtcccnccgaggcctccgagggcgaaggggctaggggtacggtggggtcggacctacgttagtagtggttatggagttaggaaacgtttaaataaattacgtagtacgactaacggaccgtttaccggaggtaaaccggggtccctaaagtttaccccgaaccttaacgttccctaacccgaaaggaccgtaaaccttaaaaccgtttcccgaaaaaggtaacccgtaaccgtacccgtttagttaactccgttaacgaaactaaaacgttacgaaacgacgtacccgtaggaccggacggtccggaacggaaccgacgggtactggttaactagttaacgtgtacgacggagtactagtttacgttacgg

SEQ ID NO: 428359 - DNA, 566 bp, Homo sapiens
  misc_feature: GZ8MTXP02HE72H.44.85.H08.1.454.CMB.2.raw
  modified_base (172)..(172): a, c, t, g, unknown or other
  modified_base (314)..(314): a, c, t, g, unknown or other
  modified_base (335)..(335): a, c, t, g, unknown or other
  modified_base (341)..(341): a, c, t, g, unknown or other
  modified_base (365)..(365): a, c, t, g, unknown or other
  modified_base (421)..(421): a, c, t, g, unknown or other
  modified_base (476)..(476): a, c, t, g, unknown or other
  modified_base (513)..(513): a, c, t, g, unknown or other
  modified_base (529)..(529): a, c, t, g, unknown or other
tcagacagtatatacacgaccggtgctcgatttagtatcactcagtcgcggggggagaggagcccagcactagaagtcggcggtgtttccattcggtgatcagcactgaacacagaggactcaccatggagtttgggctgagcttgggttttcctcgttgcttcttttaagnggtgtccagtgtcaggtgcagcgtggtggagtcgtgggggagcgtggtccagccgtgggacgtcctgacgtactctccgtgtcgcagtcgtctggtacttccgaccttcaagttacctagtggcagtcgcacgttgggcccncgacgctccgaggcgaggggntagggnggtgggcgctacttgtagcggtangaacgtaggaaataaataagtctagtgactagacttcggagacggctaatccgacntctacgagtacgactaactacgaaagacacgaccttagtactctagactaaacgngaaacgacgtacgtagacgacggacgagacgacggtntacgtagtacttacgngtacgacgaagtactagttatacgtacacctactacg

SEQ ID NO: 428360 - DNA, 556 bp, Homo sapiens
  misc_feature: GZ8MTXP02JIE25.44.85.H08.1.454.CMB.2.raw
  modified_base (310)..(310): a, c, t, g, unknown or other
  modified_base (417)..(417): a, c, t, g, unknown or other
  modified_base (450)..(450): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagccgtgggagtccctgagctctcctgtgcagcgtctggacttcaccttcagtacctatcggcagtgctacgtcggggtcccnccgaggcctccgagggcgaaggggcgtgggaggtggggtgccgtacttatagtggtatgatgggaaataaataaatactatgacagactcgagacggcgtatccacntctcgagacgactaaactaccgaaagaacacgntagtactacgtgaactaaatcgaaactagcctagaacgacgaccgggaacgacgacggtcgtacgttagttactaagtagtacgacggtagactagtagtttaacg

SEQ ID NO: 428361 - DNA, 597 bp, Homo sapiens
  misc_feature: GZ8MTXP02F1SPI.44.85.H08.1.454.CMB.2.raw
  modified_base (294)..(294): a, c, t, g, unknown or other
  modified_base (316)..(316): a, c, t, g, unknown or other
  modified_base (522)..(522): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgtggggacggtccctgacgactctcctgtgcagcgtctggacttcaccttcagttacctanggcatcgctacgtcgggtcccncgaggcctccgagggtcgaaggggtctgggaggtggggtcgcctaacttagagtggtatggaagtagggaaagtaaataaagttactagtagacctaagtaccgtcggtaaggtaaccggggacctattacccgaactacttcgtaccaagaaacgaactaaacttaccgaaaagaaccgaacgctagtactctagactaaagtanaacacgacctagaacgacggaccgagaccgacgcgtacgtagtaattgagtggaacgaggataagtactttaagg

SEQ ID NO: 428362 - DNA, 619 bp, Homo sapiens
  misc_feature: GZ8MTXP02G8SIP.44.85.H08.1.454.CMB.2.raw
  modified_base (196)..(196): a, c, t, g, unknown or other
  modified_base (260)..(260): a, c, t, g, unknown or other
  modified_base (265)..(265): a, c, t, g, unknown or other
  modified_base (279)..(279): a, c, t, g, unknown or other
  modified_base (318)..(318): a, c, t, g, unknown or other
  modified_base (418)..(418): a, c, t, g, unknown or other
  modified_base (510)..(510): a, c, t, g, unknown or other
  modified_base (586)..(586): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagagtgtccagtgtcaggtncagcgtggtggagtcgtgggggagcgtggtccagccgtgggacgtccctgagctctcctgtgcngcgtntggacttcaccttnacgttacctagtggccagtcgcgtacgtcggggtccccnccgaggccctacggacgggtacgaagggggtcctaggggaggtggggtacgaccctagttagtagtggtatgaagtaggggtaaataaataaagtctagngactaacgacctcggtaaggacggtaccgattccaaccgatcctaccgaatacgaaactaacgtacaaacgaactccgtatcgtaatcgtanacgaaatcggaaactcgaccgtgaacggaccggacggaaccggacgtacggtcgtaccggtattacgttaaccggnggtacggacggacgtaactacgttacgttaacg

SEQ ID NO: 428363 - DNA, 599 bp, Homo sapiens
  misc_feature: GZ8MTXP02G1BCY.44.85.H08.1.454.CMB.2.raw
  modified_base (313)..(313): a, c, t, g, unknown or other
  modified_base (400)..(400): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtcctgagtactctcctgtgcagcgtctggattccaccttcagttacctagtggcatcgctacgtcgggtcccnccgaggtcctccgagggcgaaggggtctggggtaggtgggtgaccctagttagtagtggtatgatgggtaaataaataaatcgtaangacagacgtacgaggacgcgtaatcactcgtactaccgaagactaactaaacttaccgaaaagaacctaacgtacgtagttacacgtagaacctaaagtaacaacctacgtaccgaagaacggacggaccggaaacggaaccgtacggccgttagtagttataacggtgtaggtaccgaggtactagttacgtttaacg

SEQ ID NO: 428364 - DNA, 570 bp, Homo sapiens
  misc_feature: GZ8MTXP02H0JHU.44.85.H08.1.454.CMB.2.raw
  modified_base (265)..(265): a, c, t, g, unknown or other
  modified_base (412)..(412): a, c, t, g, unknown or other
  modified_base (469)..(469): a, c, t, g, unknown or other
tcagacagtatatacacgaccggtgctcgatttagtatcactcagtcgcgggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctctgtgcagcgtcnggtattcaccttcagtacctatggcagtgccacgtcgggtccgccgaggcctccgaggcgaaggggctgggagtggggtggctacgttatagtggtatgatgggaaataaataaatactatgacagactcgtagacggcagtccacnctctacgagacgaacaacttaccaaacgaacacgtcttagtactctagaacctaaanacgaaactagacctggaacggacgaccggaacggaccgacggttacgtaggttaatacgttaacgtgttacggacggtaaggacttagtttaactttacgg

SEQ ID NO: 428365 - DNA, 617 bp, Homo sapiens
  misc_feature: GZ8MTXP02FGCXW.44.85.H08.1.454.CMB.2.raw
  modified_base (254)..(254): a, c, t, g, unknown or other
  modified_base (278)..(278): a, c, t, g, unknown or other
  modified_base (312)..(312): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctgttgctcttttaagaggtgtccagtgtcaggtgcagctggtggagtcgtgggggagcgtggtccaggcctgggagtccctgacgctctcctgngcagcgtctggacttccacccttnacgttacctagtcggcatcgcacgtcggggtccnccgaggcctccgagggcgaaggggtctgggaggtggggtgaccctacgtttagagtggtaatgagtaggtaaagtaaataaattactatcggacacgtaccgtaccggtaggaacgggacccgtattaccctaccgactcctaaccgaagtaacgtaactaaacttaacccaaagtaaccgaccgtattacgtaacttacgtagaactaaagtcgaaacgtacgaccaggaacgacgaccggaacggacgacggtccgtacgtgttaactaacgtgtcggacgacggtaactagttacgttaacg

SEQ ID NO: 428366 - DNA, 558 bp, Homo sapiens
  misc_feature: GZ8MTXP02I6UH0.44.85.H08.1.454.CMB.2.raw
  modified_base (505)..(505): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacggtccctgagactctcctgtgcagcgtctggattcaccttcagtacctatggcatgcacgtgggtccgccaggctccgaggcaaggggctggagtggggtgcctacgttatagtggtatgatggaaagttaaataaatactatgacagactccgtggaacgggccgtagttcaccagtctacgagagactaattaccaaagaacacgtactgtactctagacaaatcgaaactacgaccgtaggaacgtacggaccgtacggaaacncgtacggactggttacgtaacgttacgtggtcgacggtaagtactagtttagg

SEQ ID NO: 428367 - DNA, 609 bp, Homo sapiens
  misc_feature: GZ8MTXP02GVKRO.44.85.H08.1.454.CMB.2.raw
  modified_base (213)..(213): a, c, t, g, unknown or other
  modified_base (280)..(280): a, c, t, g, unknown or other
  modified_base (314)..(314): a, c, t, g, unknown or other
  modified_base (532)..(532): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgngggggagcgtggtccagccgtgggagtccctgacgacttctcctgtgcagcgtctggattcaccttnacgtacctatggcagtgcctacgtcggggtcccnccgaggccctcgaagggccgaaagggggctcggggaggtggggtagcccgtacgtttagagttggtaatggtaagtaggggtaaaacttaaaattaaaacgttactaagtcgacgtaaggtaaccgtccggtaaggacggggacctaacttaccaacctaactccgtacaagacaactaaacgttaccaaacgacaacgctagtatctagacaaagtnaacaggacctagacgacggacgtaacgacgacgggtctagtacgtataagtcgacgagtacgataacttagttacgg

SEQ ID NO: 428368 - DNA, 729 bp, Homo sapiens
  misc_feature: GZ8MTXP02FLRFF.44.85.H08.1.454.CMB.2.raw
  modified_base (307)..(307): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggagtccctgagactctcctgtgcagcgtctggattcaccttcagtacctagtggcatgcacgtggggtcccncgaggcctccgagggcgaaggggtctggggaggtggggtggacctacgtttagagttgggtaatggaagttggggaaaagtaaaattaaaagttacgtaattacggacctaaagtacccgttacccgggtaggaaaacgggggtccctaacgtttacccgaaccctacttacccgtaccccgaagaaacgtaaacctaaaaccgtttaccccgaaaaggtaaacccgtaaaccggacctttagggttaaccttacccgtttaaggaaaccctaaaaagttacggaaaaccgtaaccggacccgttaaagggaaaccggaacggggaacccggtaaacgggaaacccggtaccgggtaccgttagggtaccgtttaactaacggttaggtacggacggaggaaactacgtttaagtttaacgg

SEQ ID NO: 428369 - DNA, 609 bp, Homo sapiens
  misc_feature: GZ8MTXP02IT16G.44.85.H08.1.454.CMB.2.raw
  modified_base (486)..(486): a, c, t, g, unknown or other
  modified_base (578)..(578): a, c, t, g, unknown or other
  modified_base (592)..(592): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggttgtccagtgtcagggtgcaggctgggtggagtcggtgggggaggcggtggtccaggccgtgggggacgtccctggacgcctctcctgtgcagcgtctggattcaccttcagttacccagtggccattcgctacgtcgggtccccgaccaggcctccgagggcgaaggggcgtggaggtggggtgccctacgttatagtggtataggatgggtaaataaataaaatctatagacacgacgttaccgaggtaaacggccgtaacttcacctacgtctaccagaacgactaaactaccgaaagaacncgtctagtacctacgtagaactaaataccgaaacgacgtccgtaagacgacggaccggaacggaccgaggtccttagtacgttaattaacgnggtacgaccggaanacgttagtacgtttacg

SEQ ID NO: 428370 - DNA, 556 bp, Homo sapiens
  misc_feature: GZ8MTXP02JADU1.44.85.H08.1.454.CMB.2.raw
  modified_base (411)..(411): a, c, t, g, unknown or other
  modified_base (434)..(434): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccaggcctgggacgtcctgagctctcctgtgcagcgtctggacttcaccttcagtacctagtggcatcgcacgtgggtcccgcaggctccgagggcgaggggctgggagtggggtcgctacgttatagtggtatgagtggaaataaataaatctatgacagactcgtagacggcgatcactactcncgagacgactaactacaaagacncgactgtactctagacaaagtacgaacacgacgtagacggacggaccggaacgggaccgacggtacgtagttacgttaacgttaacgtgtacggacggtaacggtactacgttagtttaacg

SEQ ID NO: 428371 - DNA, 585 bp, Homo sapiens
  misc_feature: GZ8MTXP02FIM6K.44.85.H08.1.454.CMB.2.raw
  modified_base (161)..(161): a, c, t, g, unknown or other
  modified_base (259)..(259): a, c, t, g, unknown or other
  modified_base (279)..(279): a, c, t, g, unknown or other
  modified_base (337)..(337): a, c, t, g, unknown or other
  modified_base (343)..(343): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttccncgttgctcttttaagaggtgtccagtgtcaggtgcacctggtggagtcgtgggggagcgtggtccagcctgggagtccctgagctctctgtgagcctntggatttagttcagtagtcngcatgcacgtgggtccgccaggcctaccgaggcgaaggggccgagtggttgcagttangcatangatggaacttctagattaatatgacagtacctccggtagaaacgggccctaattcaacctattccaccgagaacgaactaaacgttccccggaaactaccgtctacgtaccgtaagggtaaactggaactccgagccgtaggaacggagggtaccggaagggtaccgtcggggaccttacgttaggttaacttaccgtggtcgacggaagcggtacggggaagtcggaacacgggactaagg

SEQ ID NO: 428372 - DNA, 717 bp, Homo sapiens
  misc_feature: GZ8MTXP02F5JXV.44.85.H08.1.454.CMB.2.raw
  modified_base (309)..(309): a, c, t, g, unknown or other
tcagacagtatatacacgaccggtgctcgatttagtatcactcagtcgcggggggagaggagcccagcactagaagtcggcggtgtttccattcggtgatcagcactgaacacagaggactcaccatggagtttggctgagcttgggttttcctcgttgcttcttttaagaggtgtccagtgtcaggtgcagctggtggagtcgtgggggagcgtggtccaggccgtgggacgtccctgacgtactctccgtgtgcagtcgtctggatttccgaccttcagtacctagtcggcatcgcacgtgggcccncgaggcctaccgaggaccgaagggggctaggggaggtggggtgaccgtactttaagtagttggtaattggaagttagggaaaacttaaattaaaatcgttaagacggtacgtaacgtacccgttaccgggtaagggaaacggggtacccttaacgtttacccgaaaccgtaacttacctaacccgaaagtaaccgaaacctaaacttaaacccgaaaacgaaaccgtaaaccgtacgttaacgttaacttacttaacgaacctaaaagtacgaaaacgacgttacccgtaaggaacggaaccggacccggaaggaccgtaaccggtcgttagggttaaccgttaggtttacgtaggttccggaggtaacggtactaagttagttacgtaacgttacctacccgtaacg

SEQ ID NO: 428373 - DNA, 660 bp, Homo sapiens
  misc_feature: GZ8MTXP02IEF9D.44.85.H08.1.454.CMB.2.raw
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctgggtggagtcgtgggggaggcgtggtccaggccgtggggacgtccctgagctctcctgtgcagcgtctggattccacctttcagttaccctagtcggctagtgctacgtcggggtcccgccgagggtcctccgagggcgaaagggggctggggaggtcggggtcgaccctaacgttatagttaggtatcggaagtaggggtaaattaaattaaaacttacgtagtcggacagtaccgttcggtaggaacgggtcctattccgaacctactacctaccgaagacgaactaaaacgttaccgaaacgtaaccaccgtcgttagtactacgtacgaactaaaacgtacgaaacacgtacctagggaacggaccgaccgggaacggaaccgtacggggtccttagggttacgttaacgttaacgtgggtacggacggtaaggtactaagtttaaccgtttagg

SEQ ID NO: 428374 - DNA, 552 bp, Homo sapiens
  misc_feature: GZ8MTXP02FMLPF.44.85.H08.1.454.CMB.2.raw
  modified_base (302)..(302): a, c, t, g, unknown or other
  modified_base (351)..(351): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccgtgggagtccctgagactctcctgtgcagcgtctggattcacttcagtacctagtgcatgcacgtgggccncaggcctccgagggcaaggggtctgggaggtggggtgaccctacgttanagtggtatgaatgggaaataaataaactctatgacagtacgtccgtaggaacggtcattccacactcaccagagacaaacttaccaaagaacacgtacgttatactacgtagaacaaagtacgaaacagccgtaagagacgaccggaacgacgaacggcctaagtgttaactaagtgacggacgaggtactattagttacg

SEQ ID NO: 428375 - DNA, 505 bp, Homo sapiens
  misc_feature: GZ8MTXP02FK002.44.85.H08.1.454.CMB.2.raw
  modified_base (300)..(300): a, c, t, g, unknown or other
  modified_base (339)..(339): a, c, t, g, unknown or other
  modified_base (397)..(397): a, c, t, g, unknown or other
  modified_base (403)..(403): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcgtctggattcaccttcagtacctatggcatgcactgggtccnccaggctccaggcaaggggctggagtgggtggcacttanatggtatgatggaaagtaataaaatactatgcagactccgtgaagggccgattcacanctccanagacaaatcaaagacacgctgtatctgacaaatgaaacagcctgaacgagaccgacggacacgggacctgtcgtattaacgtgtagcgaggacatattacgg

SEQ ID NO: 428376 - DNA, 633 bp, Homo sapiens
  misc_feature: GZ8MTXP02G7285.44.85.H08.1.454.CMB.2.raw
  modified_base (310)..(310): a, c, t, g, unknown or other
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgacgactctcctgtcgcagcgtcgtggattccaccttcgagtacctagtggctatcgccacggtcgggtccnccgaggcctaccgaggccggaaggggcgttgggaggtgggtcggacttacgttagttagtggtagtgtaagtaaggaaagttaaaattaaacgtctagtacgacgtacgtaccgtacggtaggaacgggtccctacgttaccactacgtctaccgaagacgtaactaacgtaccgaaagtaaccacgtccttagttactacgtactaaacgtaaactacgaaaccgacgtaccgtaggaaccggacggacggtaacgacggtacggtcttaggtattacgtacgtggacgtacgaagtactaagttgtacgacttacacgtcg

SEQ ID NO: 428377 - DNA, 682 bp, Homo sapiens
  misc_feature: GZ8MTXP02I3TKF.44.85.H08.1.454.CMB.2.raw
  modified_base (162)..(162): a, c, t, g, unknown or other
  modified_base (177)..(177): a, c, t, g, unknown or other
  modified_base (341)..(341): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcgtgggttttccncgttgctctttaagnggtgtccagtgtcaggtgcagctggtggagtcgtgggggagtcgtggtccaggtccgtggggacggttccctggagtacctcgtcctggtgcaggtccgtcgtaggactttccacccgtttcagttaccctagtcggacagtcgccgtacgtcggggtaccccnccgaggcctacggagggaccggaggggcgtaggggacggtggggtcgaccttagttagtagtggtataggaagttagggtaaataaactaaacgtagtatagacgtaagtaccgtacggtaagggaaccggtctaactaccaccgtactaccgtaaccgaagtaaacaaacccgttaaactaacccgaaaagtacccgtagtaccgttaacgtactacgaacgaaacgtaaagaacgaaacgaacgtacgtacgacggacggaccggacggaacgacggtacgtacgttacgttacgttaacgtacggtacggtacggtaagtaacgtaacgttacgtacg

SEQ ID NO: 428378 - DNA, 700 bp, Homo sapiens
  misc_feature: GZ8MTXP02H2HUV.44.85.H08.1.454.CMB.2.raw
  modified_base (177)..(177): a, c, t, g, unknown or other
  modified_base (356)..(356): a, c, t, g, unknown or other
  modified_base (580)..(580): a, c, t, g, unknown or other
tcagacagtatatacacgaccggtgctcgatttagtatcactcagtcgcgggggggagaggagcccagcactagaagtcggcggttgtttccattcggtgatcagcactgaacacagaggactcaccatggagtttgggctgagtcttgggttttcctcgttgcttctttttaaggnggtgtccagtgtcaggtgcagcgtgggtggagtcggtgggggaggcgtggtccaggccgtggggacgtccctggacgactctccgtgtcgaccgaggtccgttcgtacggtacttcccgtaccctttccaacgttaacccctagtagggtccagttcgacctaccgttcggggtccccncccggagggccctaccccgagggccgaaagggggtccttaggggaggttcggggtggcctaacgtttagtaagtggtagtgaataggggtaaataaaacttaaatacctaatgaccgagtacctccggtagaaacgggccgtattaccacctagtacctaccgaagaacgaactaaacgtaccgaaagtaaacaccgtctacgttaatcgtgaaactaagtaanaacgaacgtccgagaacgaacgcccgggaaagtcctaacgggcttaacgtacggttattaccgttgcgtaaccggaaggtaactaagttagttacgtaaacgtttacctaaccgtaccgg

SEQ ID NO: 428379 - DNA, 704 bp, Homo sapiens
  misc_feature: GZ8MTXP02G52BV.44.85.H08.1.454.CMB.2.raw
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcagctggtggagtcgtgggggagcgtggtccagccgtgggagtcctgacgctctcctgtgcagtcgtctggtattccaccttcagttacctagtcggactagtcgcctaccggttcggggtccccaccgtagggccctacccggaaggggaccggaagggggtcctaggggacggttggggtacgtactaacgttagtagtggtatgtaagtaggtaaattaaaattaaactacgtagtacgactaacgtaccgttaccggtaagggaaccgggtacccgtacttacccgaccctactacccgtacccgaagaaccgtaacctaaacttaaccgaaaacgtaaccacgtaccgttagtacttacgacgaaactaaaagtaagaaaacgtccgtaagaacggaacgaccggaaggaaccgtacggtacgttaggttacgttaacgttaacgcggtacgacggtaaagtaacttagttaacgtttacgtaacgttaaccctaccgtaacgtcgg

SEQ ID NO: 428380 - DNA, 608 bp, Homo sapiens
  misc_feature: GZ8MTXP02JXRY0.44.85.H08.1.454.CMB.2.raw
  modified_base (282)..(282): a, c, t, g, unknown or other
  modified_base (310)..(310): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggaggcgtggtccagccgtggggagtccctgagactctcctgtgcagcgtctggattcacctttnacgtacctatggcatgcacgtggtcccncaggcctccgaggcaggggctggagtgggtgcctacttagtatggtatgagtggaaagtaataaatacatgactagacgtcgtagacggccgattcactatcctccgagacgacaaacttaccaaagaacacgtcttacggtactacgttagaacctaaagtacgaaaccgacgtacccgtaggaacggaaccgggccggaaaacgggaccggaaaccggggtctaggggtttacgtttaacgttaaccgttgggttacggacggtaacgggtaacctaaggtttaactttaaccggg

SEQ ID NO: 428381 - DNA, 620 bp, Homo sapiens
  misc_feature: GZ8MTXP02FYZC9.44.85.H08.1.454.CMB.2.raw
  modified_base (277)..(277): a, c, t, g, unknown or other
  modified_base (304)..(304): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgagactctctgtgcagcgtctggattcaccttnagtacctatggcatgcacgtcggtccnccgaggcctccgagggccgaaggggctggggagtggggtgccctattagatggtatgatgggaaactaaataaatctatgactagacgtccgtagaacgggtctacgttcacctatcctaccgtaagaacgaactaaacttaccaaagttaacccgacgtaccgtagttactacgtacgtaaacaaacgtacgaaacgtaccgtaccgtaaggacgggaacgacccgggtaacggtaaaccggacgggtaccgttaaggttccgttaaagtttaaccgtgggtacgtaccgggtaggtaactagttagtttaacgg

SEQ ID NO: 428382 - DNA, 658 bp, Homo sapiens
  misc_feature: GZ8MTXP02F4SDK.44.85.H08.1.454.CMB.2.raw
  modified_base (258)..(258): a, c, t, g, unknown or other
  modified_base (270)..(270): a, c, t, g, unknown or other
  modified_base (302)..(302): a, c, t, g, unknown or other
  modified_base (344)..(344): a, c, t, g, unknown or other
  modified_base (591)..(591): a, c, t, g, unknown or other
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgagactctcctgtgcagcgtntgattcaccttnacgtacctatggcatgcctacgtcgggtcccncgagcctccgaggcgaaggggctgggagtgggtgctagttangtaggtatgagttaggaaattaaataaatctatgacgagtaccctaccggtaggaaacgggtccgtaacttcccaacctaactacctacccgaaagactaaactaacttaaccaaaacgaaccaaccggtactacgttacgttaccgtaggtaaaccaaaagttaccgaaacgtacggacccgtaaggaacggaaccggacgggaacgggaacgaaccggggtcttaggtacgttaacgtttaacgnggttaacggacgaaacggttaactagtttaaagttacggttaaccgtaaccgttaaccctaaccggg

SEQ ID NO: 428383 - DNA, 727 bp, Homo sapiens
  misc_feature: GZ8MTXP02JAZ9Y.44.85.H08.1.454.CMB.2.raw
  modified_base (282)..(282): a, c, t, g, unknown or other
  modified_base (295)..(295): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcagctgggtggagtcgtgggggagcgtggtccagccgtgggacgtccctgagctctctgtgccagtcgtctggattccaccttnagtacctagtgcntgcacgtcggtcccgccaggcctccggaggcgaaggggtctagggaggtcggggtgccctacgtttagtagttaggggttataggtaatagggggtaaaacttaaaattaaaagttccgtaagttacggaccgtaagtacccgttaccggtaaggtaaaccggggaccttaaccgtttacccaacccgtacgttaacccgtaccgaaacgtaacgaaacctaaaaccgttaacccggaaaactaaaccccgtacggtacccttaggtaaccttaacccgaggtaaacctaaaagttacggaaaccctacgacccggttaaggaaaccggaccggaaccggtaaacggtaaacccggacggttacgtcggttaagtttaacgttaaccggttggtacggaccggtaagtaccgtagtttaaaccgtttaacgg

SEQ ID NO: 428384 - DNA, 602 bp, Homo sapiens
  misc_feature: GZ8MTXP02I4740.44.85.H08.1.454.CMB.2.raw
  modified_base (300)..(300): a, c, t, g, unknown or other
  modified_base (356)..(356): a, c, t, g, unknown or other
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggtttcctcgttgctcttttaagaggtgtccagtgtcaggtgcagctgggtggagtcgtgggggagcgtggtccagcctgggagtccctgagctctcctgtgcagcgtctggacttcaccttcagttacctatcggcatgccacgtgggtcccnccgaggcctccgaggcgaaggggctggggagtggggtcggctactttatatggtanggtatagggaaagttaataaatctatgactagactcgagaagggccgattcccgacatcctaccgagacgaacaatccaaagaaccgacgtctagtactcagacctaaatcgaaacacgactaggacggacggaccgaagggaccgtaccgggtcgttagggtacgttaaacgttaccggtggttacggacgaacgggtaaacttaacgttagtttacgggtaacgttaccctaacccgttaccgg

SEQ ID NO: 428385 - DNA, 675 bp, Homo sapiens
  misc_feature: GZ8MTXP02IT648.44.85.H08.1.454.CMB.2.raw
  modified_base (269)..(269): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggtccaggccgtggggacgtccctgagctctcctgtgcagcgtcnggtacttcaccttcaacgttacctagtcggcagtcgcgtacgtcggggtcccaccgaggcctaccggaagggtcggaacgggggtcgtaggggtaggtcggggtaggtaccccttaacgtttagtaggtggttaactaggaagttaggggtaaaattaaaactaaacgttactagtcgaactaagtacccgttcggaacgggaacggtccgtacttaccgaccttacgtacccgtaaccgaaaggactaaacctaaacgttaaccaaacggaactacgtacgttagtactacccgtacgaaataaacgtcgaaacgcgtaccgaggaacgaccggacggaaacgaccgtacggtcgtagttacgttaactcgtgggaagtacggagtaacttagtttacttaacgg

SEQ ID NO: 428386 - DNA, 654 bp, Homo sapiens
  misc_feature: GZ8MTXP02F8RQM.44.85.H08.1.454.CMB.2.raw
  modified_base (309)..(309): a, c, t, g, unknown or other
  modified_base (403)..(403): a, c, t, g, unknown or other
  modified_base (530)..(530): a, c, t, g, unknown or other
tcagacagtatatacacgaccggtgctcgatttagtatcactcagtcgcgggggggagaggagcccagcactagaagtcggcggtgtttccattcggtgatcagcactgaacacagaggactcaccatggagtttggctgagctgggtttcctcgttgcttcttttaagaggtgtccagtgtcaggtgcagctggtggagtcgtgggggaggcgtggtccagccgtgggacggtcctgacgtactctcctgtgcagtcgtcgtggtattccaccttcagtacctgtggcatcgctacggtcgggtcccncgacggcctaccgaggtacggaaggggtcgtaggggtaggtcggggtgacctaattagtataggtatgagtaaggtaaaacttaaataaaactntagtcgagagtacccgtacggtaggaaacgggtcctaacttcccgaactactcctaaccgaagaactaaacgtaacttacaaaaacggaccaacggtccttaagtaacttacgactaaaacgtaaanacggaaactacgtacgtaacgggaacggacgacccgggaaacggacgtacgtcgttagtaacgttagttaccgcggtacgaacggtaagtataagttaacgtacgttaaccgaactaccgtacg

SEQ ID NO: 428387 - DNA, 650 bp, Homo sapiens
  misc_feature: GZ8MTXP02IOMH8.44.85.H08.1.454.CMB.2.raw
  modified_base (165)..(165): a, c, t, g, unknown or other
  modified_base (302)..(302): a, c, t, g, unknown or other
tcagacagtatatacacgaccggtgctcgattttagtatcactcagtcgcgggggggagaggagcccagcactagaagtcggcggtgtttccattcggtgatcagcactgaacacagaggactcaccatggagtttgggctgagcttgggttttcctcgttgctnttttaagaggtgtccagtgtcaggtgcagctggtggagtcgtgggggagcgtgtccagccgtgggacgtcctagacgactctcctgtgcagtcgtctggacttcaccttcagtacctatgcatgcacgtgggtcccnccgagtcctaccgaggcgaaggggctagggagtgggtgactagtatagtcggtatgaagttaggaaagttaaattaaaacttatatacgacgaagtacccgtacggtagggaaacggtccgtaattacccaaaccaactcctaccgaaagaacgaaacctaaactaccaaaacgaactaacgtactaacggttactacttagaacaaaacgtacaaccgaactaccgtaggaacgtacggacgaacggacgacccggtactacgttagttaaacgttccgttaaacggtagaccggttaagaacttaacgttagttacggttaaacgtaaccttaacccgtaacccgg

SEQ ID NO: 428388 - DNA, 592 bp, Homo sapiens
  misc_feature: GZ8MTXP02IA90Y.44.85.H08.1.454.CMB.2.raw
  modified_base (270)..(270): a, c, t, g, unknown or other
  modified_base (297)..(297): a, c, t, g, unknown or other
tcagacagtatatacacgaccggtgctcgatttagtatcactcagtcgcggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgagctctcctgtgcagcgtctggattccaccttnagtacctatggcatgcacgtgggcccncgaggcctccgaggcgaaggggtctgggacggtgggtcgctattagtatggtatgatagggaaataaactaaatctatgactaagccgtacggtaggaaacgggtccattcccaacctacttacccgaccgaagaacgtaactaacgttacccaaagacacgtcttaggtaactctacgaactaaatcgaaacacggtacgtagacgacgacggtacgacgtacggtctaggttatacgttcgtcgtacgacgtaagtactaacgttacgttacgtaacgttaaccacccgtacg

SEQ ID NO: 428389 - DNA, 722 bp, Homo sapiens
  misc_feature: GZ8MTXP02HTLIP.44.85.H08.1.454.CMB.2.raw
  modified_base (175)..(175): a, c, t, g, unknown or other
  modified_base (268)..(268): a, c, t, g, unknown or other
  modified_base (319)..(319): a, c, t, g, unknown or other
  modified_base (363)..(363): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagagactcaccatggagtttggctgagcttgggtttcctgttgcttcttttaagnggtgtccagtgtcaggtgcaggctggtggagtcgtgggggagcgtggtccagccgtggggacgtccctgacgtactctctgtgcgagtcgtcnggtacttcacctttcagttacctagtggctagtcgcgtacgttcgggcccnccgaggcctcggaggacggaaggggctaggggaggttcgggganaccctaacgtttagtggtagggttataggaagttaggggtaaaattaaataaaacgttctaagtcgaacgtaacgtacgtacggaggtaacggaccgtacttacccgaactacgttaccacgaacgtaaagaacctaaacgttaacccgaaaacgtaaaccgtaacgtaccgtaggttaaccttaccgtaacggtaactaaaacgttaccggaaaacgttacggaacccgtaaggggaaacggaaaccgggtaaccggaaacggtaaccgggtaaacggtccgttaggtttaacgtttaacgttaaccggttaggtacggtaccggtaaaggtaaccgtaaggtttaacgtttaaacgg

SEQ ID NO: 428390 - DNA, 688 bp, Homo sapiens
  misc_feature: GZ8MTXP02GU5WV.44.85.H08.1.454.CMB.2.raw
  modified_base (274)..(274): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcggtgggggagcgtggtccaggccgtggggacgtccctgacgtctctcctgtagcaggtcgtntggtacttccacctttcagtacctagtcggctagtcggcctacggtcggggtccccaccgaggccctaccggaacgggcggaaagggggctagggggacggttggggtacgtaccctaagtttaagtaggttagggtatcggaaagttagggggtaaaattaaaattaaaacgtacgtagtgactaacggtaccgtaccggtagggaacgggccctaattaccgacctacgttcccaacgaacgaaacgtaaacctaaaccgttaccgaaaaccgtaactaccggtattagtacctacgtagaaaactaacgtacgaacgtacgtacgacgtaacggacgaccgggtaacgacggtaccgcgttacgtacgttacgtaacggtacgtgaacggtagaactttagtactttacgg

SEQ ID NO: 428391 - DNA, 696 bp, Homo sapiens
  misc_feature: GZ8MTXP02ISN3T.44.85.H08.1.454.CMB.2.raw
  modified_base (162)..(162): a, c, t, g, unknown or other
  modified_base (261)..(261): a, c, t, g, unknown or other
  modified_base (263)..(263): a, c, t, g, unknown or other
  modified_base (283)..(283): a, c, t, g, unknown or other
  modified_base (301)..(301): a, c, t, g, unknown or other
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttccncgttgcttcttttaagaggtgtccagtgtcaggtgcagctggtggagtcgttggggaggcgtggtccagccgtgggaggtccctgagtactctcctgtncngcgtctggattcacctttanacgtacctatggcagttncgtacgtcgggtcccgccagggtcctcccgagggccgaaaggggctaggggtggttcggggtcggtccctaactttgtaagttggggtaattggagttagggggtaaaacttaaaagtaaaacttactagttagaccgtaaacgtaccgttccggtacggtaacggggaccgtaatttcccgaaacccacgttacctacccgagtaaacgacctaaaattaccccaaaaggaacccctacgtacgttagtaaccgttctacggaacctaaaagtacggaaaccagtacccgaggaaacgacgggtaccccgaaagggaaaccccagggttacctaggttaccgttagtttaactagggacggtcgggaaacgttagtacgtttaacgtttaacgg

SEQ ID NO: 428392 - DNA, 392 bp, Homo sapiens
  misc_feature: GZ8MTXP01CMB0K.19.53.E09.1.454.CMB.2.raw
  modified_base (264)..(264): a, c, t, g, unknown or other
  modified_base (390)..(392): a, c, t, g, unknown or other
tcagtactctcgtgcacgaccggtgctcgatttagagagagtgtgttgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggagtatagcagctactggtacgactactggggccagggaaccctggtcaccgtctctcagccnccacaaggccatcggtctcccctgcgccctgctccaggagcacctccgagagcacagcggccctgggcctgctggtcaaggactacttcccacgagagtactgagcgggctggcaaggcgcatagnnn

SEQ ID NO: 428393 - DNA, 580 bp, Homo sapiens
  misc_feature: GZ8MTXP01EFWXZ.19.53.E09.1.454.CMB.2.raw
  modified_base (239)..(239): a, c, t, g, unknown or other
tcagtactctcgtgcacgaccggtgctcgatttagagagagtgtgttgggtctggggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaaggccattcaccatcnccagagacaacgcaaagaactcctgtatctgacaaatgaaacagtctgagagctagaaggacacggtcctttgtattactggtgacgaaagggtacggtatagcaagtcttaaacgtgggtaaccgactaacgggtcgggggaccaagggggtaacccctgggtaccaccgtctcctcacgcctaccaccgaacgggcccacgtccggtccttccccgtggccgcccgtcgcctcccgaggacgccaccgtccgacgacgcacgacgccggcccgtgggctcgccgtggtaccaaggccttaccttcccgaacgtaacgacgtaccgttgaacggcgggcg

SEQ ID NO: 428394 - DNA, 510 bp, Homo sapiens
  misc_feature: GZ8MTXP01EIRH4.19.53.E09.1.454.CMB.2.raw
  modified_base (301)..(301): a, c, t, g, unknown or other
  modified_base (352)..(352): a, c, t, g, unknown or other
  modified_base (450)..(450): a, c, t, g, unknown or other
  modified_base (458)..(458): a, c, t, g, unknown or other
  modified_base (460)..(460): a, c, t, g, unknown or other
  modified_base (477)..(477): a, c, t, g, unknown or other
  modified_base (505)..(505): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtggggggagcttgggtacagcctggcagggtccctgagactctcctgtgcagcctctggattcacctttgatgattatgccatgcactggggtccgnaagctcccgaggggaggcctggagtgggtctcaggtattagtggaatagtnctagtatagcctatgcgactctgtgaagggccgattcacatctccagaacgacaaacgcccaaagggaacctccctagtactctgcaatagaacagtntgagaagngngagacgacgtcttgttnttacgtgtgaagaaggaggttagtaagngtaag

SEQ ID NO: 428395 - DNA, 551 bp, Homo sapiens
  misc_feature: GZ8MTXP01DK9FM.19.53.E09.1.454.CMB.2.raw
tcagtactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaaggccattcaccatctccagagacaacgccaagaactccctgtatctgacaaatgaaacagtctgagagctagaggacacggcctttgtattactgtgacaaaggaggtatagcagctaactgggtaacgactacgtggggcccaaggggaacccctgggtccaccgtctcctcacgccctccaaccgaacgggccccagtccggtccttcccccgtggcccgccccgtcgcctccgaggacgccacccgtccgagacgcacgacgccggccctgggctgccgtggtcaacggcttacctcccacgaagagtacttgaacgcgggcg

SEQ ID NO: 428396 - DNA, 541 bp, Homo sapiens
  misc_feature: GZ8MTXP01D76VW.19.53.E09.1.454.CMB.2.raw
  modified_base (259)..(259): a, c, t, g, unknown or other
  modified_base (300)..(300): a, c, t, g, unknown or other
  modified_base (348)..(348): a, c, t, g, unknown or other
  modified_base (481)..(481): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggaggcttggtacagcctggcaggtccctgagactctcctgtgcagcctntggattcacctttgatgattatgccatgcacgtgggtccgnaagctccgaggggaaggctggagtggtctcgaggtatagtgaataagngctagtatagcctatgcggtactcgtggtagaacggggccattcaaccctatcctaccgaagacgaaccaaaccgacccaaagggtaaaccctccctaggtaactctgaacaaatagaacctagtctgagaancgttggacgacgacgtcttagttacttacgtgtgaacgaagggaggttataacggcaacg

SEQ ID NO: 428397 - DNA, 641 bp, Homo sapiens
  misc_feature: GZ8MTXP01B62C0.19.53.E09.1.454.CMB.2.raw
  modified_base (198)..(198): a, c, t, g, unknown or other
  modified_base (214)..(214): a, c, t, g, unknown or other
tcagtactctcgtgcacgaccggtgctcgatttagagagagtgtgttgggtttgggagctctgggagaggagccccagccctgagattcccaggtgtttccattcagtgatcagcactgaacacagaggactcaccatggagttgagactgagcgtgtagttccttaggctatttaaagtgtcagtgtgaagtgcagngtggtggagtgtgggnggtgtgtacgagcgtgcgacgtccgtgagactctcgtgtgcgcgtctcgtgtacttctacttagtatagtattatcgtctagtcgcgtacgtcggtccggacgacgacgtacggacgggacggcggtggtaggtcggtcgtagtagtagttagttaagtagtgtagtagtagtagtacgtacgtagtcgtacgtacgtcgtaggtaggacggtacgtacgtactacctacgtacctaccgaacgaacgaaccgaaccggaaccgtaaacgtaaccgtacccgtacgtacgtacgtacgtaacgtaaacgtaacgtaacgtacgtacgtaacgaaggacgtacgttacggtaacggtaacgttaccggttcgttacgttaacgttacgttaacggtacggtacggttaagggtaacggttaagtaacg

SEQ ID NO: 428398 - DNA, 619 bp, Homo sapiens
  misc_feature: GZ8MTXP01EUTPG.19.53.E09.1.454.CMB.2.raw
  modified_base (261)..(261): a, c, t, g, unknown or other
tcagtactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccgagggaaggcctggagtgggtctcgaggtattagttggaatagtgctagtatagcctatgcgactctgtgaaggccattcaccatctcagagacaacgccaagaacncctgtatctgacaaatgaaacagtctgagagctgagacacggcctttgtattactgtgacgaaggacggtatagcagcttaactgggtaacgactacgtcgggggccaacggggtaaccctgggtaccaccgtctcctcacgccctaccaaccgaacgggcccacgttccggtcccttcccccgtcggcccgccccgtcgtccgtcccgacgggacgccgaacccgtccggaacgacgaccaaccgacggcccgggtccccgtcggggcctcggacgttcgggtaccgaaacgggttacccttaaccgttaaccccgaacggtaacggaacggttaccttaggaacggccggggtcgg

SEQ ID NO: 428399 - DNA, 402 bp, Homo sapiens
  misc_feature: GZ8MTXP01BIR3E.19.53.E09.1.454.CMB.2.raw
  modified_base (312)..(312): a, c, t, g, unknown or other
  modified_base (397)..(402): a, c, t, g, unknown or other
tcagtactctcgtgcacgaccggtgctcgatttagagagagtgtgttgggtctcaggtattagttggaataatgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctgggtcaccgtctcctcagcctccaccaagggcccatcggtcttccccctggcgccctgctccaggngcacctccgagagcacagcggccctgggcctgctggtcaaggactactccacgagagtactgagcgggctggcaaggcgcatagnnnnnn

SEQ ID NO: 428400 - DNA, 586 bp, Homo sapiens
  misc_feature: GZ8MTXP01EW3TM.19.53.E09.1.454.CMB.2.raw
  modified_base (266)..(266): a, c, t, g, unknown or other
  modified_base (571)..(571): a, c, t, g, unknown or other
tcagtactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaagggccattcaccatctccagagacaacgccaagaacctcccngtatctgacaaatgaaacagtctgagagctagaggacacggtctttgtattacgtgtgacgaaagggaggtactagcaggcctaacgtgggtaacgaactacggtcgggggacccaacggggtaacccctgggtccaccgtctcctcacgcctccaccgaacgggcccctacgtccgtcctccccgtggcccgcccgtcggcctaccgacggacgccgacccgtcgacgacgctacgcgccggcccgtgggccttggcccttgggtacaacggttaccttaccttcccgaagagtaacgttacgnggacggtcggcgtgg

SEQ ID NO: 428401 - DNA, 610 bp, Homo sapiens
  misc_feature: GZ8MTXP01BCM93.19.53.E09.1.454.CMB.2.raw
  modified_base (210)..(210): a, c, t, g, unknown or other
  modified_base (215)..(215): a, c, t, g, unknown or other
  modified_base (219)..(219): a, c, t, g, unknown or other
  modified_base (224)..(224): a, c, t, g, unknown or other
  modified_base (245)..(245): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagcggtgtagttccttaggctatttaaaagtgtccagtgtgaagtgcagctggtgagtctggggaggntgtanagtntgcgngtccgtgagactctctgtgcncgctctgtatctacttgtatgtatatcgctatgcgtacgtcggtcggacgacgcgtacgacgggacggcgtcggtaggtggtcgtcgtaggtagttagttaggtagtaagtagtgtagtagtagtacgtagtgtcgtacgtcgtgtaggacgggtacgtactactacctactacctaccgacgacgaaccgaaccgaaccgaaaccggtaaccgtacccgtacgtacgtacgtacgacgtaacgtaacgtaacgtacgtacgtacgtaagaacgtacgttacggtacggaacgtaccggtacgttacgttacgttacgtaacgtacggtaacggtaagggtaaggttagtaacgttaacgtaacg

SEQ ID NO: 428402 - DNA, 553 bp, Homo sapiens
  misc_feature: GZ8MTXP01BJRYV.19.53.E09.1.454.CMB.2.raw
  modified_base (484)..(484): a, c, t, g, unknown or other
  modified_base (496)..(496): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctattttaaaaggtgtccagtgtgaagtgcagctggtggagtcgtgggggagcttggtacagcctggcaggtccctgagctctcctgtgcagcctctggattcactttgatgattatgccatgcacgtggggtccgcaagctaccgaggggacggcctggagtgggtctcgaggtattagtggaatagtgtcgtagtatagcctagtcggcgggtactcgtgtaggaacggggcctaattccaaccattccacccgagaacgaccaaacggcccaaagggtacccttcccgtagtactcctgaaccaaatacgaactaggttnagagaacgtcgnggaacgacgtacgtcttagttacttacgtgacgaacgaagggtagttactcgcgaag

SEQ ID NO: 428403 - DNA, 580 bp, Homo sapiens
  misc_feature: GZ8MTXP01ETBTO.19.53.E09.1.454.CMB.2.raw
  modified_base (281)..(281): a, c, t, g, unknown or other
  modified_base (359)..(359): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggaggcttggtacagcctggcaggtccctgagactctcctgtgcagcctctggattcactttgatgattangccatgcacgtcgggtccgacaagctccgaaggggaacgggcctgggagtggtctcgaggttattagtggaataggtntcgtaagtatacgcctagtggcgtactcgtggtaggaacggggtcctattccaacctattccaccgaagaacgaaccaaaccgacccaaaggtaacccttcccgtagtaactctagaactaaaatacgaaactagtcaggaagaacgcgttagggacggaacgtacggtcctttaggttacttacgtggtagaacgaaagggtaggttataaggctaacgg

SEQ ID NO: 428404 - DNA, 552 bp, Homo sapiens
  misc_feature: GZ8MTXP01D6O59.19.53.E09.1.454.CMB.2.raw
  modified_base (300)..(300): a, c, t, g, unknown or other
  modified_base (411)..(411): a, c, t, g, unknown or other
  modified_base (456)..(456): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctattttaaaaggtgtccagtgtgaagtgcagctggtggagtcgtgggggagcttggtacagcctggcaggtccctgagactctcctgtgcagcctctggattcacctttgatgattatgccatgcacgtggggtccgnaagctccgaaggggaacgggcctggagtggggtctccgagggtattaggtggaataaggtgctagtatacgcctagtggcggtactcgtgtaggagggctattcaacatcncagacgaacaacgtaccaaacggtaactccctataactctacganaaatacgaactagtcgagagaagtcgaggaacggacgtaacgggtccttaggttacttaacgtggtacgaacgaaggggtagttagtaagcgtaag

SEQ ID NO: 428405 - DNA, 502 bp, Homo sapiens
  misc_feature: GZ8MTXP01D6GWA.19.53.E09.1.454.CMB.2.raw
  modified_base (299)..(299): a, c, t, g, unknown or other
  modified_base (439)..(439): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctggggggagcttggtacagcctggcaggtccctgagactctcctgtgcagcctctggattcacctttgatgattatgccatgcacgtgggtccgnaagctccgagggacggccgagtggtctcgaggtattagtggaatgtgctaagtatagcctagtgcggatctgtgaaggcgatcaccatctcagagacaacgacaacgactccctgtatctgacaatgaaactgtctgagngctagacggacacgggtcctttgttacttcgttgtgacgaagggaggtattagcgaagtaacg

SEQ ID NO: 428406 - DNA, 614 bp, Homo sapiens
  misc_feature: GZ8MTXP01EHTVM.19.53.E09.1.454.CMB.2.raw
  modified_base (293)..(293): a, c, t, g, unknown or other
  modified_base (543)..(543): a, c, t, g, unknown or other
  modified_base (591)..(591): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagcttggtacagcctggcaggtccctgagactctcctgtgcagcctcgtggattcactttgatgattangccatgcacgtgggtcccgacaacgcctaccggagggggacggccgtgggaggttcggggtctacgtaggttatttaggttaagggaaattggtgtacgttaaggttaactacggccttaagtcgggaccggtacttcgtagggtacggaaacgggtcccgtaatttccaacctactcccaccgaagaacgaccaaaccgggaccaaacggtaacccttcccgtagtaactctagaactaaatcgaaacngtcgaaggagacgcgttaggaacggtacacggttcttagtaattacgngtagacgaagggtgttaagaacg

SEQ ID NO: 428407 - DNA, 541 bp, Homo sapiens
  misc_feature: GZ8MTXP01EYG8O.19.53.E09.1.454.CMB.2.raw
tcagtactctcgtgcacgaccggtgctcgatttagagagagtgtgttgagtctggggaggcttggtacagcctggcaggtccctgagactctcctgtgcagcctctggattcacctttgatgattatgccatgcactgggtccggcaagctccgagggaaggcctggagtgggtctcaggtattagttggaatagtgctagtatagcctatgcggactctgtgaaggccattcacatctcagagacaacgccaagactcctgtatctgacaaatgaacagtctgagagctagacggacacggtcctttagtattactgtgacgaaaggaggtatagcaggactacgtggtacgactacgtggggaccagggaccctgtccaccgtctcctcacgccctaccaccgaacgggcccagtcccggtccttcccccgtggccgtccctgcctccgaggcgccacccgtcgagcgcacgcgccggcccttgggcttcgccgtggcgaacggctaacctcccgaagacgagttactggaacgccggg

SEQ ID NO: 428408 - DNA, 598 bp, Homo sapiens
  misc_feature: GZ8MTXP01B3AL9.19.53.E09.1.454.CMB.2.raw
  modified_base (264)..(264): a, c, t, g, unknown or other
  modified_base (347)..(347): a, c, t, g, unknown or other
tcagtactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccattcacatctccagagacaacgccaagactcccngtatctgacaaatgaacagtctgagagctgaggacacggtcctttgtattactgtgcaaaggagtatagcagctacgtggacnctagtcggggaccacggggaacccttgggtccacccgtctccctcacgccctaccacccgaacgggccccacgtccggtcccttcccccgtggccgcccctgggccctccgacggacgccacccgtccgagacgcaccgacggtccggccccgtggggccttcgggcccgttgggtaccgaaacgggttacccttaccgttccccgaacgggacggtaacgttaccggcgggacgggtccggggcgtcggg

SEQ ID NO: 428409 - DNA, 385 bp, Homo sapiens
  misc_feature: GZ8MTXP01CSTST.19.53.E09.1.454.CMB.2.raw
  modified_base (266)..(266): a, c, t, g, unknown or other
  modified_base (314)..(314): a, c, t, g, unknown or other
  modified_base (358)..(358): a, c, t, g, unknown or other
  modified_base (382)..(385): a, c, t, g, unknown or other
tcagtactctcgtgcacgaccggtgctcgatttagagagagtgtgttgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactacgtggggccagggaaccctggtcaccgtctctcagccncacaaggccatcggtctcccctgcgccctgctccagagcacctcgagngcacagcgcctgggcctgctgtcaagactactccagagagtacngagcgggctggcaaggcgcatagnnnn

SEQ ID NO: 428410 - DNA, 527 bp, Homo sapiens
  misc_feature: GZ8MTXP01AIZA8.19.53.E09.1.454.CMB.2.raw
  modified_base (365)..(365): a, c, t, g, unknown or other
  modified_base (398)..(398): a, c, t, g, unknown or other
  modified_base (452)..(452): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaggtgtccagtgtgaagtgcagctggtggagtcgtgggggagcttggtacagcctggcaggtccctgagactctcctgtgcagcctctggattcacctttgatgattatgccatgcacgtggggtccgcagctccgaggggacgggcctggagtgggtctcgaggtattagtggaatagtgctagtatagcctagnggcgactcgtgtaggaagggccattccacatcnccagacaacacgccaaggaacctcccgtagtactctgacaaatcgaaactgtcngagaacgcttaggacggacgccgggtctttggttacttacgtggtgaacgaaggggtagttagtaacgcgtaacg

SEQ ID NO: 428411 - DNA, 527 bp, Homo sapiens
  misc_feature: GZ8MTXP01A2U2T.19.53.E09.1.454.CMB.2.raw
  modified_base (300)..(300): a, c, t, g, unknown or other
  modified_base (469)..(469): a, c, t, g, unknown or other
  modified_base (473)..(473): a, c, t, g, unknown or other
  modified_base (504)..(504): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtgggggagcttggtacagcctggcaggtccctgagactctcctgtgcagcctctggattcacctttgatgattatgccatgcacgtcggggtccgnaagctcgaggggaggcctgggagtgggtctcgaggtattaggtgaataagtgctagtatagcctagtcgcggtactcgtggtggaaggggcctaattccaccatcctaccgagacgacaacgccaaacggaacctccctgtactctagacaaatagaactagtctgagngcgngaggacgacgggtccttgttattacgtggtnaacgaaggagttataagcgtaag

SEQ ID NO: 428412 - DNA, 526 bp, Homo sapiens
  misc_feature: GZ8MTXP01AEQBF.19.53.E09.1.454.CMB.2.raw
  modified_base (470)..(470): a, c, t, g, unknown or other
  modified_base (502)..(502): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagcttggtacagcctggcaggtccctgagactctcctgtgcagcctctggattcacctttgatgattatgccatgcactgggtccgcaagctaccgagggaaggcctggagtcgggtctgaggtattaggttaggaatgtgctagtatagctatgcgatctgtgaagggccagttcaccatctccagacgacaacgggccaaaggtaacctcccctagtactctgacaaatgaaaccagtctggaagngcgttggagaccgcgttcctttagtaacttgngtacgagaagggtgttaagtaacg

SEQ ID NO: 428413 - DNA, 561 bp, Homo sapiens
  misc_feature: GZ8MTXP01B9WVP.19.53.E09.1.454.CMB.2.raw
  modified_base (438)..(438): a, c, t, g, unknown or other
tcagtactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaagggccgattcaccatctccagagacaacgccaaagaactccctgtatctgacaaatgaacagtctgagagctgaggacacggcctttgtattactgtgcaaggaggtatagcagctaacgtggtaacgactacgtgggggccaggggaaccctggtccaccgtctccctcacgccctccaaccgaacgggccccagtccggtccttcccccgnggcccgccccgtgcctccgaggacgccaccgtccgagcgcacacggccggccctggggcctcgcccgtgggtccaacgggttccttacctcccagaacgacggtaccttggaacggcgggtcg

SEQ ID NO: 428414 - DNA, 527 bp, Homo sapiens
  misc_feature: GZ8MTXP01CZ8XI.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtgggggaggcttggtacagcctggcaggtccctgagactctcctgtgcagcctctggattcacctttgatgattatgccatgcacgtgggtccgcaagctccgagggaggcctggagtggtctcgaggtattgtagaataagtgctagtatagctatgcggactctgtgagggccgattcactatctccagacgaacaacgaccaaggtaacctccctagtactctagacaaagtgaactagtctaggagaacgcgttggaacggacgaacgggtcctttaggttctttacgtggtgaacgaagggaggttactggcgtaagg

SEQ ID NO: 428415 - DNA, 545 bp, Homo sapiens
  misc_feature: GZ8MTXP01AFL52.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttggtacagcctggcaggtccctgagactctcctgtgcagcctctggattcactttgatgattatgccatgcacgtgggtccgcaagctccgagggaggcctggagtcgggtctgaggttattaggttaggaattgtgcttaaggtataggcctatgcggtactcgtgtaggaagggccgattcacatctccagacgacaacggccaaagacctccctagtactctagaccaaatcgaaactagtctaagagagccgttggaacggacttacgggttcctttaggtaacttcgtggtgaccgttaagggtggttaataagg

SEQ ID NO: 428416 - DNA, 585 bp, Homo sapiens
  misc_feature: GZ8MTXP01CBC79.19.53.E09.1.454.CMB.2.raw
  modified_base (259)..(259): a, c, t, g, unknown or other
  modified_base (565)..(565): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctattttaaaaggtgtccagtgtgaagtgcagctggtggagtcgtggggggagcttggtacagcctggcaggtccctgacgctctcctgtgcagcctntggattcacctttgatgtattatgccatcgctacgtggggtcccgacaaggcctaccggagggggaacgggccgtgggacggttggggtctaccgtaggttattaggtggaatagtgctagtatagtcctagtcggacgactctggtaggacgggcctattcacactctaccaagacgaactaacgaccaaacggacttcccgtagtactctagaaccaaatacgaaactaggtactaggaagaacgtcgttagggaacggacgtaccgggtctttaggttacttacgtgtcgaacggtaaagggngttaagtcgaacgtaacggg

SEQ ID NO: 428417 - DNA, 538 bp, Homo sapiens
  misc_feature: GZ8MTXP01EZFJV.19.53.E09.1.454.CMB.2.raw
  modified_base (312)..(312): a, c, t, g, unknown or other
  modified_base (406)..(406): a, c, t, g, unknown or other
  modified_base (509)..(509): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagcctggcagggtccctgagactctcctgtgcagcctctggattcacctttgatgattatgtcatgcacgtgggtccgnaagctccgagggaggctggagtcggtctgaggtattaggtagaatgtgctagtatagctatcgcgactgtgtagaagggccgtattcactatcncaagagaccaacgacaaagaacctcctagtactcgtagaacaaagtgaaactgtctaaggagaagcgttaggacggaaccacggttccttaggtaattaacgngttggacgttaaagggtggttaactaagg

SEQ ID NO: 428418 - DNA, 533 bp, Homo sapiens
  misc_feature: GZ8MTXP01A4YYI.19.53.E09.1.454.CMB.2.raw
  modified_base (298)..(298): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctattttaaaaggtgtccagtgtgaagtgcagctggtggagtcgtgggggagcttggtacagcctggcaggtccctgagactctcctgtgcagcctctggattcactttgatgattatgccatgcacgtgggtccgnaagctccgagggaggcctggagtggtctcgaggtatagtggaatagtgctagtatagcctagtgcggtactcgtgtggaacgggccgtattcgaacctatcaccagacgaacaacgccaaaggtaaccctcccgtagtactctgaacaaatacgaaactagtctaggaagaacgcgttaggaagacgacgggtccttagttcttacgtgtcgaagaagggagttataagcgtaag

SEQ ID NO: 428419 - DNA, 535 bp, Homo sapiens
  misc_feature: GZ8MTXP01DIK20.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttggtacagcctggcaggtccctgagactctcctgtgcagcctctggattcacctttgatgtattatgccatgcacgtcggggtccggcaagctccgaggggacgggcctggaggtggtctccgaggtattagttggaatagtgctagtatagcctatgcggactctgtggaagggcctagttcacctatctccagagacaacgaccaaggaacctccctagtactctgacaaatagaaactagtctgagaagcgttaggacggacgtacgggtcctttaggttacttacgtgtacggcgaagggaggttataagcgtaag

SEQ ID NO: 428420 - DNA, 566 bp, Homo sapiens
  misc_feature: GZ8MTXP01A6EQZ.19.53.E09.1.454.CMB.2.raw
  modified_base (292)..(292): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggaggcttggtacagcctggcagggtccctgagactctcctgtgcagcctctggattcacctttgatgattangccatgcacgtcgggtccggcaagctccgagggggaacgggcctgggagtcggggtctcgagggttattaggttagggaattggtgctaaggtataggtccctatcggcgggtactcgtggtggaacgggccgtattccaccatcctaccgaagacgaaccaacgggccaaagaacctccccgtagtactctagacaaatcgaactagtctgagttagccttggacggacaccgggttcttggtaacttcgtgtgacgaaggtgttaagtaacg

SEQ ID NO: 428421 - DNA, 566 bp, Homo sapiens
  misc_feature: GZ8MTXP01B096X.19.53.E09.1.454.CMB.2.raw
  modified_base (268)..(268): a, c, t, g, unknown or other
  modified_base (309)..(309): a, c, t, g, unknown or other
  modified_base (504)..(504): a, c, t, g, unknown or other
  modified_base (518)..(518): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaggtgtccagtgtgaagtgcagctggtggagtcgtgggggaggcttggtacagcctggcaggtccctgagactctcctgtgcagcctntggattcacctttgatgattatgccatgcacgtgggtccgnagctccgagggaggctggagtcggtctgaggtattaggttaggaatggtgactagtatagcctagtcgcggtactcgtggtaggaacgggccgtaattccaaccagttccacccgaagaacgaacccaaacggggacccaaaggtaaccctcccgtagtactcctagaaccaaagtcgaactaggttcaagaagngcttaggacggacnccggttcttaggtaattacgtgtacgagaagggtaagttaagtaacgg

SEQ ID NO: 428422 - DNA, 403 bp, Homo sapiens
  misc_feature: GZ8MTXP01B5DBV.19.53.E09.1.454.CMB.2.raw
  modified_base (232)..(232): a, c, t, g, unknown or other
  modified_base (266)..(266): a, c, t, g, unknown or other
  modified_base (292)..(292): a, c, t, g, unknown or other
  modified_base (306)..(306): a, c, t, g, unknown or other
  modified_base (316)..(316): a, c, t, g, unknown or other
  modified_base (375)..(375): a, c, t, g, unknown or other
  modified_base (395)..(395): a, c, t, g, unknown or other
  modified_base (397)..(397): a, c, t, g, unknown or other
  modified_base (399)..(403): a, c, t, g, unknown or other
tcagtactctcgtgcacgaccggtgctcgatttagagagagtgtgttgggtctcaggtattagttggaatagtgctagtatagcctatgcggactctgtgaagggccgattcaccatctccagagacaacgccaagaactccctgtatctgcaaaatgaacagtctgagagctggaggacacggccttgtattactgtgacaaggagtatagcagctactggtacactacgnggggccagggacctggtcaccgtctcctcagccnccacaggccatccggtctcccctgcnccctgctccaggancacctcgagngcacagccgcccgtgggccctgctggtacaaacggtactaccttcccgagagagtacgnggacggcggctgacgaggcnangnnnnn

SEQ ID NO: 428423 - DNA, 619 bp, Homo sapiens
  misc_feature: GZ8MTXP01CJJD2.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcgttggtacagcctggcaggtccctgacgactctcctgtgcagcctctggattcacctttgatgattatgccatgcacgtcggggtccgacaacgccgtaccgaagggggacgggccgtgggaggtgggtctcgtaggtattagtggaatagtgctagtatacgcctagtcgcgggacttcgtggtaggaacggggcctattaccgacctattccaccgaagaacgaaccaacgacccaaagggtacccttcccgtagtactccgtagaactaaatacgaaactcggttacaggaagaacgtcgttacgggaacggaccgtaaccgggttccgttttaggttactttaaccggtggttaacggaacggtaaaagggggtaggttaacttaacggcgttaacggg

SEQ ID NO: 428424 - DNA, 575 bp, Homo sapiens
  misc_feature: GZ8MTXP01AGTUB.19.53.E09.1.454.CMB.2.raw
  modified_base (294)..(294): a, c, t, g, unknown or other
  modified_base (314)..(314): a, c, t, g, unknown or other
  modified_base (385)..(385): a, c, t, g, unknown or other
  modified_base (546)..(546): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagtcttggtacagcctggcaggtccctgagactctcctgtgcagcctctggattcacctttgatgattangccatgcacgtggggtccgnaacgctaccgaggggaacggcctgggagtcggtctgaggttattaggtggaatgtgactagtatagcttancggcggtactcgtggtaggaacggggcctacttcaccatccaccagacaccaacggacaaacgtaccctccgtagtactaccgtgaactaaagtgaaacctggttacaaggaagttacgcgttaggaacggaccgttaccgggttcctttagtaattacgnggtagacggaagggtaaggttaataacgg

SEQ ID NO: 428425 - DNA, 555 bp, Homo sapiens
  misc_feature: GZ8MTXP01CLXPE.19.53.E09.1.454.CMB.2.raw
  modified_base (269)..(269): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagcttggtacagcctggcaggtccctgagactctcctgtgcagcctntggattcacctttgatgattatgccatgcacgtgggtccgcaagctccgagggacggccgtggagtcgggtctcgaggttattaggtagaatgtgactagtatagctagtgcggactcgtgtagaagggtccagttcacctatctaccagacgaaccaacgggccaaacgtacctcccgtagtactctagaccaaagtcgaaactagtctaagaagagccgttggaacggcgaccgggttccttaggtaacttacgtggtcgacgaagggtaaggttaagtaacgg

SEQ ID NO: 428426 - DNA, 610 bp, Homo sapiens
  misc_feature: GZ8MTXP01AQXFY.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggaggcttggtacagcctggcaggtccctgagactctcctgtgcagcctctggattcacctttgatgattatgccatgcacgtgggtccggcaagctccgagggggaaggccgtgggagtcggggtctcgaggtattaggtaggaatgtgctagtatagcctatggacggtactcgtaggtggaaacgggtcccgtaatttccaaccctaagttcctacccaaggaacgaacccaaaccggggacccaaaacggaacccttaccccgttaggtaactccgtagaacctaaaagtcggaaactaggtctaagaacgagccgttggaaacggaccaccgggttcctttaggtaactttacgtggtgacggttaaagggtaaggttaagaagg

SEQ ID NO: 428427 - DNA, 653 bp, Homo sapiens
  misc_feature: GZ8MTXP01A2XCA.19.53.E09.1.454.CMB.2.raw
  modified_base (267)..(267): a, c, t, g, unknown or other
  modified_base (292)..(292): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaggtgtccagtgtgaagtgcagctggtggagtcgtgggggagcttggtacagcctggcaggtccctgagctctctgtgcagcctntggtacttctacctttgatgattancgccatcgctacgtcggggtcccgacaacgccgtaccggagggggaacgggccgtgggaggtcggggtctacgtagggttattaggttaagggtaattggtgtacgtaagtatacgccttagtcgggacgtactcgtagggtacgggaacggggtcccgtaagttcccaacctacgttcccgacccgaaaggaaccgaaacccaaacccgggggaccctaaaacggtaaccccttaccccgttagtaacctcgttacgaactaaagtcgaaacctagtcgtaagacgagccgttaggaacggaccttaccgggttctttagtaacttacgtggtacgacgttaagggtcggttaataacgg

SEQ ID NO: 428428 - DNA, 623 bp, Homo sapiens
  misc_feature: GZ8MTXP01C2W79.19.53.E09.1.454.CMB.2.raw
  modified_base (269)..(269): a, c, t, g, unknown or other
  modified_base (291)..(291): a, c, t, g, unknown or other
  modified_base (316)..(316): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttaattttaaaaggtgtccagtgtgaagtgcagcgtgggtggaggtcgtggggggaggcgttggtacagcctggcaggtccctgacgactctcctgtgcagcctntggattcactttgatgtattangccatcgctacgtcggggtcccganaacggccgtaccggagggggaacggccgtagggacggtgggtctaccgtagggttattaggtaggaatagtgcttagtatacgcctagtcggcgtacttgtggtaggaacgggtccaattccaactattccaccaagacaacaaccgccaaaggtacccttccgtagtactactagaactaaagtacgaaactcgttcaggaagaacggtcgttacgggaaacgggacccgttaacgggttccttttaggttaactttaccggtggacgtaacgtaaagggggtaggttaataacgaaccgtaaggg

SEQ ID NO: 428429 - DNA, 515 bp, Homo sapiens
  misc_feature: GZ8MTXP01DJYWG.19.53.E09.1.454.CMB.2.raw
  modified_base (268)..(268): a, c, t, g, unknown or other
  modified_base (448)..(448): a, c, t, g, unknown or other
  modified_base (454)..(454): a, c, t, g, unknown or other
tcagtactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaaagaactcccngtatctgcaaaatgaaacagtctgagagctgaggacacggccttgtatactgtgcaaggaggtatagcagctactggtacgctactggggcccaggggaacccctgggtcacccgtctcctcagcctccaccaagggcccatcgtcttcccctgcgccctggctcagacgcacctccganagcacngcgcctgggcttgccttggtcaaggacttacttcccaagacgaagtactgagcgggctggg

SEQ ID NO: 428430 - DNA, 532 bp, Homo sapiens
  misc_feature: GZ8MTXP01BOA3K.19.53.E09.1.454.CMB.2.raw
  modified_base (311)..(311): a, c, t, g, unknown or other
  modified_base (357)..(357): a, c, t, g, unknown or other
  modified_base (456)..(456): a, c, t, g, unknown or other
  modified_base (505)..(505): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagcctggcaggtccctgagactctcctgtgcagcctctggattcactttgatgtattatgccatgcacgtgggtccgnaagctcgagggaggctggagtcggtctgaggtattagtagaatgtnactagtatacgctagtcgcggtatcgtggaggaacgggcctattcacatccacagacgaccacggacaaagacctcctagactctgaactaaatgaacngttcaagagttgcgttggaaacggcacgggttcctttaggtaattacgngtacgagttaagggtaagttaagaacg

SEQ ID NO: 428431 - DNA, 557 bp, Homo sapiens
  misc_feature: GZ8MTXP01BLW97.19.53.E09.1.454.CMB.2.raw
  modified_base (549)..(549): a, c, t, g, unknown or other
  modified_base (556)..(556): a, c, t, g, unknown or other
tcagtactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccgagggaagggcctggagtgggtctcaggtattagttggaatagtgctagtatagcctatgcggactctgtgaagggccattcaccatctccagagacaacgccaagaactccctgtatctgacaaatgaacagtctgagagctgaggaccacggtcctttagtattactgtgacgaaagggacgtatagcagccttaaacgtgggtaacgacctacggtcggggacccaaggggaacccctggtacccaccgtctcctcacgccctccaaccgacggccctagtccggttccttccccgtggcccgcctcgcctccgaggacgccaccctcgagcgcacgcgccgcccgtgggctcgccgtggtcacggcttccgtaacccagaacgacgtacgngcgcggng

SEQ ID NO: 428432 - DNA, 530 bp, Homo sapiens
  misc_feature: GZ8MTXP01D6DNB.19.53.E09.1.454.CMB.2.raw
  modified_base (406)..(406): a, c, t, g, unknown or other
  modified_base (526)..(526): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggcttattttaaaaggtgtccagtgtgaagtgcagctggtggagtcgtgggggaggcttggtacagcctggcaggtccctgagactctcctgtgcagcctctggattcacctttgatgattatgccatgcacgtcggggtccgacaagcctccgagggggaacgggcctggagtgggtctcgaggtattagtgaataagtgctagtatagcctagtgcggactcgtgtgaacgggccattcacatcnccagacgacaacgccaaagaacctcctagtactctgacaaatagaaacctgtactggagaagcgttggaacggacacgggtcctttaggttaccttagtgtgaagagggagttataacgnaacg

SEQ ID NO: 428433 - DNA, 650 bp, Homo sapiens
  misc_feature: GZ8MTXP01DE60T.19.53.E09.1.454.CMB.2.raw
  modified_base (263)..(263): a, c, t, g, unknown or other
  modified_base (283)..(283): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttcctttggcttaattttaaaaggtgtccagtgtgaagtgcagcgtggtggagtcgtgggggagcgttggtacagcctggcaggtccctgagactctcctgtgcagcctntggattcacttgatgattangccatgcacgtcggggtccgacaagccgtaccggaagggggaacgggtcctaggggacggttcggggtccttaccggaagggtttatttagggttaggaaattacgggtgtaacgtaagttaagtacgtacccttaagtcggcgggtacttcgtaggtaggaaacgggcctattccaaccctatcctaccgaagacgaacctaacgaccccaaaggtacctccctgtaactcctagaccaaatacggaaactggttccaggaagtaacgcggttaggaaacggttaccgtaaccggtcctttaggttaattaccggttggtaaggaaccggtaaaaggggtacggttaagtaacggcgttaaaccgg

SEQ ID NO: 428434 - DNA, 613 bp, Homo sapiens
  misc_feature: GZ8MTXP01DJYBB.19.53.E09.1.454.CMB.2.raw
  modified_base (260)..(260): a, c, t, g, unknown or other
  modified_base (280)..(280): a, c, t, g, unknown or other
tcagtactctcgtgcacgaccggtgctcgatttagagagagtgtgttggctctgggagaggagccccagcactgagattcccaggtgtttccattcagtgatcagcactgaacacagaggactcaccatggagttgagactgagctggtattttcctttggcttaatttaaaggtgtccagtgtgaagtgcagctgggtggagtcgtgggggagcttggtacagcctggcaggtccctgagactctcctgtgcagcctgnggattcactttgatgattangccatgcacgtcgggtccgcaagcctaccggaagggggaggcctaggggagtcgggtcctgtaggttattaggtggaaaattggtgactaagtatacgccttagtcggacggtacttcgtggtacgggaacgggtccctaattaccaacctatcccaccgaagaacgaaccgaaaccgaccaaacgtaacccttcccgtagtactccgtagaactaaaagtcgaaactaggtctaggaagtagccgtaagggacgggtaacctaccggggttacctttgggttaactttaagtggtaagaacgaaaggggttacgttaattaacgggtaaccg

SEQ ID NO: 428435 - DNA, 575 bp, Homo sapiens
  misc_feature: GZ8MTXP01D7H5T.19.53.E09.1.454.CMB.2.raw
  modified_base (262)..(262): a, c, t, g, unknown or other
  modified_base (433)..(433): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttattttaaaaggtgtccagtgtgaagtgcagctggtggagtcgtgggggaggcttggtacagcctggcaggtccctgagactctcctgtgcagcctntggattcacctttgatgtattatcgccatgctacgtcggggtccgacaacggcgtacccggaaggggaacgggccgtgggaggtgggtctacgaggttattaggtaggaataagtgtcgtagtatacgtcctagtcggacggtactcgtggtaggaacgggctattccacntcacagacacaacgaccaaacggtaccctccgtagtactctagaacaatacgaactagtcgaggagaacgcgttaggacggacgtaccggtcttagttacttacgtggtacgtaacgaagggtagttagtcgaacgtaacgg

SEQ ID NO: 428436 - DNA, 559 bp, Homo sapiens
  misc_feature: GZ8MTXP01EMFL9.19.53.E09.1.454.CMB.2.raw
  modified_base (313)..(313): a, c, t, g, unknown or other
  modified_base (488)..(488): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggctattttaaaaggtgtccagtgtgaagtgcagctgggtggagtcgtgggggagcttggtacagcctggcaggtccctgagactctcctgtgcagcctctggattcaacctttgatgtattatgccatgcacgtgggtccggnaagctccgagggggaacggcctagggagtcgggtctagtaggtattaggttagaaatgtgtactaggtatacgctagtgcggtatcgtaggagaaggggcctaattccaacatccacaagacgacaaacgggaccaaagaccttcccgatactctagacaaagtcgaactagtcngagagtacgttggaacggtacaccgggttctttagtaacttagtgtaggacgaaagggtaagttaagaagg

SEQ ID NO: 428437 - DNA, 581 bp, Homo sapiens
  misc_feature: GZ8MTXP01BBIQ9.19.53.E09.1.454.CMB.2.raw
  modified_base (492)..(492): a, c, t, g, unknown or other
  modified_base (514)..(514): a, c, t, g, unknown or other
  modified_base (571)..(571): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttattttaaaggtgtccagtgtgaagtgcagctggtggagtcgtgggggagcttggtacagcctggcaggtccctgacgactctcctgtgcagcctctggattcactttgatgattatgccatgcacgtcgggtccgacaagccgtacccgaggggaacggccgttagggagtggggtcctacgtaggttagtttaggtaggaattaggtgtcgttaagtagtaacgcctagtacgggcggtactccgtggtaggaacgggcgtacttccgacctactctaccaagacgaacaaccgcctaaacggaacccttccccgtagtacttccngaacctaataccggaatgtacngagaatcgaggacgaccgtacggtccttggttacttagtgtacgaagaaggagttancgaagtaacg

SEQ ID NO: 428438 - DNA, 625 bp, Homo sapiens
  misc_feature: GZ8MTXP01DP3OT.19.53.E09.1.454.CMB.2.raw
  modified_base (267)..(267): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagagtactcaccatggagttgagactgagctggtattttccttttggctattttaaaggtgtccagtgtgaagtgcagctggtggagtcgtgggggagcttggtacagcctggcaggtccctgagctctcctgtgcagtccnctggacttcacctttgatgattatgccatgcacgtcgggtccgcaagctccggaaggggacggcctagggagtcgggtctagtaggtattaggtagggaattggtgtactagtactaggaccttagtcgacgggtacttcgtaggtacggaacgggtccgtacttaccacctaattccaccaaggaacgaaccaaaccggggacccaaacggtaacccttaccccgtagtaacttcacgtaactaaattacggaaactacggtcgtggaaggacgtcgttaggaaacgggtaccttaccgggttcctttaggttaacttaacgtggtacggacggttaaagggtaaggttaataacgg

SEQ ID NO: 428439 - DNA, 671 bp, Homo sapiens
  misc_feature: GZ8MTXP01AXL3T.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttccttttggcttaattttaaaaggtgtccagtgtgaagtgcagctggtggagtcgtgggggagcttggtacagcctggcaggtccctgagactctcctgtgcacgcctcgtggtacttctacctttggatgatttatgcctagtcgcacgttcgggggtcccgcaacgccgtccggagggggaacgggccgtggggagttcgggtctacgaggttagttaggtaggaattggcgtactagtactagcctagtcgacgtactcgtggtagggaacggccgtaattcccaaccacttccacccgaaggaacgaaccgaaaccggggaaccaaaacggtaaccccttaccctaggttaaacctcgtacggaaacctaaaagtcggtaaacctaggttaccggtaaggaaacggaggaccggttaagggaaccggtaaccggttaccggttccgtttagttaaccgttaggtaacggtacggaacgggttaagggtaacggttaagtaacg

SEQ ID NO: 428440 - DNA, 580 bp, Homo sapiens
  misc_feature: GZ8MTXP01EGAQM.19.53.E09.1.454.CMB.2.raw
  modified_base (269)..(269): a, c, t, g, unknown or other
  modified_base (520)..(520): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggctattttaaaaggtgtccagtgtgaagtgcagctggtggagtcgtgggggagcttggtacagcctggcacggtccctgagactctcctgtgcagcctntggacttcactttgatgattatgccatgcacgtgggtccggacaacgcgtaccggagggggacggtcgtgggagtcgggtctgaaggttattaggttaggaatcggtgtactagtatacgctagtcgacggtactcgtggtaggaacgggccgtaattccacctatccaccgaagaacgaaccaaccggacccgtaaagtaacccttcccgtagtactccgtagaactaaagtagaactagtcgtaagagngtcgaggacgaacgttacggttcttgtaacttagtggtagacgaaggtaagttaagtaag

SEQ ID NO: 428441 - DNA, 592 bp, Homo sapiens
  misc_feature: GZ8MTXP01CQKQR.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagcttggtacagcctggcaggtccctgagactctcctgtgcagcctctggattcacctttgatgtattatcgccatgcacgtgggtccgcaagctccgagggacggcgtggagtcggtctgaggtattaggtaggaatgtgactagtatagctatcgcggactcgtggtggaacgggcccgtaatttcccgacctattcccgaccaaggacgaaccaaaccggcccaaaagtaaccctcccgtagtactcgtacgaacctaaatcggaaactacggtctaaggaagacgtcgttggaaacgggtaccaccgggttcctttaggttaactttaccgtggtcgaacggttaaagggtaaggttaagtaacgg

SEQ ID NO: 428442 - DNA, 539 bp, Homo sapiens
  misc_feature: GZ8MTXP01DZ91L.19.53.E09.1.454.CMB.2.raw
  modified_base (280)..(280): a, c, t, g, unknown or other
  modified_base (350)..(350): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtgggggaggcttggtacagcctggcaggtccctgagactctcctgtgcagcctctggattcacctttgatgattangccatgcacgtgggtccgcaagctccgagggacgggcctggagtggtctcgaggtattaggtgaatagtncgtagtatagctatcggcggtactcgtgtggaacgggccgtattcacctatcctaccagaacaacaacgaccaaacgggtaacctccctgtaactctgaccaaattacgaaactagtcgtagagaagcttggaacgacgacgggtccttaggttattacgtgtagaacgaaggaggttatcggctaacg

SEQ ID NO: 428443 - DNA, 619 bp, Homo sapiens
  misc_feature: GZ8MTXP01B2NMN.19.53.E09.1.454.CMB.2.raw
  modified_base (260)..(260): a, c, t, g, unknown or other
  modified_base (289)..(289): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttcctttggcttaattttaaaaggtgtccagtgtgaagtgcagctgggtggagtcgtggggggagtcgttggtacagcctggcaggtccctgagactctcctgtgcngcctctggacttcacctttgatgtattancgccatgctacgtcggggtccgacaagcctaccggaagggggaacgggtccgtaggggaggtcggggtctaccgtaggggttatttaggttagggaattaaggtgtcgttaagtatacgtcctagtcggacggtactcgtaggtaggaacgggccgtacttcgaacctatcctacgaagacgaaccaaccgaccaaacggaaccttcccgtagtactcgtagaactaaatacgaatcgtacgtagaggaacgtcgttacggacgaccgtacggtcttagttacttacggtgtacggaacgtaaggggtagttacgtcgttaaccgtaagg

SEQ ID NO: 428444 - DNA, 632 bp, Homo sapiens
  misc_feature: GZ8MTXP01B3EL6.19.53.E09.1.454.CMB.2.raw
  modified_base (239)..(239): a, c, t, g, unknown or other
  modified_base (242)..(242): a, c, t, g, unknown or other
tcagtactctcgtgcacgaccggtgctcgatttagagagagtgtgttgggtctgggggaggcttggtacagcctggcaggtccctgagactctcctgtgcagcctctggattcacctttgatgattatgccatgcactggggtccggcaagctccaggggaagggcctggagtgggtctcaggttattagttggaatagtgctagtatagcctatgcgactctgtgaaggccattcacntcnccagagacaacgccaaagaactcctgtatctgacaaatgaaacagtctgagagctaggaggacacggtcctttgtaacttacgtgtagacaaggggtagtataggcagcttaaacgtacgggtaaccgacgtacgggtcgggggaccctaaggggtacccccttgggtaccctacccggttctcccgtacgaccgccctacccgaacccgaacgggcccctacgttcccgggttccccttcccccggtcggccccgtcccgtacgcctaccgacgggaccgcccacccgtccggaacgacgccgaccgtcggccggccccgtgggcctcggccgtggtaccaacggttccttacctaacccgagaacgtacgtacgcgaacggcgggtcg

SEQ ID NO: 428445 - DNA, 641 bp, Homo sapiens
  misc_feature: GZ8MTXP01EJH91.19.53.E09.1.454.CMB.2.raw
  modified_base (292)..(292): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagcttggacagcctggcagggtccctgagactctcctgtgcagccctctggattcacctttgatgattangcatgctagtcgggtccgacaacgcgtacggaggggaacggtcgtgggaggtcggtctagtaggttagttagtaaggaattggtgtacttagtactacgtactagtcgcgtacgtcgtaggtaggaacgggtccgtaacttaccaactactaccaccgaagaacgaacccaaacggaaccgaaacgtaacccttacccgtagttaactacgtagaacgtaaacgtaacgtaaacgtaacgtacgtaacgaaggacggtacgttacggtaacggaaccggttaccggttccgtttacgttaacgttacgttaacggtacggtacggttaacgggtaacggttaacgtaag

SEQ ID NO: 428446 - DNA, 767 bp, Homo sapiens
  misc_feature: GZ8MTXP01DBP6B.19.53.E09.1.454.CMB.2.raw
  modified_base (285)..(285): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttattttaaaaggtgtccagtgtgaagtgcagcgtggtggagtcgtgggggagcttggtacagcctggcaggtccctgacgactctcctgtgcagcctctggattcactttgatgtattangccatcgctacgtcggggtccgacaacggccgtacccggaagggggaacggggtccgttaggggtacggttcggggttccttaccggtaaggggtttaatttaggggtttagggtaaagttaagggttcgtaacgttaaaggttaacgttaacggtacccgttaagtcgggtaccgggtacgttcgttagggtacgggaaacggggtccgtaactttacccaacctacttccgtaccgaacggaaacgaaccgaaaccgacccctaaaacggggtaaccccttccccgttaagttaaccttacgtaacgtaacctaaaagttacggaaactacggttaccgtagggaaggtaacggtccggttagggaaaccgggttacccggtaaacccggggtttcccttttaaggttacgtttaaccggttaagggttacggaacggtaaaaggggtacgggttaaacgttaacggaaccgttaacggg

SEQ ID NO: 428447 - DNA, 631 bp, Homo sapiens
  misc_feature: GZ8MTXP01BJJP4.19.53.E09.1.454.CMB.2.raw
  modified_base (265)..(265): a, c, t, g, unknown or other
tcagtactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaaggccgattcaccatctccagagacaacgcaagaactcccngtatctgacaaatgaacagtctgagagctagaggacacggtcctttagtattactgtgacaaaggagtataggcagtctacgtacgggtacgaactacggtcggggaccgaacggggaaccccttgggtcacccggttctaccctcgacgccctaccaccgaaacgggcccctagtcccggttcccttcccccgtggcccgtccccgtggcccgtaccgagggacgccacccgtccggagaacgccgtaacgaccggccgggtccccgtggggtccttcggtccccgttgggttacccgaaacggttacccttacccgttccccgaacggtagtaacgtaccgtggacgccggggttcgaacgggg

SEQ ID NO: 428448 - DNA, 650 bp, Homo sapiens
  misc_feature: GZ8MTXP01EUHGN.19.53.E09.1.454.CMB.2.raw
  modified_base (200)..(200): a, c, t, g, unknown or other
  modified_base (263)..(263): a, c, t, g, unknown or other
  modified_base (265)..(265): a, c, t, g, unknown or other
  modified_base (267)..(267): a, c, t, g, unknown or other
  modified_base (282)..(282): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagcgtgtagtttccttaggctatttaaagtgtcagtgtgaagtgcagngtggtggagtgtggggaggcgttggtacagccgtggcgaggtcccgtgagactctcctgtgcncncnctgtactctcttgtntgtatatcgctatgcgtacgtcggtcggacgacgacgtacggagggacggcggtaggtggtcggtcgtagtagttagttagttaagtagtgtagtagtagtagtacgtacgtagtcgtacgtacgtcgtaggtacggtacgggtaccgtacgttaccgtacctacgtacctaccgaacgaacgaaccgaaaccggaaccgtaaacgtaaccgtaccgttacgttacgtacgtacgtaacgtaaacgtaacgaacgtaacgtacgtaacggtaagttaggacgttacggtaacggtaaccgttaccggttacgtttacgttaacgttacgttaacggtacggtacggttaagggtaaggttaagtaacg

SEQ ID NO: 428449 - DNA, 602 bp, Homo sapiens
  misc_feature: GZ8MTXP01EI95A.19.53.E09.1.454.CMB.2.raw
  modified_base (296)..(296): a, c, t, g, unknown or other
  modified_base (389)..(389): a, c, t, g, unknown or other
  modified_base (575)..(575): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttccttttggcttaattttaaaaggtgtccagtgtgaagtgcagctggtggaggtcgtgggggagcttggtacagcctggcaggtccctgagactctcctgtgcagcctgtgactttcactttgatgtattangccatcgcctacgtcgggggtccgacaacggctaccggagggggaacggcgtgggagttcgggtctagtaggttattaggtaaggaattggtntacgtagtagtacgctagtcgacggtactgtgggtagaacggggcctaattccactactccacccgaagaacgacccaaacggggtaccaaacgtaacccttccctagtactcctagaaccaaagtcgaaactgtcgaagaagcgtacgttaggaaaggtacccacgggttccttagttaacttgnggtacgagttaagggtaagttaagaag

SEQ ID NO: 428450 - DNA, 631 bp, Homo sapiens
  misc_feature: GZ8MTXP01D69DE.19.53.E09.1.454.CMB.2.raw
  modified_base (280)..(280): a, c, t, g, unknown or other
  modified_base (305)..(305): a, c, t, g, unknown or other
  modified_base (575)..(575): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctgggtggagtcgtgggggagtcttggtacagcctggcacgggtccctgagtacctctccgtgtgcagtccctntggacttccactttgattgatttancgcctatcgacctacggttcgggggtaccccggacaaacggtcctaccgggaagggggaacgggtcccgtagggggacggtttcgggggtccttacggaagggtttatttagggttaaggaaattggtgtacttaaagtatacgccttagtcggcgtacttcgtggtaggaacgggtcctaattccaacctatccaccgaagaacgaaccaacggacccaaagtaacccttccgtagtactctgaaactaaatcgaaactgtcgaagagncgttagaacgtcttacgggttcttaggtaattacgtgtagacggaagtggttaatg

SEQ ID NO: 428451 - DNA, 532 bp, Homo sapiens
  misc_feature: GZ8MTXP01CFA2B.19.53.E09.1.454.CMB.2.raw
  modified_base (304)..(304): a, c, t, g, unknown or other
  modified_base (356)..(356): a, c, t, g, unknown or other
  modified_base (369)..(369): a, c, t, g, unknown or other
  modified_base (398)..(398): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttaattttaaaaggtgtccagtgtgaagtgcagctggtggagtcgtgggggagcgttggtacagcctggcaggtccctgagactctcctgtgcagcctctggacttcacctttgattgattatgccatgcacgtgggtccgnaagctacgagggacggcctggagtggtctcgaggttattaggtggaatagtnctagtatagctanggcgactcgtgtgaaggccattcacatcncagacaacacgaccaaggaacttcctagtactctagacaaatcgaactagtctagagaacgcgttggaacgggaccgtacgggtcctttaggttacttacgtggtagcgtaaagggtagttataacgcgtaagg

SEQ ID NO: 428452 - DNA, 815 bp, Homo sapiens
  misc_feature: GZ8MTXP01DB1ZQ.19.53.E09.1.454.CMB.2.raw
  modified_base (260)..(260): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttcctttggctaattttaaaaggtgtccagtgtgaagtgcagctggtggagtcgtgggggagcttggtacagcctggcaggtccctgagactctcctgtgcagcctntggattcacctttgatgattatgccatgcacgttcggggtccgacaaggccgtaccggaagggggaacgggtccgttagggggaacggttgggggttacctacggtaaggggtttagtttaagggtttacgggaaagtttaaggttggtaaccgttaaagggtttaacgttaaacgggtccccgtttaaggttccggggacccgggttaaccttccgggttttaggggtaacggggaaaccggggggtaccccgttaaacgttttaccccgaaacccgttaaacgttttccctaacccccgtaaagggaaaccgaaaccccgaaaaaccccggggttaccccctaaaaaacgggggtaaaccccctttacccccgttaaggttaacccttacgttaacggaaaccctaaaagttaacgaaaccgtaggttaccgtaaggaacggaagtacgttaggaaacgggaaccgttaaccggtacccgtttttaggttaactttaccggtttgggtacgaacgggtaaagggtaagggttacttaaggcccgttaaacggg

SEQ ID NO: 428453 - DNA, 574 bp, Homo sapiens
  misc_feature: GZ8MTXP01AV4YG.19.53.E09.1.454.CMB.2.raw
  modified_base (316)..(316): a, c, t, g, unknown or other
  modified_base (560)..(560): a, c, t, g, unknown or other
tcagtactctcgtgcacgaccggtgctcgatttagagagagtgtgttgggtctggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaaggccgattcaccatctccagagacaacgccaagaactccctgtatctgacaaatgaacagtctgagagctgaggacacggcttgtattacngtgcaaggacggtatagcagctaactgggtaacactacgtgggggcccaggggtaaccctgggtccaccgtctccctcgacgccctccgaaccgaacgggccccaacgtccggtcccttcccccgtcggccgccccgtcgccgtccacgggacgccaacccgtccgacgacggccacgacgccggccctcgggctcgccgtcgggtaccaacgggaccttaccttccccgaacgcgacggtacnggaacggcggggcg

SEQ ID NO: 428454 - DNA, 598 bp, Homo sapiens
  misc_feature: GZ8MTXP01D85EJ.19.53.E09.1.454.CMB.2.raw
  modified_base (429)..(429): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttatttaaaaggtgtccagtgtgaagtgcagcgtggtggagtcgtgggggagcttggtacagcctggcaggtccctgagactctcctgtgcagcctctggattcactttgatgattatgccatgcacgtcggggtccgacaaggctacccgaggggaacgggccgtagggaggtggggtcctacgaggttagttaggtaggaataagtgtcgtagtaatacgcctagtcggcgggtactcgtggtaggaacgggcctagttccaacntcctaccagacaacaaccgaccaaacggtactcccgtagtaactctaagactaaatacgaaactagtctaggaagaacgcgttagggaacggttaccgtacgggttcctttaggttaactttacgtggtacggtaacgaaagggggtagttagtaacgggaactaacgg

SEQ ID NO: 428455 - DNA, 620 bp, Homo sapiens
  misc_feature: GZ8MTXP01DV3UU.19.53.E09.1.454.CMB.2.raw
  modified_base (379)..(379): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagcttggtacagcctggcaggtccctgagactctcctgtgcagcctctggattcactttgatgattatgccatgcacgtcggggtccgacaagctacccgaagggggaacgggccgtagggagtggggtcctacggtaggttatttaggttaggaattaagggtncgttaagtatacgtcctatcggacgggtactcgtaggtaggaaacggggccctaattcccaaacctcttaccacccgaaggaaccaaccgaaaaccggtacccaaagggtaaccccttcccgtagttaactctagaaccaaagttacgaactagtctgaaggaagtcttaggggacgttacgtacgggtcctttaggttattacgtggtacgaagtaagggtaggttactaagcgtaacgg

SEQ ID NO: 428456 - DNA, 711 bp, Homo sapiens
  misc_feature: GZ8MTXP01CA9UU.19.53.E09.1.454.CMB.2.raw
  modified_base (271)..(271): a, c, t, g, unknown or other
tcagtactctcgtgcacgaccggtgctcgatttagagagagtgtgttgggtttggggagctctgggagaggagccccagccccgagattcccaggtgtttccattcagtgatcagcactgaacacagaggactcaccatggagttgagactgagctggtattttcctttggcttaattttaaaggtgtccagtgtgaagtgcagctggtggagtcgtgggggagtcgttggtacagccgtggcaggtccctgagactctctgtgcagcctntggattcactttgatgattatcgcctagtcgaccacggtcggggtacccggacgaaacggtcccgtacccggaaggggggtaacggggccccgtagggggtacggttcgggggttaccccttacgggtaaaggggtttagttttaagggttagggaaaaagtttagggttggacgtttaaagtacgtacgtcccttaagtcgggacggtacttcgtaggtaggaacgggtccgtacttaccgacctacgtccgtaccgaagaacgaaccgaaccgacctaaacgtaacccttcccgtagttaactcgtacgaactaaacgtcgaaaccgtgttaccggtagaacgggaacgcggtaacggaacggtaaccgtacgggttaccctttaggttaacttaacgtagtaacggtaagaagggttaggtaacgttaacggaaccg

SEQ ID NO: 428457 - DNA, 629 bp, Homo sapiens
  misc_feature: GZ8MTXP01C3MXG.19.53.E09.1.454.CMB.2.raw
  modified_base (252)..(252): a, c, t, g, unknown or other
  modified_base (274)..(274): a, c, t, g, unknown or other
  modified_base (296)..(296): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctgggtggagtcgtgggggagtcttggtacagcctggcaggtcccngacgactctcctgtgcagcctntggtattcactttgatgattangccatgcacgtggggtccgcaagcctccggaggggaacgggccgtgggaggttcggggtctacgtaggttagttaggttaaggaaattggtgtacgttaaggtatacgacctaagtcggacggtactcgtggtacgggaaacggggtcccgtaatttacccaacctacgttcccaccgaacggaaacgaacccgaaacggggaccccaaaacggtaaccctccccgttagtaactccgtagtaaaccaaagtacgaaacagtcgtaagaagagcgttaggaacgcgttacgggttccttaggtaattacgtgtcgagaaggtaagaagtaacg

SEQ ID NO: 428458 - DNA, 621 bp, Homo sapiens
  misc_feature: GZ8MTXP01EQLJK.19.53.E09.1.454.CMB.2.raw
  modified_base (271)..(271): a, c, t, g, unknown or other
  modified_base (551)..(551): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagcttggtacagcctggcaggtccctgagactctcctgtgcagcctntgacttcactttgatgattatgcctatcgctacgtcgggtccgacaacgccgtaccggagggggaacggccgtaggggtacggttcgggtacctaggtaaggttagtttaggttaagggaaattggtgtacgttaaggtatacgtccgttaagtcgggacggtacttcggtagggtacgggaacggggcccttaattcccaactacttccaccgaagaacgaaccaaccgggacctaaacgtaccctcccgtagtactccgagaaacctaaatcgaaacngttcgaagaagcgtcgttaggacgacgacggttcttaggtaactagtggagaggaggtaagttaacaagg

SEQ ID NO: 428459 - DNA, 732 bp, Homo sapiens
  misc_feature: GZ8MTXP01C60EN.19.53.E09.1.454.CMB.2.raw
  modified_base (292)..(292): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaggtgtccagtgtgaagtgcagctggtggagtcgtgggggagcttggacagcctggcacggtccctgacgactctcctgtgcagcctctggattcactttgatgattancgcctatcgcctacggttcgggggtcccggacaaacggtccgtacccgggaaggggggaaccgggtccgtagggggtacggttccgggggttacctacggtaggggtttaatttagggtttaagggaaagttaaggttcgtaacgttaaggtaactacgggtaccttaagtcgggtaccgggtacgttcgtagggtacgggaaacggggtcccgtaacgtttacccaaccgtacgtaccctaccgaacggaacgaaacccgaaaccggggacccctaaaacggtaaacccttccccgttaggttaacctcgttacggaacctaaaagtacgtaaaccgaggttcgtaaggaaggagtcggttacggaacgggtaaccgttaccgggttcctttagtaactttacggtgttcggaggttaaagggtaaggttaagtaacgg

SEQ ID NO: 428460 - DNA, 581 bp, Homo sapiens
  misc_feature: GZ8MTXP01C7LQV.19.53.E09.1.454.CMB.2.raw
  modified_base (268)..(268): a, c, t, g, unknown or other
  modified_base (281)..(281): a, c, t, g, unknown or other
  modified_base (290)..(290): a, c, t, g, unknown or other
  modified_base (368)..(368): a, c, t, g, unknown or other
  modified_base (476)..(476): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagcttggtatttttccttttggcttaattttaaaaggtgtccagtgtgaagtgcagcgtggtggaggtcgtgggggagtcttggtacagcctggcaggtccctgacgactctcctgtgcacgcctntgattcacctttnatgtattangccatgcacgtcgggtccgacaagccgtaccggaggggacgggctgggagtggtctacgaggttattgtagaatagtncgtagtatacgctagtcgcgtactcgtggaggtacgggcctaattcccaactcgtcctaccgaagacgaccaaacgaccaaagggtaaccctccgtagtactcgtaanacaaagtcgaaactgttcaggagaagtcgttagggaacgccgtaacggttctttaagttactttaacgtggtagaacgtaagggtagttacgtcggaagtaacgg

SEQ ID NO: 428461 - DNA, 657 bp, Homo sapiens
  misc_feature: GZ8MTXP01BESNC.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttcctttggcttaattttaaaaggtgtcagtgtgaagtgcagcgtggtggagtcgtggggggagtcgttggtacagccgtggcaggtccctgacgctctcctgtgcagcctctggattcactttgatgtattatgccatcgactacggtcgggggtcccgacaacggccgtaccggaaggggggaacgggtccgtaggggacggttcggggtcctacggtagggtttaagtttaggtaggtaaattcggtgtcgttaagtaagtacgccttagtcgggacggtactcgtaggtaggaacggggtcctaacgttcaaccctatacctaccgaagaacgaaccaaacgtacccgaaacggtaacccttcccgtagtactcgagaaactaaagtacgaactaggttacaggacggaagtcggttaggaacggttcccgtacgggttctttaggttactttacgtgggtacgaacggtaaaggggtaggttaagaacgaacgtaacgg

SEQ ID NO: 428462 - DNA, 537 bp, Homo sapiens
  misc_feature: GZ8MTXP01DSZZT.19.53.E09.1.454.CMB.2.raw
  modified_base (265)..(265): a, c, t, g, unknown or other
  modified_base (351)..(351): a, c, t, g, unknown or other
  modified_base (439)..(439): a, c, t, g, unknown or other
  modified_base (523)..(523): a, c, t, g, unknown or other
  modified_base (528)..(528): a, c, t, g, unknown or other
  modified_base (534)..(534): a, c, t, g, unknown or other
  modified_base (536)..(536): a, c, t, g, unknown or other
tcagtactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaaggccattcaccatctccagagacaacgccaagaactcccngtatctgacaaatgaaacagtctgagagctgaggacacggtcctttgtattactgtgacaaggagtatagcagctactgggtaacncgtacgtgggggacccaggggaacccctgggtccacccgtctccctcacgcctccaccgaacgggcccagtccgtcctccccgtgccnccctgcctccgaggcgccacccgtccgagacgcacgagccgcccgtggcttcgaccgttgtacaacggcttacttcccaagagntacgngcgcgngng

SEQ ID NO: 428463 - DNA, 625 bp, Homo sapiens
  misc_feature: GZ8MTXP01E4QWE.19.53.E09.1.454.CMB.2.raw
  modified_base (286)..(286): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggctattttaaaggtgtcagtgtgaagtgcagctggtggagtcgtgggggagcttggtacagcctggcaggtccctgagactctcctgtgcagcctctgattcactttgatgattangccatgcacgtgggtccgacaagcctaccggaagggggaacggccgttgggacggttcgggggtctacggtaggttaattaggtagggaaattggtgtacttaggtatacgccttaagtcggacggtactcgtgggtaggaaacgggtccgtaacttccaacctattacccgtaccaaaggacgaaccaaaccggggtacccaaaggaaccttcccctagtactccgtagaaccaaagtacgaaacagtctaagaagacgccgagggaaacggacgaacccggttctttaggttaaccttagtggttacgacggaaagggtaacgtttaagtaaccggg

SEQ ID NO: 428464 - DNA, 638 bp, Homo sapiens
  misc_feature: GZ8MTXP01B946U.19.53.E09.1.454.CMB.2.raw
  modified_base (300)..(300): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctgggtggagtcgtgggggagcttggtacagcctggcaggtccctgagactctcctgtgcagtccctgtggtacttcctactttgatgtattancgcctatcgctacggttcgggggtccgacgaacggccgtaccggaagggggacggtccggtgggtacggtccgggtactacggtaggtttagttaggttaagggtaattgtgtacgtagtatacgtctagcggtcgtactcgtggtacggaacgggtcctacttaccacctactcccaccgaagaccgaaaccgaaccggaccgtaaacgtaaccccttccgtattacgtctagaaccaaatcgaaactgtcgtaagaggttacgcgttaggaacggtccgttaaccgttcctttagtaacgttacgtggtacgaggttaaggtaagttaagtaacgg

SEQ ID NO: 428465 - DNA, 644 bp, Homo sapiens
  misc_feature: GZ8MTXP01AZ7VC.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggaggtcgttggtacagccgtggcaggtccctgacgtactctctgtcgcacgcctcgtggtacttcctacctttgatgtattatcgcctagtcgaccgtacggtcgggggtcccggacgaacggcccgtacgggaagggggaacgggtccggtaggggtacgggttccggggtcttacggtaagggttaagtttaggttaagggaattggtgtacgttaagtatacgtcctagtcgcggtactcgtgggtacggaacgggcctactccactactctaccaggaacgaccaacggaccctaaagaccctacctagtactcgtagaacaaagtacgaatcgtgtaacgaaggcgcgttaggaccggaacttcgggttacctttggtaattccggtgtacggaggttaagggtggttaacgtaacg

SEQ ID NO: 428466 - DNA, 686 bp, Homo sapiens
  misc_feature: GZ8MTXP01D4T7H.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttaattttaaaaggtgtccagtgtgaagtgcagctggtggagtcgtgggggagcttggtacagcctggcaggtccctgagactctcctgtgcagcctctggacttcactttgatgtattatgccatgcctacgtcggggtcccgacaacgccgtacccgaagggggaacgggccgtgggaggtggggtctccgagggtttaattaggttaggaaacttaagggtgtcgtaagttaagtacgtacccttaagtcgggtaccggtaacgttcgttagggttacgggtaaacgggggcccgttaatttacccgaaccctaacgttccctacccgaaaggaaaccgaaccgtaaaacccgaccccgaaaacggggtaaaccccgtttacccctaaggttaactaccgttaacggaacctaaaaagttacggaaacctagtaccgtaggaacgtaagcgttaggacggaacgtaccggttcttaggttacttacgtggtagaacgtaaggtaggttactaagcgtaagg

SEQ ID NO: 428467 - DNA, 701 bp, Homo sapiens
  misc_feature: GZ8MTXP01BWA15.19.53.E09.1.454.CMB.2.raw
  modified_base (255)..(255): a, c, t, g, unknown or other
  modified_base (264)..(264): a, c, t, g, unknown or other
  modified_base (288)..(288): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttattttaaaaggtgtccagtgtgaagtgcagctggtggagtcgtgggggagcttggtacagccgtggcaggtccctgacgactctcctgngcacgcctntggacttcacctttgatgtattancgccatcgcacgtcgggtccgacaagcgtaccggaggggaacggccgtggaggtgggtctcgtagggttattaggtaggtaataaggtgcgttaagtagtacgtccgtagtcgggtacggtaacttcggttaggttacgggaacgggggtcccgtaactttacccaacccgtacgttcccctaccgaacggaaaccgaaacccgaaacccgaaccccgtaaacgggtaaaccccgtttaccccgttacggttaaccttccgttaacggaacctaaaacgttaacggaaacgtacggttaccgtacggaaggaacggtacggttacgggaacgggttacccgtaaaccggggttccctttaggttaaccttacggttaagcggtaacgaagggtaggttactaacggcgtaacg

SEQ ID NO: 428468 - DNA, 547 bp, Homo sapiens
  misc_feature: GZ8MTXP01DJQXA.19.53.E09.1.454.CMB.2.raw
  modified_base (269)..(269): a, c, t, g, unknown or other
  modified_base (311)..(311): a, c, t, g, unknown or other
  modified_base (368)..(368): a, c, t, g, unknown or other
  modified_base (387)..(387): a, c, t, g, unknown or other
  modified_base (402)..(402): a, c, t, g, unknown or other
  modified_base (461)..(461): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagagtactcaccatggagttgagactgagctggattttccttttggctaattttaaaaggtgtccagtgtgaagtgcagctggtggagtcgtgggggagcttggtacagcctggcaggtccctgagactctcctgtgcagcctntggattcacctttgatgattatgccatgcacgtgggtccganaagctccgagggacggcctggagtcggtctgaggtattaggtagaatgtgctaagtntagctatcgcgactctggngaggctatcacatcncagacgacaacgggcaaacgtaacctcctagtaactcgtacgaacctaaaagtgaaacngttcgaaggaagagcgttagacgggaacaccggggttcctttaggttaacccttaagttggtgacggaaggtaagggttaataagg

SEQ ID NO: 428469 - DNA, 603 bp, Homo sapiens
  misc_feature: GZ8MTXP01AN43B.19.53.E09.1.454.CMB.2.raw
  modified_base (486)..(486): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagcctggcaggtccctgagactctcctgtgcagcctctggattcactttgatgattatgccatgcacgtgggtccgacaagcctccgaagggggacggcctgggagtgggtctcgtaggttattaggtaggaacttaggtgcttaggtatacggccttatcggacggtactcgtggtacggtaacggggccctaattcccgaacctattccgtaccgaagacgaacctaacgcccaaaggtaacccttcccgtagtacttccngacctaaaagtcgaaactgtaccaggagaacgcttggaacgggacctaacgggtccctttaggttactttaccgggtggtacgaacggaaagggtaggttacgtaacggcgtaacgg

SEQ ID NO: 428470 - DNA, 540 bp, Homo sapiens
  misc_feature: GZ8MTXP01DI3QF.19.53.E09.1.454.CMB.2.raw
  modified_base (302)..(302): a, c, t, g, unknown or other
  modified_base (519)..(519): a, c, t, g, unknown or other
  modified_base (534)..(534): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttggtacagcctggcaggtccctgagactctcctgtgcagcctctggacttcactttgatgtattatgcctatgcacgtgggtccganagctccgagggacggctggagtggtcctagaggttattaggtggaattaagtgctagtatagtccctaagtcggacggactcgtggtaggaacggggctattccaactatctaccgagacgacaaacgccaaaggaccctctagtactctagaccaatacgaactagtctagagaagcgttggacggacgtacgggtctttaggttattacgtgagngaagggtgttatcgntaacgg

SEQ ID NO: 428471 - DNA, 622 bp, Homo sapiens
  misc_feature: GZ8MTXP01ANIN1.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggctattttaaaaggtgtccagtgtgaagtgcagctggtggagtcgtgggggagcttggtacagcctggcagggtccctgagactctcctgtgcagcctctggattcacctttgatgattatgccatgccacgtcggggtccgcaacgctaccggaggggacgggcctgggagtcgggtctgaggttattaggtaaggaatgtgactagtatagcctagtgcggtactcgtagtggaacgggccgtattcggacctagtccaccgaagacgaaccgaaccgggaccctaaaacggtaaccctcccgttaggtaactccgttaggaactaaaacgtcggaaacctaggttccgtaaggaaagacggaccggttaggaaacgggaaccgttaccgggttccgtttaggttaacttacgtggtaggaaccgttaaaggggtaacggttaagtaagg

SEQ ID NO: 428472 - DNA, 600 bp, Homo sapiens
  misc_feature: GZ8MTXP01ATDAG.19.53.E09.1.454.CMB.2.raw
  modified_base (292)..(292): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagcttggtacagcctggcaggtccctgagactctcctgtgcagcctcgtggattcacctttgatgattangcctatgcacgtggggtccgacaagccgtccggagggggaacgggccgtgggaggtcggggtctagtaggttagttaggttaggaatgtgtacgttagtatagcctagtcggacgtactcgtggtaggaacggggtcctattccactactccacaaggaacaacccaaccgggaccaaacggtaacccttcccgtagtactctaggaaccaaatcgaaacctggtcctaaggaagcgtacgttaggacggtaaccgttacggttcctttagttaattacgttggacgagaaagggtgttaagtaacgg

SEQ ID NO: 428473 - DNA, 572 bp, Homo sapiens
  misc_feature: GZ8MTXP01BT825.19.53.E09.1.454.CMB.2.raw
  modified_base (291)..(291): a, c, t, g, unknown or other
  modified_base (505)..(505): a, c, t, g, unknown or other
  modified_base (511)..(511): a, c, t, g, unknown or other
  modified_base (547)..(547): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagcttggtacagcctggcaggtccctgagactctcctgtgcagcctctggacttcacctttgatgattntgccatgcacgtgggtccgcaagctaccggagggacggccgtggaggtcggtctcgtaggttattaggtaaggaattggtgtacgtagtatacgccttagtcggcggtactcgtaggtggaaacggggtcctaactttccacctattccgaccgaagacgaaccaacgggaccaaagtaaccctccgtagtactctagacaaatcgaaatcgtnaagagngcgttgaacggcttacggttcttaggtaactttcgngttagacgaagggtaagttgtaacg

SEQ ID NO: 428474 - DNA, 777 bp, Homo sapiens
  misc_feature: GZ8MTXP01CBKWC.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttcctttggcttaattttaaaaggtgtccagtgtgaagtgcagcgtggtggaggtcgtgggggagtcttggtacagccgtggcctacgggtcccctggacgtacttcctcctggtcgccacgtcccttcgtaggtactttccgtaccttttggacttggtaaacttttacgtcgaccctaagttcggacccgtacggttcgggggtaccccggactaaacgggtcccgtacccgggaaggggggtaaccggggtcccgttagggggtacgggttcggggtacttaccggtaaggggtttaatttagggttagggtaaagttagttcggtaacgttaaaggttacgtacggtccttaaggttcgggacggttacttcggttagggtacgggtaaacgggggtcctaactttcccgaaccctacgttccgtaccgaaggaacgaaacccgaaaccggaacccctaaacggggtaaaccccttcccgttaagtaccttacgtacgaacctaaaagtacgtaaacgtaggttcgtaggaaggcgtacgttagggaacgttaccgtacgggttctttaaggttccttaagtgggtagaacggtaagggtagttaataacggcgtaacgg

SEQ ID NO: 428475 - DNA, 727 bp, Homo sapiens
  misc_feature: GZ8MTXP01EFTQH.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggtcttaattttaaaaggtgtccagtgtgaagtgcagcgtgggtggaggtcggtgggggagtcgttggtacagccgtgggcacgggtccctaggacgtacctctcctggtcgcacgcctcgtggtacttcctacctttgattgtatttagcgcctagtcgcgtacggtcggggtccggactaacggccgtaccgggaagggggtaacgggccgtagggggtacggttcggggtctacggtaagggtttattagggttaaggtaatggttgtacttaaggttactacgtacgtagttcgggacgtacttcgtagggtacggaaccggggccttaacttaccgaacctacttaccgacccgaaggaaccgaaacccaaaccggggaacccctaaacggttaaaccccttccccggttaaagttacctaccgttaagaaaccgtaaagtacggaaacctggttaccgaagggaacgttacggacggttagggaaccggtaccgttacgggttccttaagttaagttacgcggtagtaacggaagggtaagttcgtaacgg

SEQ ID NO: 428476 - DNA, 537 bp, Homo sapiens
  misc_feature: GZ8MTXP01ARKMW.19.53.E09.1.454.CMB.2.raw
  modified_base (279)..(279): a, c, t, g, unknown or other
  modified_base (475)..(475): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtgggggaggcttgggtacagcctggcaggtccctgagactctcctgtgcagcctctggattcactttgatgatangccatgcacgtgggtccggacaagctaccgagggaacgggcctggagtgggtctcgaggtattaggtggaatagtgctagtatagcctatgcgactcgtgtagaacgggccgtattcgaccctatcctacaagacgaacaaccggaccaagggaacctccctagtaactcctgacaaagtcgaaactgtactgagngcttggaacgacgtacgggtccttagttacttctggtgaacgaagggtgttatcgcgtaacg

SEQ ID NO: 428477 - DNA, 681 bp, Homo sapiens
  misc_feature: GZ8MTXP01ASYZO.19.53.E09.1.454.CMB.2.raw
  modified_base (262)..(262): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctaattttaaaaggtgtccagtgtgaagtgcagctggtggagtcgtgggggagtcttggtacagcctggcacggtccctgacgactctcctgtgcagcctntggacttcactttgatgtattatcgccagtcgacctacgtcgggggtcccgacgaacggccgtacccgggaagggggaacgggtccgtagggggtaggttcggggtcctaccggtaagggttattagggttaggaaattaacggtgtcttaagtaactacggtcctagtcggacgggtactcgtggtaggaacggggtccctattcccgaacctacgtcctacccgaagaccgaaccgtaaccgaccaaacgggtaacccttcccgttagtaccttaccgacgtaactaaacgttacgaaacctggttaccgtaggaagaacggtaccgttagggaaaccgggacccgtacgggtccctttaggttaacttaccgtggtacggtaacggaagggttacgggttataacggcgtaaccgg

SEQ ID NO: 428478 - DNA, 598 bp, Homo sapiens
  misc_feature: GZ8MTXP01A3Z8V.19.53.E09.1.454.CMB.2.raw
  modified_base (305)..(305): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagcttggtacagcctggcaggtccctgagactctcctgtgcagcctctggattcactttgatgattatgccatcgcacgtcggggtccganaagctccgaggggacggctggagtggtctcgaggttattagtaggaatagtgctagtatacgcctagtcgcgtactcgtggtaggaacggggcctaacttcacctaagttccaccgaagaacgaaccaacgacccaaagggtaacccttcccgttagtactactacgaactaaagtacgaaaccgtagtacgtaggaaggtaagcgttagggaacgggacccgtaacggggttccctttaggttacctttacgtggtacggaacgtaaaggggagttacgtaaggccgtaagg

SEQ ID NO: 428479 - DNA, 707 bp, Homo sapiens
  misc_feature: GZ8MTXP01C0XW9.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagcttggtatttttccttttggcttaattttaaaaggtgtccagtgtgaagtgcagctggtggagtcgtgggggagtcttggacagccgtggcaggtccctgacgactctcctgtgcacgcctcgtggacttctacttttgattgtaattagtcgaccctagttcggaccgtaccggttcgggggtaccccggacgaaacggtcccgttacccgggaaagggggaaccgggtccgttaggggtacggttcggggttctaccggtaagggtttaagtttagggttagggtaaagttaagggttgtaacgtttaaaggtaacgttacgggtacccgttaagtcgggtaccgggtacgttcgttaggtacgggaacgggtccgtaacgttacccgaacctacttaccgtaccgaacggaaccgaaccgaaacccgaaccctaaacggtaaccctcccgttagtactacgtacgaactaaagtacgaaactacggttcaggaagaagtcgagggtacgaccgtacgtctttagttattacgtgagaagaagggtagttatcgcgtaacg

SEQ ID NO: 428480 - DNA, 583 bp, Homo sapiens
  misc_feature: GZ8MTXP01C118J.19.53.E09.1.454.CMB.2.raw
  modified_base (292)..(292): a, c, t, g, unknown or other
  modified_base (309)..(309): a, c, t, g, unknown or other
  modified_base (478)..(478): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctatttaaaaggtgtccagtgtgaagtgcagctggtggagtcgtgggggagctggtacagcctggcaggtccctgagactctctgtgcagcctctggacttctacctttgactgtattangcatgcacgtggtccgnaagctcgagggacggctggagtcggtctacgtaggtattagtaggtaatgtgacgtaagtagtacgtacctagtcggccgtactcgtggtacggaacgggtccgaatttccactacgtctacccagaacgaaccgaacggacccaaacgtaacccttcccgtagttacnctagaaccaaattagaacctagtgtaaggaagagtccgttaggaacggtacgttaccgggttccttagggtaattacgtgtagacgaagggtaagttaacgtaag

SEQ ID NO: 428481 - DNA, 578 bp, Homo sapiens
  misc_feature: GZ8MTXP01A7VBG.19.53.E09.1.454.CMB.2.raw
  modified_base (258)..(258): a, c, t, g, unknown or other
  modified_base (260)..(260): a, c, t, g, unknown or other
  modified_base (286)..(286): a, c, t, g, unknown or other
  modified_base (308)..(308): a, c, t, g, unknown or other
  modified_base (512)..(512): a, c, t, g, unknown or other
  modified_base (523)..(523): a, c, t, g, unknown or other
  modified_base (558)..(558): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggctattttaaaggtgtccagtgtgaagtgcagctggtggagtcgtgggggagcttggacagcctggcaggtccctgagctctcctgtncngcctctggattcactttgatgattangccgatgctacgtgggtccggnaagctccgagggggaacggcctgggagtcggggtctagtaggttattaggttagggaattggtgtacttaagtatacggcctagttcgcggtactcgtaggtggaaacgggtccgaatttccactacttccacccaaggacgaaccaacggggacctaaacggtaaccctccccgtagtaactcctagacctaaagtcgaaacnggtctaagagngcttaggacggacttacggcctttagtaattacgngtgagttaaggtgttaagtg

SEQ ID NO: 428482 - DNA, 866 bp, Homo sapiens
  misc_feature: GZ8MTXP01B0J0J.19.53.E09.1.454.CMB.2.raw
  modified_base (268)..(268): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagtcgttggtacagcctggctaggtccctgagactctcctgtcncagcctcgtggtacttcgtaacctttgattggtaatttagtcgaccctaagtggtacctaacggttcgggggtaccccgacgtaaacggtcccgtaacccggaaggggggtaaaccgggtcccgttaggggtaacgggtttccgggggttccttaccggtaaaggggtttaaacgttttaagggtttaaagggtaaactttaaggttgggtaacccgtttaaagggttaacgttaacgggtaccccgttttaaaggccgggtacccggggttaattccggtttaggggtaacggggtaaaacccgggggtacccgttaaacgttttacccgaaaccccgttaacgtttaccccaaccccggtaaaggaaaccgtaaaccccgtaaaaccccggggaaacccctaaaaaccggtaaaccccttcccccgttaaggttaaccctacgttacggaaacctaaaagttacgaaacgtaacggttaccgtaagggtaaccgagggcccgttaagggaaccggggttaacccaccggggttccctttagggttaattaccgtggttaccgggacgttaaaagggggtaacggtttaaagtaacg

SEQ ID NO: 428483 - DNA, 806 bp, Homo sapiens
  misc_feature: GZ8MTXP01D27LS.19.53.E09.1.454.CMB.2.raw
  modified_base (266)..(266): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttaattttaaaaggtgtccagtgtgaagtgcagcgtgggtggagtcgtggggggagcttggtacagcctggcaggtccctgagactctcctgtgcagtcctntggattctactttgatgtattatcgccatcgctacggtcgggggtccgacaacggtcctacccgggaagggggaacgggccgttagggggtacggttcgggggttaccttacggtaaggggtttaagtttaggggtttaacggtaaagtttaacgggtgttaacgttaaagggttaacttacgggtaccctttaaggtcgggacccggggttaacctttccggttaggggttaacggggaaaccgggggtccccgttaacgtttaccccgaaacccgttacgtttacccctaaccccggaaaggaaacccgggaaacccaaaaccggtaaccccctaaaacggggtaaccccttaccccgttaggttaaacttcgtaacggaactaaaaccgtaaggaacctaaggttacctaagggaacgtaaggaccgttaggggaaaccgggttaaccgtaaccgggttaccctttaaggttacgtttaccggtaagggttacgaacgggttaaaggggaccggttagttaacgggcttaaaccggg

SEQ ID NO: 428484 - DNA, 600 bp, Homo sapiens
  misc_feature: GZ8MTXP01DNJ6Z.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagcttggtacagcctggcaggtccctgagactctcctgtgcagcctctggattcactttgatgattatgccatgcacgtcggggtcccggacaacgcctaccggaggggaacgggcctgggaggtcgggtctccgagggttagtttaggttaggtaattaaggtgtcgtaagtatacggtcctagtcggacggtactcgtggtaggaaacgggccgtattccgaacctatcctaccgagaacgaaccgaaacgacccaaagggtacccttccctagtacctctacgaacaaagtacgaaactgtctaggaggaacgcgttaggaacggttaccgacggtctttaggttacttacgtgtacgaacgtaagggagttactaagcgtaacg

SEQ ID NO: 428485 - DNA, 572 bp, Homo sapiens
  misc_feature: GZ8MTXP01C4KMH.19.53.E09.1.454.CMB.2.raw
  modified_base (260)..(260): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggctattttaaaaggtgtccagtgtgaagtgcagctggtggagtcgtgggggagcttggtacagcctggcaggtccctgagactctcctgtgcagcctntggattcacctttgatgattatgccatgcacgtggggtccgcaagcctcgaggggacggcgtggaggtcggtctcgaggttagttaggtgaatagtgtctagtatacgtcctatcgggacgtactcgtgtaggaacggggtccattccaactacgttccaccgagaacgaacaaccgaccaaacgggaccttccccgtagtactctagaccaaagtagaactagtcgtagagaagcgttagggacgaccgtaccgggtcctttagttagttacgttggacgaacggaaagggtagttagtaacgcgtaacgg

SEQ ID NO: 428486 - DNA, 546 bp, Homo sapiens
  misc_feature: GZ8MTXP01BJQWA.19.53.E09.1.454.CMB.2.raw
  modified_base (295)..(295): a, c, t, g, unknown or other
  modified_base (319)..(319): a, c, t, g, unknown or other
  modified_base (423)..(423): a, c, t, g, unknown or other
  modified_base (428)..(428): a, c, t, g, unknown or other
  modified_base (450)..(450): a, c, t, g, unknown or other
  modified_base (465)..(465): a, c, t, g, unknown or other
  modified_base (475)..(475): a, c, t, g, unknown or other
  modified_base (513)..(513): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagcttggtacagcctggcaggtccctgagactctcctgtgcagcctcgtggtattcacctttgatgattangcctatcgcacgtcggggtccganaacgctccgagggggacggcctgggagtcggggtctgaggtattggtaaggaatgtgactaggtatcgctagtcgcgatcgtggtggaaggccgtatcacatcncaganacacggacaagaacctccatcnctagacaatcgaacngtctaagagngcgttggaacggtacacgggttcttaggtaacttacgnggttcggagttaaaggggtaagttaagtaacgg

SEQ ID NO: 428487 - DNA, 675 bp, Homo sapiens
  misc_feature: GZ8MTXP01BXB3K.19.53.E09.1.454.CMB.2.raw
  modified_base (291)..(291): a, c, t, g, unknown or other
  modified_base (300)..(300): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtgaagtgcagcgtggtggagtcgtgggggagcgttggtacagcctggcaggtccctgacgtactctcctgtcgcacgcctctggacttctactttgatgtattangccatcgcncgtcgggtccggacaacggccgtacccggagggggaacgggtccgtgggaggtcgggtctacgtagggttagtttaggtaggtaaagttaaggtagtcgttaagtatacgtccttagtcggacggtacttcgtggtacgggaacgggtccgtaacttacccaacccgtacttcccgtaacccgaaggaaccgaaacccgaaaccgaccccgtaaacgggtaacccctttaccccgttagtacttaccgtacggaaacctaaagtaacgaaactacgggttacaggacgaacgtcgagggtaacggacgtaccgggttctttaggttactttaccgtggtacggtaacgaaggggtaggttactcggaacgtaacg

SEQ ID NO: 428488 - DNA, 684 bp, Homo sapiens
  misc_feature: GZ8MTXP01BVEOA.19.53.E09.1.454.CMB.2.raw
  modified_base (263)..(263): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttaattttaaaaggtgtccagtgtgaagtgcagcgtggtggagtcgtgggggagtcttggtacagcctggcaggtccctgacgtctctcctgtgcagcctntgacttcactttgatgtattatcgccatcgactacggtcggggtccgagaacgccgtacccggaagggggaacgggtccgttagggtacgggttcgggtccttacgtaagggttagtttagggttaggtaagttaaggtcggtcttaaggtaactacggtcctagtcggacggtacttcggtaggtacggaacgggtcctattaccaccgtattccgaccgaagaaccgaaccaacggacccaaaggtacccttcccgtagtaactcgtaacgaactaaagttcgaaaccgtgttaccgtaggaacggaacggtcttaaggggaaccggttacccgtaaccggggtttccctttagtttaaccgtttaccggtaaggttcggaaccggtaaaaggggtcggttaattaacgggctaacggg

SEQ ID NO: 428489 - DNA, 578 bp, Homo sapiens
  misc_feature: GZ8MTXP01AHRCY.19.53.E09.1.454.CMB.2.raw
  modified_base (289)..(289): a, c, t, g, unknown or other
  modified_base (529)..(529): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctattttaaaggtgtccagtgtgaagtgcagctggtggagtcgtgggggagcttggtacagcctggcaggtccctgagactctcctgtgcagcctctggattcactttgatgattangccatgcacgtgggtccggacaagcctccggaggggaagggcctgggagtcgggtctcgtaaggttattaggttaaggaatgtgtactaggtatacgcctagtcggacggtactcgtgtaggaacgggcgtacttccgaccattcaccaagacgaaccaacggggaccaaaggtaacctccctagtaactcgtagaacaaagttcgaaactagtctaaggacgaggtcaggaacggtacncggttccttaggtaattactggttacgacgttaagggtgttaagtaagg

SEQ ID NO: 428490 - DNA, 688 bp, Homo sapiens
  misc_feature: GZ8MTXP01DEO02.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttaattttaaaaggtgtccagtgtgaagtgcagcgtgggtggagtcggtggggggaggtcgttggtacacggccgtgggccacgggtcccctggacgtacctctcctgtcgcacgtcctcgtggattctacctttgaattgtattatgacctatcgctacggtcgggggtacccgacgaagtccgtaccgggaagggggaacgggtccgtaggggacggttgggtctaccggtagggtttagttaggttagggaagttaggtgtaacgtagtaagtacgtacctagtcggcggacttcgtaggtagggaacgggtccattacaacctacttccaaccgaagaccgaaccaaaccgtaaccaaacggtaacccttcccgttagtaactccgtacgtaacgtaaagtacgtaaactaggtccgtaggaggtaacgcgttaaggggaccgaccggtacgttccgtttaagttacgttaacgttgggaacgtaacggtaaaggggtagttaacgtgaacccgttaagg

SEQ ID NO: 428491 - DNA, 564 bp, Homo sapiens
  misc_feature: GZ8MTXP01AFOWB.19.53.E09.1.454.CMB.2.raw
  modified_base (296)..(296): a, c, t, g, unknown or other
  modified_base (348)..(348): a, c, t, g, unknown or other
  modified_base (466)..(466): a, c, t, g, unknown or other
  modified_base (521)..(521): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaggtgtccagtgtgaagtgcagctggtgagtcgtgggggagcttggtacagcctggcaggtccctgagactctcctgtgcagcctctggattcacctttgatgattatgccatgcactgggtccgnaagctccgaggggaggcctggagtgggtctcgaggtattaggtgataagtgntagtatgcctagtgcggactctagtgaaggggccctattcgaccatccgtacaggacgacaacgaccaaggtaactccctgtaacttccagaccaaagttcgaaactgtaccgtaggngaacggccgttaaggacgggacctaaacggggtccctttagggttaactttccgngggttacgaacgaaaggggtgggttaattaacgggcctaaggg

SEQ ID NO: 428492 - DNA, 650 bp, Homo sapiens
  misc_feature: GZ8MTXP01D53U2.19.53.E09.1.454.CMB.2.raw
tcagtactctcgtgcacgaccggtgctcgatttagagagagtgtgttgggtttgggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagcctggcgacggtcctgacgtctctcgtgtgcacgtccctgtggtacttctacctttgatagtattagtcgcctatcgctacggtcgggtcccgagacgccgtaccgggaggggacggtccgtaggtacggttccggtactacgtaggtttagtttaggttaaaggaattggtcgtacgttaaagtagtacgtacgttagtcggacgtacgttcgtggaggtacgggccttacttccaacctgtccaccgaagacgaaccaaccggaccaaacgtacccttccgtataacctcgtagaaactaagtacgaacgtgtcgtaaggaaggttaccgtcgttaagggaaaccggtaccgacccgggttcgtttagtaactttacgtgggtaacgaggttaaagggtaacggttaagtaacg

SEQ ID NO: 428493 - DNA, 601 bp, Homo sapiens
  misc_feature: GZ8MTXP01DJWEN.19.53.E09.1.454.CMB.2.raw
  modified_base (310)..(310): a, c, t, g, unknown or other
  modified_base (438)..(438): a, c, t, g, unknown or other
  modified_base (533)..(533): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagcttggtattttccttttggcttaatttttaaaaggtgtccagtgtgaagtgcagctggtggagtcgtgggggagcttggtacagcctggcaggtccctgagactctcctgtgcagcctctggattcacctttgatgtattatgccagtcgcacgtcggggtccganaacgccgtaccggaagggggacgggccgtgggaggtgggtctacgaggttagttaggtagaatagtgtcgttagtatacgcctagtcggacgggtactcgtggtaggaacgggcctattccgaacctnttcccgaccgaagaacgaaccaaaccgacccgtaaacggtaaacccttcccgttagtactctagaacctaaagtacgaaactgtcagaagaacgngttaggacggcgtacgtcgtttaggttacttacgtggtagaacgtaagggtacgttatcgcgtaacgg

SEQ ID NO: 428494 - DNA, 852 bp, Homo sapiens
  misc_feature: GZ8MTXP01CMO08.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttattttaaaggtgtccagtgtgaagtgcagctggtggagtcgtgggggagtcttggtacagcctggcaggtccctgacgactctcctgtgcagcctctggacttctactttgatgtattagtcgcctagtcgacctacggtcgggggtacccgacgtaaccggccgtacccgggaaggggggaacgggtcccgttggggacgggttcggggttaccgtacggtaaggggtttaagtttaggggtttaagggtaaagtttaagggttcgttaaccggttaaaggtttaacgttaacgggttaccccgttaggtaccggggtaccgggttaacctttaccgggtttagggtaaccggggtaaaaccgggggtcccgttaacctttacccgaaaccccgttactttaccccggaaccccgaaagggaaacccgtaaacccgaaaacccgtaaccccgaaaacggggttaaaccccctttccccgttaagggttaaccttaccgttaacggaaaccttaaaagtaaccggtaaacctaaggtttaccgaaggtaacgggaaacgtcccgttaaagggggaaccggttaacccggttaaaccccggggttccttttaaaggttaccgtttacgtaagggtacggaacgggtaaaaggggttacggttaaataaccgggttaacgtaaccggg

SEQ ID NO: 428495 - DNA, 547 bp, Homo sapiens
  misc_feature: GZ8MTXP01BFOHU.19.53.E09.1.454.CMB.2.raw
  modified_base (224)..(224): a, c, t, g, unknown or other
  modified_base (260)..(260): a, c, t, g, unknown or other
  modified_base (303)..(303): a, c, t, g, unknown or other
  modified_base (532)..(532): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttaattttaaaaggtgtccagtgtgaagtgcagctggtggagtcgtgggggagcttggtacngcctggcaggtccctgagactctcctgtgcagcctntggattctacttttgatgattatgccatgcacgtcgggtccgnaagctccgaggggacggcctggagtgggtctcgaggttattaggtgaatagtgctagtatagcctagtcgcggtactcgtagtgaaggggcctattccacctatctccgagacgaacaaccgccaacggggtaacctcccgtagactcgtagacaaattcggaaactgtactaggagaacgcgttagacggacgaccgggtcttagttattacgtgagaacgtaagggnggttataaggctaag

SEQ ID NO: 428496 - DNA, 611 bp, Homo sapiens
  misc_feature: GZ8MTXP01AJ550.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtgggggaggcttgggtacagcctggcaggtccctgagactctcctgtgcagcctctggattcacctttgatgattatgccatgcacgtcggggtaccacaacgcctaccgaagggggaacgggtcctggggaggtggggtacctccgtagggttattaggttaggaatagtgtcgttagtactagcctagtcggcggtactcgtgtaggaacgggccgtattaccgaaccctagtcctacccgagacgaaaccaccgacccaaagggtaacccttcccgtagtaacttccgagaaccaaagttcggaaacctagttaccgagaggaaggccttaagggacggaccgaaccgggttcctttaggttattaccgtggtacgaaggtaagggtggttataacgccgtaag

SEQ ID NO: 428497 - DNA, 744 bp, Homo sapiens
  misc_feature: GZ8MTXP01DOA0C.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttccttttggtcttaattttaaaggtgtccagtgtgaagtgcagctgggtggaggtcgtgggggaggtcgttggtacagccgtggcacggtccctgacgaccttcctcctgtgcacgcctcgtggacttctacctttgattgtattagtcgcctatcggcctacggttcgggggtacccggacgaacggccgtacccgggaagggggaacgggcccggttaggggtacggttcggggtcctacggtaggtttagtttagggtaagggtaaattggtagtacgttaagttatacgtccgttagtcggaccggtacttcggtagggtacgggtaacggggtacccgtaatttcccgaacctacgttacccgaaccgaacggaaacgaaccccgaaacccggggaaaccctaaacggtaaccccttaccccgttagttaacctacgttacgaaacctaaagtacggaaactacggttacgtaaggaacggagtaccgttagggaaccggggtaaccttaccgggtttcctttaggttaacgtttacgtcgggttaagacggttaaaggggtaagttaaggaacg

SEQ ID NO: 428498 - DNA, 601 bp, Homo sapiens
  misc_feature: GZ8MTXP01DG9M2.19.53.E09.1.454.CMB.2.raw
  modified_base (265)..(265): a, c, t, g, unknown or other
  modified_base (378)..(378): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttaattttaaaaggtgtccagtgtgaagtgcagcgtggtggagtcgtgggggagtcttggtacagcctggcaggtccctgacgtctctcctgtcgcacgcctntggattctaccttgattgtattatgacatcgacacgtcggggtccgacaaggtccgtaccgggaagggacgggtccgtagggtaggtggtctacgaggttatggtagatagtncgtatagtagtctagtgcgactctggtacggacggcgtacttccgaactctctaccgaagacaacaaccgacctaaacggaccctccgtatactacgacgaataaagtacaaacgtcgtacgtggaacgaagtcgacgggaaacggacccgtacgggttctttaagttgttaaaccgtggtaaggtaacgtaaaggggtacgttataacggttaaccgtaagg

SEQ ID NO: 428499 - DNA, 568 bp, Homo sapiens
  misc_feature: GZ8MTXP01ATUWL.19.53.E09.1.454.CMB.2.raw
  modified_base (241)..(241): a, c, t, g, unknown or other
  modified_base (246)..(246): a, c, t, g, unknown or other
  modified_base (259)..(259): a, c, t, g, unknown or other
  modified_base (330)..(330): a, c, t, g, unknown or other
  modified_base (460)..(460): a, c, t, g, unknown or other
tcagtactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccgagggaagggcctggagtgggtctcaggtattagttggaatagtgctagtatagcctatgcggactctgtgaaggccattcacatcncaganacaacgcaagacncctgtatctgacaaatgaacagtctgagagctgaggacacggcttcgtattactgtgacgaaggacggtanagcagctaaacgtgggaacgactacgtggggaccaggggaaccctggtccaccgtctcctcacgcctccaccgaacggccctacgtccgtcctcccccgtcggcccgcccgtcgccgtccgacgggaccnccgaccgtacggacgacgccgacgcggccggcccgtcggccgtcggccgtcggtaccgaacggttaccttaccgtaacccgagaacgtacgtacgaggtcgggcggcg

SEQ ID NO: 428500 - DNA, 622 bp, Homo sapiens
  misc_feature: GZ8MTXP01BK6Z8.19.53.E09.1.454.CMB.2.raw
  modified_base (535)..(535): a, c, t, g, unknown or other
  modified_base (583)..(583): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactaaccatggagttgagactgagctggtattttcctttggctattttaaaaggtgtccagtgtgaagtgcagctggtggagtcgtgggggaggcttggtacagcctggcaggtccctgagactctcctgtgcagcctctggatcactttgatgattatgccatgcacgtggggtcccgacaaagcctaccggagggggaacggtccgtagggaggttgggtctacgtaaggttagttaggttagggaaattggtagtacgtaaggtactacggacccttagtcgggaccggtacttcgtagggtaggaacggggtccctaattcccgaacctaactccgtaccaggacgaaaccgaaacgacccgaaacgtaacccttcccgtagtaactcgtacgaacctaaatcggaaaccngttcaggagagtcgtaggacggaccacggtaccttgttaacgtttcgnggttaagacggaagggtagtacttacgcgaagggtaacc

SEQ ID NO: 428501 - DNA, 600 bp, Homo sapiens
  misc_feature: GZ8MTXP01BYBVN.19.53.E09.1.454.CMB.2.raw
  modified_base (242)..(242): a, c, t, g, unknown or other
  modified_base (263)..(263): a, c, t, g, unknown or other
  modified_base (290)..(290): a, c, t, g, unknown or other
  modified_base (332)..(332): a, c, t, g, unknown or other
  modified_base (441)..(441): a, c, t, g, unknown or other
  modified_base (469)..(469): a, c, t, g, unknown or other
tcagtactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccgagggaaggcctggagtgggtctcgaggtattagttggaatagtgctagtatagcctatgcggactctgtgaaggccattcaccatcnccagagacaacgccaagaacnccctgtatctagacaaatgaacagtcngagagctgaggacacggccctttgtattactgtgacgaaggngtatagcagctaaacgtggtaacgactacgtggggaccacggggaaccctggtccacccgtctcctcacgccctccaaccgaacggccctacgtccgttccttccccgnggcccgtcccgtgcccgtccgacggacnccgacccgtcgaacgcgtccgacgacggcccggcccgtggggcctcggcccgttgggtacccgttaaagggaccctttaacccgttcccccgaggtaacgtcgtaacgttcggaacgggccgggtaaccgg

SEQ ID NO: 428502 - DNA, 586 bp, Homo sapiens
  misc_feature: GZ8MTXP01BM58B.19.53.E09.1.454.CMB.2.raw
  modified_base (298)..(298): a, c, t, g, unknown or other
  modified_base (506)..(506): a, c, t, g, unknown or other
  modified_base (533)..(533): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagcttggtacagcctggcaggtccctgagacctctctgtgcagcctgtggtacttctacctttgattgtattancgcctatcgctacggtcgggggtcccgacgaacggtccgtaccggaagggggacggtccgtaggggtacgtcgggttctagtagggttatttaggttaggaattggtgtacttagtatacgctagtcggcgtatcgtggtaggaacgggtcctattccactatcctacgagacgaaccaacgggtaccaaagtaccctccgtagtacncgtgaacaaatcgaactgtcaagaggngcgttggaacgcttcgggttctttggtaatcgtgtgaacgagggtgttaatcg

SEQ ID NO: 428503 - DNA, 697 bp, Homo sapiens
  misc_feature: GZ8MTXP01EG703.19.53.E09.1.454.CMB.2.raw
  modified_base (264)..(264): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggcttaattttaaaaggtgtccagtgtagaagtgcagctggtggagtcgtgggggagtcttggtacagcctggcaggtccctgagactctctgtncagcctctgacttcacctttgatgtattatcgccagtcgcacggtcgggtaccgcaacgcgtccggaaggggaacggtcgtagggacggtcgggtactacgagggttaattaggttaaggaaattggtagtacgttaacggtaataaccggtcttaagtcggtaccggtaacttcgtaggtagggtaacggggaccttaacgtttacccaaccgtacgttaccctaaccgaaacggaacgaaacccgaaaccggaacccgtaaaaacggttaaaccccgttacccctaaggttaacctccggttaaacgaaaacctaaacgtaacgtaaacgtacggtagtaaggaacgttaggtacgttaacgggaacggtaaccgttacgttcttagttaacgtacgtaaggtacgaaggttaaggtaacgttaacgtaag

SEQ ID NO: 428504 - DNA, 618 bp, Homo sapiens
  misc_feature: GZ8MTXP01DKL9D.19.53.E09.1.454.CMB.2.raw
  modified_base (265)..(265): a, c, t, g, unknown or other
  modified_base (282)..(282): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttaattttaaaaggtgtccagtgtgaagtgcagcgtggtggagtcgtgggggagtcttggtacagcctggcaggtccctgagactctcctgtgcagcctctgnttcactttgatgattangcatcgcacgtcgggtccgacaacgcgtaccggagggggaacgggccgtagggaggtgggtcctcgtagggttagtttaggtaggaattaaggtgtaacgttagtactacgtccctagtcgggacggtacttcgtaggtacggaacgggtccctattaccgaacctattccaccgaagaacgaaccaaaccgacccaaacggtaacccttcccgtagtactcgtacgaactaaagacgaactagtcgaggaagaacgcgttagggacgacgtaccgggttcttagttcgttacgtgggtaccgtaaggtaaggggtacgttagaaccgcgtaacgg

SEQ ID NO: 428505 - DNA, 759 bp, Homo sapiens
  misc_feature: GZ8MTXP01D6YIB.19.53.E09.1.454.CMB.2.raw
  modified_base (272)..(272): a, c, t, g, unknown or other
  modified_base (293)..(293): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaggtgtccagtgtgaagtgcagctggtggagtcgtgggggagcttggtacagactggcacggtccctgacgactctcctgtgcagcctntggattcactttgatgattangccagtgctacgtcgggggtaccggacaacggccgtaccgggaagggggaaccgggtccgtagggggtacggttccgggggtacttacggtaaggggtttaagtttaaggggttaagggaaatttaagggtgtaaaccgttaaggttaactacggtaccttaagtcgggaccgggtaacttcggtagggtacgggaaacggggtacccttaacgtttacccaacctacgttacccaacccgaaaggaaccgaaaccgaaacccggggtaaaccccaaaacggttaaaccccttccccgttaaggttaaccttaccgttaacggaaacctaaaagttacgaaaaccgtaggttccgtaagggaaggttacggaccgttaagggaaaccgggtaccgttaaacccggggttctttaagggttaacttacgtaaggtacggaggttaaaggggtaagttaacgtaacgg

SEQ ID NO: 428506 - DNA, 475 bp, Homo sapiens
  misc_feature: GZ8MTXP01C0HP5.19.53.E09.1.454.CMB.2.raw
  modified_base (272)..(272): a, c, t, g, unknown or other
  modified_base (455)..(464): a, c, t, g, unknown or other
  modified_base (466)..(475): a, c, t, g, unknown or other
tcagtactctcgtgcacgaccggtgctcgatttagagagagtgtgttgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaagggaggtatagcagctactggtacgactacgtgggggccaggggaaccctggtcaccgtctcctcacgccnccacgaacgggccccattccggtccttccccccgtggcccgcccctgcctcccgaggacgccaccctccgagacgccacacggccggcccgtgggccctcggcctggtccaaacggaccctacttccccgaagacggacgtacgtggaacggcggggctgggacgaaacgggcgacaagtagnnnnnnnnnngnnnnnnnnnn

SEQ ID NO: 428507 - DNA, 565 bp, Homo sapiens
  misc_feature: GZ8MTXP01E4D48.19.53.E09.1.454.CMB.2.raw
  modified_base (268)..(268): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagcttggtacagcctggcaggtccctgagactctcctgtgcagccntggattcacctttgatgattatgccatgcacgtgggtccgcaagctcgagggaggctggagtcggtctcgaggtatagtaggaatgtgactagtatagctatcgcggtactcgtgtaggaagggccgtaattccaaccatcctacccaagaacgaaccaaacggggacccaaaggaacccttcccgtagtactcgttagaccaaaagtcgaaactaggtctaaggaagagacgttggaaacggaccacgggttcccttagttaacttactggtgacgaagggtaagttaagtaacgg

SEQ ID NO: 428508 - DNA, 658 bp, Homo sapiens
  misc_feature: GZ8MTXP01COUAO.19.53.E09.1.454.CMB.2.raw
  modified_base (271)..(271): a, c, t, g, unknown or other
tcagtactctcgtgcacgaccggtgctcgatttagagagagtgtgttgggtttggggagctctggggagaggagcccccagccctgagattcccaggtgtttccattcagtgatcagcactgaacacagaggactcaccatggagttgagactgagctggtattttccttttggcttatttaaaaggtgtccagtgtgaagtgcagctggtggagtcgtgggggagcttggtacagcctggcaggtccctgagactctcctgtgcagcctntggtacttcacctttgatgtattatcgcctatgccgtacgtcgggggtcccggacaacggcctaccggagggggaacgggccgtgggaggttcggggtctcggtaggttagttaggttagggaattggtgtacgtagtatacgctagtggccgtactcggtggacggaacgggcccgtaattccaacctactcctaccgaaggaccgaaacccgaaaccgggtacccaaacgtaaccctccccgtagtactcctagactaaaacgtggaaacctggtctaaggaacgaggtaccgttgggaaacggtacccgttacggggttcccgtttagttaacccgtttacgtgggtaacggtaacggttaaaggggtaaggttaagtaacggg

SEQ ID NO: 428509 - DNA, 686 bp, Homo sapiens
  misc_feature: GZ8MTXP01AJZ4S.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagcttggtacagcctggcaggtccctgagtactctcctgtcgcacgtcctcgtggcttcctacgtttgatgattagtcgcctatcgcctacggtcgggtccgacaacggcgtacccggaggggacgggtccgtgggaggtcggtcgtaccgtaggttagttaggtaggaagtaagtgtcttagtaactacgtccgtagtcggacgtactcgttaggtacggaacggggtacctatttacccgaaccgtacttaccgtacccgaaggtaacgaaacccgtaccgaacccgaaacggggtaacccttccccgttaagtaccttacgtacgaaactaaacgtaccggaaagtccgttacgaggaggtaacgccggttaggaaacgggaccgtaaccggggtttccttagggtttaactttaccggttgggagtaaccggtaaaggggtacgggtttaaacgtaacggaaccgtaacg

SEQ ID NO: 428510 - DNA, 696 bp, Homo sapiens
  misc_feature: GZ8MTXP01CA11J.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggaggtcttggtacagcctggcacggtccctgagactctcctgtgcagcctctggattcactttgatgtattatcgccagttcgacctacggttcgggggtaccccggacgtaaacggtccgtacccgggaaggggggaacgggtccgttaggggaggttcggggttctaccggtaggggtttagtttaggttaggtaagttaagggttgtaacgttaaggttaacgtacggtccctagtcgggacgtacttcgtggtacgggaacgggtccgtaattcaacttcctaactccgtaccgaagaccgaaccaaacccggaccaaacggtacccttcccgtagttaacctcgtagaacctaaagtcgtaaacgtggttcgtaggaacgacgacggtacgggaacggtaaccgtaccgggttaccgtttggttaactttaacggtaggtcggtaacggaaaggggttagttaacgttaacggtaaccg

SEQ ID NO: 428511 - DNA, 715 bp, Homo sapiens
  misc_feature: GZ8MTXP01AT824.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttccttttggcttaattttaaaaggtgtccagtgtgaagtgcagcgtggtggagtcgtgggggaggtcgttggtacagccgtggcgtacggtccctgacgtacctctccgtgtcgcacgcctcgtggtacttctacctttgatgtattatgccatcgctacggtcgggtccggcgaacgccgtaccggaagggggaacgggtccgtggggacggtcgggtctacgtaggttagttaggttaaggtaaagttgtggtacttaagtagtacgtacctagtcggacggtacttgtagggtacggtaacgggacccgttaacttaccgaacctacgttccgaccaaaggaaccgaaaccaaaccggggtaaccctaaaacggtaacccctccccgttaagtaccgttacgtacggaaactaaaacgtacggaaaaccgtcggttaccgtaagggtaaggaacgtcggttaaacgggacgggtaaccgttacccggggttctttagtttaacgttaccgtgggttacgacgggttaagggtaacgtttaaggaacgg

SEQ ID NO: 428512 - DNA, 682 bp, Homo sapiens
  misc_feature: GZ8MTXP01AKKOE.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggcttattttaaaggtgtccagtgtgaagtgcagctggtggagtcgtgggggaatcgttggtacagcctggcaggtccctgacgtactctccgtgtcgcacgtcctcgtaggtacttcctaccttttggaattgtaactttagtcgaccctaagtcggacctacggttcgggggtacccggacaaacgggtcccgtaccggggaagggggtaacgggtccgtaggggtacggttccggggttacctacggtaaggggtttaatttagggttaaagggtaaattaagggtcgttaaccgtaaagttagtacgtacctagtcggacggtactcggttaggacggaacgggcctacttccactactccgacgaagacgaaccaacgggaaccaaacgtacctcccgtatactctagaactaaatagaacgtagtcaagagacggtacagggaacggtacttaccgggttcttacggtaattacgtgtaggacggttaaggtaacgttaagtaaccg

SEQ ID NO: 428513 - DNA, 721 bp, Homo sapiens
  misc_feature: GZ8MTXP01ALED1.19.53.E09.1.454.CMB.2.raw
  modified_base (308)..(308): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagcctggcaggtccctgagctctcctgtgcagcctctggattcactttgatgattatgccatgcagtcggtccgnaacgcgtccgaggggacggcgtgggaggtcggtctagtaggtagttaggtaaggaattaagtgtacgttaaggtactacggtacctaagtcggaccgggtacttcgtagggtagggaaaccggggtcccgtaaactttcccgaaacctacgttaccctacccgaaaggtaaccgaaacccgaaaccggggaacccctaaaacggtaaaccccgttccccttaggttaacctcccggttaaacgaaaccgtaaagtaaccggaaaccgtacggttacgtaagggaacgttacggtaccggttaaacgggtaaaccgggtacccgttaacccgggtttccgtttaagggttaacccgtttacggtaacgggttaacggtaacgggttaaaaggggtaacggtttaaagtaaccgg

SEQ ID NO: 428514 - DNA, 572 bp, Homo sapiens
  misc_feature: GZ8MTXP01E03R9.19.53.E09.1.454.CMB.2.raw
  modified_base (462)..(462): a, c, t, g, unknown or other
  modified_base (488)..(488): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtggggggagcttggtacagcctggcaggtccctgagctctcctgtgcagcctctggattcacctttgatgattatgccatgcacgtcggggtccgacaacgcctaccggagggggaacgggtccgtgggaggtcggggtctcggagggttatttaggtggaagttaagtgtctaagtatacggccttagtcgcggtactcgtgaggacgggccattcaccatctcagacacaacgaccaacgactccgtgtacnctagactaaagtacgaaactagtacnggaggaacgcgttaggacgggttaacgaccgggtccttagttcttacgtggtagaacgaagggtaggttataacgaacgtaacg

SEQ ID NO: 428515 - DNA, 668 bp, Homo sapiens
  misc_feature: GZ8MTXP01AKS26.19.53.E09.1.454.CMB.2.raw
  modified_base (299)..(299): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagcgtggtggagtcgtgggggaggtcttgggtacagactgggcacggtccctgagactctcctgtgcagcctctggattcacctttgatgattangccatgacacgtggggtccgacaaggccgtaccgagggggaacgggtccgtagggaggttcggggtcctgtaaggttattaggttaggaaattggtgactagtatagtcctatggcggtactcgtgggtacggaacgggtccgtacttaccaacctacgtacctaccgaaggaacgaacccaaaccgggaccgaaacgtaaccctccccgtagttaacctcgtaacgaaacgtaaagtacgaaaccgtagtcgtaaggaacggacggtcgttaacgggaacggtaacccggttaccggttccgtttaaggttaacgttacggtaacgggttacgggaacgggttaaacgggggtaagttaacggtaacg

SEQ ID NO: 428516 - DNA, 611 bp, Homo sapiens
  misc_feature: GZ8MTXP01AB71Z.19.53.E09.1.454.CMB.2.raw
  modified_base (267)..(267): a, c, t, g, unknown or other
  modified_base (287)..(287): a, c, t, g, unknown or other
  modified_base (311)..(311): a, c, t, g, unknown or other
  modified_base (520)..(520): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggctattttaaaggtgtccagtgtgaagtgcagctggtggagtcgtgggggagcttggtacagcctggcaggtccctgagactctcctgtgcagcctntgattcactttgatgattangccatgctacgtcggggtcccganaacgcctaccggagggggacggcctgggagtcgggtctgaaggttattaggttaggaaatgtgactagtatagctagcgacggtactcgtagtggaacgggccgtaagtttccaacctactacccttaccgaaggacgaaccaaccggggaccaaacgtaccctccccgtagtacttcgacgaccaaatggaacctagtctaagaaggngtacgttagggacggtaacccgaccgggttcccgtttaagttaagtttaccgtgttacgggacgttaaaggggtaacggttaagtaacggg

SEQ ID NO: 428517 - DNA, 683 bp, Homo sapiens
  misc_feature: GZ8MTXP01A7LN3.19.53.E09.1.454.CMB.2.raw
  modified_base (176)..(176): a, c, t, g, unknown or other
  modified_base (268)..(268): a, c, t, g, unknown or other
tcagtactctcgtgcacgaccggtgctcgatttagagagagtgtgttggctctgggagaggagccccagccctgagattcccaggtgcttccattcagtgatcagcactgaacacagaggactcaccatggagttgagactgagctggtattttcctttggcttattttaaaggtntccagtgtgaagtgcagcgtggtcggagtcggtgggggagtcttggtacagcctggctacggtccctgagtctctcctgtcgcagtcctcgnggtattcctacgtttgattgtattatcgccagtcgctaccggtcggggtcccgacgaacggccgtaccgggaagggggtaaccggtccggtagggaggttcggggttaccccttaggaaggtttaaggttaggttacggtaaaagttaggtcgtacgttaagtagtacgtccttaagtcggacggtactgttaggacggacgggtacctacttaccactagtcccgacgaagaacgaacgaacccgacgaaacgttaacccgttccttaaggtactccggtaacgaaactaaacgtcgtaaacgtagtacgaagaacggtacggacggtacggaaacggtaccgtaaccgggtttacgttacgttacgttaacggtcggtaacgaacgggtaaggttacgtaacgttcggtaacg

SEQ ID NO: 428518 - DNA, 563 bp, Homo sapiens
  misc_feature: GZ8MTXP01DLQBK.19.53.E09.1.454.CMB.2.raw
  modified_base (259)..(259): a, c, t, g, unknown or other
  modified_base (280)..(280): a, c, t, g, unknown or other
  modified_base (300)..(300): a, c, t, g, unknown or other
  modified_base (354)..(354): a, c, t, g, unknown or other
  modified_base (356)..(356): a, c, t, g, unknown or other
  modified_base (512)..(512): a, c, t, g, unknown or other
  modified_base (534)..(534): a, c, t, g, unknown or other
  modified_base (540)..(540): a, c, t, g, unknown or other
  modified_base (550)..(550): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggcttattttaaaaggtgtccagtgtgaagtgcagctggtggagtcgtggggggagcttggacagcctggcaggtccctgagactctcctgtgcagcctnggattcactttgatgatttangccatgcacgtgggtccganaacgctccgaagggaggcctggacgtggtcctcgaggttataggtgaactaagntntagtatacgcttagcgacggtactgttagaggaacgggccctattacccaaccctaattccaccgaagaacgaaccaaaccggttacccaaaggggtaacccttcccggtagtaacttcctacgacaaagttaccgaaactggttcagagaacggngaggacgcgtacgtcttagttnttacgngagaagaggngttatcgcgtaag

SEQ ID NO: 428519 - DNA, 696 bp, Homo sapiens
  misc_feature: GZ8MTXP01AXVQY.19.53.E09.1.454.CMB.2.raw
  modified_base (295)..(295): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagcgtgtagtttcctttaggctatttaaaggtgtccagtgtgaagtgcagctggtggagtcgtgggggagtcttggtacagcctggcaggtccctgagcctctcctgtgcagtcctcgtggatttccactttgatgatttagngcctagtcgcgacgtcgggggtccggacaacggccgtaccggagggggaacgggtccgtggggaggtcgggttcctagtaagggttagttaggttaacgggaaattcggtggtattaagtacgtacgaccttagtcggaccgggtatcggttgggtacggaacggggtccctaaacttccaacgtactccgaccaaggacgaacccggaaaccggtacccaaaacggttaacccctccccggttaaagttaccgttcgtaaccgaaacgttaaaacgtaaacgtaacgtaacgtacgtaacggaacggacggtacgttacggtaacggtaaccggttaccggttcgttacgttaacgttacgttaacgtacggtacggttaaggtaacggttaacgtaacg

SEQ ID NO: 428520 - DNA, 630 bp, Homo sapiens
  misc_feature: GZ8MTXP01AZB8I.19.53.E09.1.454.CMB.2.raw
  modified_base (225)..(225): a, c, t, g, unknown or other
  modified_base (241)..(241): a, c, t, g, unknown or other
  modified_base (261)..(261): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttcctttggcttaattttaaaaggtgtccagtgtgaagtgcagctggtggagtcgtgggggagcttggtacngccgtggcaggtcccngagctctcctgtgcagcctntgacttcacctttgattgattatgccagtcgctacggtcggggtcccgacaacgtccgtaccggaagggggacggccgtgggaggtcggggtctacgaggttatttaggtaggaagttagtgtcgttagtagtacgtccttaagtcgacgggtacttacgtgggtacggaacggggtccctaattccaacctagtccctaccgaagaacgtaaccaaaccgaccaaacggggtaaccctccgtagtactcctagacaaagtcaacgtacgtcgagaaggtaagcgttagggaaacggaccgtacgggttactttaggttaatttccgtgggtaccaagggtaaaggggagttacgtaacggccgtaagg

SEQ ID NO: 428521 - DNA, 571 bp, Homo sapiens
  misc_feature: GZ8MTXP01AUR9V.19.53.E09.1.454.CMB.2.raw
  modified_base (315)..(315): a, c, t, g, unknown or other
  modified_base (492)..(492): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagcttggtacagcctggcaggtccctgagactctcctgtgcagcctctggacttcactttgatgtattatgccatcgcacgtgggtccganaacgctaccgaggggacggctagggagtcgggtctgaggttattaggttagggaattgtgtacgttagtatagcctagtcgcgtactcgtggtaggaacgggctattccactagtccacagaacgacaacggccaaagacctcctagtactcgtagaacaaatacgaactagttcgngaacggacgacttcgggaacggaccgttacgggttcctttaggttaacttacgtgtcgaggaaagggtgttaagtaagg

SEQ ID NO: 428522 - DNA, 673 bp, Homo sapiens
  misc_feature: GZ8MTXP01E31IM.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagcgtggtggagtcgtgggggagtcttggtacagccgtggcacggtccctgacgactctcctgtgcagcctctggtacttccacctttggatgtattatcgaccatcgccacggtcgggtacccggacaaacggccgtaccggagggggacggccgtagggaggtccgggtactagtaggttaagttaggttaaggaaagttgtgtactaagtatacgtacctagtcggacggtacttcggtaggtacgggaacgggtccgtaacttaccaacctaacgttccacccgaaagaacgaaaccgaaaccggggaccaaaacggtaacccttcccgtagtaacctcgtaacgaacctaaaagtacggaaacctagtaccgtaaggaagttacggtacgttacggaacggtaaccgttaccgggttcctttaggttaactacgtggtgaacgttaagggtaagttaagtaacg

SEQ ID NO: 428523 - DNA, 889 bp, Homo sapiens
  misc_feature: GZ8MTXP01ER0KH.19.53.E09.1.454.CMB.2.raw
  modified_base (310)..(310): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggcttattttaaaaggtgtccagtgtgaagtgcagcgtggtggagtcgtgggggagtcgttggtacagcctggcacggtccctgacgtactctccgtgtcgcacgtcctcgtaggtacttcgtacctttgattgtaattancgccctagtcgcctacggttcgggggtcccggacgaaacggtccgtaccgggaagggggaacgggtccgtaggggtacggttccggggttacgtacggtaaggggtttaagtttaagggttaagggtaaagttgggttagtaaccgtttaaagggttaacgttacggtacccgttaagtcgggtacccgggttaacgttccggttaggggttaacgggtaaaccggggtaccccggttaaacgtttaccccgaaaccttaaccggttacccctaaaccccggaaaggtaaaacccggtaaaccccgaaaaaccccgggggtaacccccttaaaaaaccgggttaaaccccctttcccccgttaaaggttaacccttaccccgtttaaggaaaaccccttaaaaaggtttaccggaaaaacccgttaccggttacggttaacgggaaagttaaccgggacgttaacggggaaaccgggtaacccgttaacccggggtttcccttttaaagggtttaacgtttacccggtaagggttaccggaaacgggttaaaaggggttaaggtttaaacgtaaccggg

SEQ ID NO: 428524 - DNA, 619 bp, Homo sapiens
  misc_feature: GZ8MTXP01DVDWJ.19.53.E09.1.454.CMB.2.raw
  modified_base (253)..(253): a, c, t, g, unknown or other
  modified_base (545)..(545): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggctaattttaaaaggtgtccagtgtgaagtgcagctggtggagtcgtgggggagcttggtacagcctggcaggtccctgagactctcctgngcagcctctggattcacctttgatgattatcgccatcgcacgtcggggtccgacaaggcctaccggaagggggaacggggcctagggggtagtcggggtcttaccgaagggtttatttaggttgggaaacttagggtagtcgttaaagtactaggtccctaagtcgtacgttactcgtaggtaggaacgggcctagttccaaccgtatcctaccgaagtacgaacaaccgaccaaagggtaaccttcccgtagtaactctagactaaagtacgaactaagtctaggagaacncgttagggaacggttactacgggttctttagttacttacgtgtaggtaacgaagggtagttagtaagcgtaacg

SEQ ID NO: 428525 - DNA, 800 bp, Homo sapiens
  misc_feature: GZ8MTXP01CZJKO.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagcgtgggtggagtcggtgggggaggtcgttaggtacagcctggcctacggtccctgacgtactcctccgtggtcgcagcctcgtggtacttctacctttgatgtattatcgcctatcgacgtacggtcgggtaccggacaacgtccggtaccggagggggaacggccgtagggacggtcggggttcctaggtaagggttattagggtaagggtaaagtggtagtacgttaaggtaacgtacggtaccgttaaagtcgggtacccgggtaacgttcggtaggggtaacggggtaacgggggtaccccttaagttacccgaaaccctacgttacccctaaacccggaaacggaaccgtaaaaccccgaaacccgggggtaaacccaaaacgggttaaaccccttcccccggttaaggttaacctcggttaaacggaaacttaaaacgtcggaaaaccctggtacgtaagggaacggttaacgggtccggaaggaacccggggaaccgttacccggggtttcccctttaaggtttaaccccgttaacgggtcgggttaacgggaacgggttaaagggggtaagttaacggtaaaccggg

SEQ ID NO: 428526 - DNA, 628 bp, Homo sapiens
  misc_feature: GZ8MTXP01EZFGJ.19.53.E09.1.454.CMB.2.raw
  modified_base (290)..(290): a, c, t, g, unknown or other
  modified_base (384)..(384): a, c, t, g, unknown or other
  modified_base (403)..(403): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttaattttaaaaggtgtccagtgtgaagtgcagcgtggtggagtcgtggggggagtcttggtacagcctggcaggtccctgacgactctcctgtgcagcctctggattcacctttgattgtattangccatgccacggtcggggtcccgacaacggccgtacccggaagggggaacggccgtgggaggtcggtctacgtaggttattaggtgaaattagngtcgtaagtatacgcctancgggcgtactcgtaggtggaacgggcctaattccgaacctacttaccgacccgaagaaccgaaaccgaaacccgaccgaaacgggtaaccttccccgttaagtactacgtacgaactaaacgtacgaaactacggtacgtagaacggaagtcgttaggaacggactagttcgttaccgtttgttaaccttgtaggtcgaagtaagggttagtaagttaagaaccg

SEQ ID NO: 428527 - DNA, 618 bp, Homo sapiens
  misc_feature: GZ8MTXP01C6L7J.19.53.E09.1.454.CMB.2.raw
  modified_base (290)..(290): a, c, t, g, unknown or other
  modified_base (542)..(542): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggctatttaaaaggtgtccagtgtgaagtgcagctggtggagtcgtgggggagcttggtacagcctggcaggtccctgacgactctcctgtgcagcctctggattcacctttgatgattangccatgctacgtcgggtccgacaacgccgtaccggagggggaacgggccgtggggacggttcggggtcttacgtagggttattaggttaagggaaattggtcggtacttaaggttaatacgtacctagtcgggtacgtacttacggtggtagggaacgggtacccgtaattaccacctactccacaacgaacgaaccaaacggggacccaaagtacctcccctagtactcctagaacctaaagtcgtaaacngttcgaagaagagcttaggacggacgttaccggttcttagttaactcgtggtacgagaaaggtggttaagtaacgg

SEQ ID NO: 428528 - DNA, 619 bp, Homo sapiens
  misc_feature: GZ8MTXP01AY53B.19.53.E09.1.454.CMB.2.raw
  modified_base (289)..(289): a, c, t, g, unknown or other
  modified_base (441)..(441): a, c, t, g, unknown or other
tcagtactctcgtgcacgaccggtgctcgatttagagagagtgtgttggctctgggagaggagccccagccctgagattcccaggtgtttccattcagtgatcagcactgaacacagagactcaccatggagttgagactgagctggtattttcctttggcttaattttaaaaggtgtccagtgtgaagtgcagcgtggtggaggtcgtgggggagtcttggtacagccgtggcgacggtccctgacgtactctcctgtgcagcctctggattcactttgatgtattancgccatcgctacggtcgggtcccgacaacggccgtaccgggaagggggacgggtccgtgggaggtcggtactacgtagggttagttaggtaggtaataggtgtctagtagtacgcctagtcggcgtactcgtggaggacggtcattccactntcacagacaacacgaccaaacggtacctacccgtagtactacgtacgaactaaatacggaactagtccgtaggaggaacgtcggttaacgggaacggttacccgtacgggttcctttacggttacgttaccggttggtaggtaacggaaaggggtagttaagtaacgaacgtaaccgg

SEQ ID NO: 428529 - DNA, 714 bp, Homo sapiens
  misc_feature: GZ8MTXP01B0FKQ.19.53.E09.1.454.CMB.2.raw
  modified_base (257)..(257): a, c, t, g, unknown or other
  modified_base (266)..(266): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttattttaaaaggtgtccagtgtgaagtgcagcgtggtggagtcgtgggggagtcttggtacagcctggcaggtccctgacgtactctcctgngcagtcctntggattcacctttgatgtattatgccagtcgcctacgttcggggcccggtacaacgtccgtacccgggaagggggaacggggtcccgttagggggaggttcgggggtaccttaccggtaaggggtttagtttaaggttagggtaaactttaagggtcgtaacgttaagttagtacggtccttaagtggaccggtactcgtggtaggaacggggtcctaacgttccaaaccctcgtacctaccgaacggaaccgaaaccgtaaacccgacccctaaacggggtaaccccttacccgttaagttacctaccgttaacgaacctaaagtaaccgaaactacggttaccgttaagggacgaagggtcgttagggaacggttaccgtaaccggttccttttaggttactttacgtggtagtaacggaagggtagttagtaacggttcgtaacg

SEQ ID NO: 428530 - DNA, 563 bp, Homo sapiens
  misc_feature: GZ8MTXP01AETHN.19.53.E09.1.454.CMB.2.raw
  modified_base (291)..(291): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagcttggtacagactggcaggtccctgagactctcctgtgcagcctctggattcacctttgatgattangccatgcacgtgggtccgcagctcgagggacggccgtggagtcggtctcgaggttataggtgaaaatgtagcgtagtagtagcctagtcggcgactcgtggtaggaacgggaccgtacttaccacctattccaccgaacgacgaaccaaaccggggaccaaacggtaaccctacccgtagtactacgtcgaacaaattgaaacctaggtctaagagagtcgttggaacgacgacggttcttagtaactatgtgacgaaggtgttaagtaacg

SEQ ID NO: 428531 - DNA, 663 bp, Homo sapiens
  misc_feature: GZ8MTXP01CNQWR.19.53.E09.1.454.CMB.2.raw
  modified_base (264)..(264): a, c, t, g, unknown or other
  modified_base (268)..(268): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttattttaaaaggtgtccagtgtgaagtgcagctggtggagtcgtgggggaggcttggtacagccgtggcaggtccctgacgctctcctgtgcacgcctntggnttctactttgatgtattatcgccatcgcacgtcggggtccgacaacggccgtcccggaagggggacgggccgtaggggaggttcggggtctacggtaggttatttagggttaggaagttagttgtcgttaagtactagtccttagtcgggtccgggtacttccggttaggtacgggaaaccgggtccgtacttaccgaacctaacgttcacccgaagacgaaccaaccgacccaaagggtaaccccttccgtataactctacgaactaaagtacgaactacggttcaaggaacgaaggtcgttagggaaacggaccgtaaccgggttccgttttagttcgtttaacgtgggttagaacggtaaagggggtaagttagttaacgggcgttaacggg

SEQ ID NO: 428532 - DNA, 585 bp, Homo sapiens
  misc_feature: GZ8MTXP01CJJM1.19.53.E09.1.454.CMB.2.raw
  modified_base (276)..(276): a, c, t, g, unknown or other
  modified_base (297)..(297): a, c, t, g, unknown or other
  modified_base (320)..(320): a, c, t, g, unknown or other
  modified_base (373)..(373): a, c, t, g, unknown or other
  modified_base (419)..(419): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttccttttggcttaattttaaaaggtgtccagtgtgaagtgcagctgggtggagtcgtgggggagtcgttggtacagcctggcaggtccctgagcctctcctgtcgcagcctntggattcactttgatgattancgccatcgctacgtgggtccganaagctaccggagggacggccgtggagtcggactcgaggtattagtaggaatgnactagtatagctagcgcgtatcgtgaggagggtcctattccaactntccgacaagacgaaaccacgggacaaacgtaccctaccgtatactcctagaacctaaagtacgtaaactcgtgtaagaacggaacgtccgttaggaaacggggtccttaccgggttccgtttataacgttacgtggtacgacggaaagggtgggttaattaaccgg

SEQ ID NO: 428533 - DNA, 686 bp, Homo sapiens
  misc_feature: GZ8MTXP01EXW0O.19.53.E09.1.454.CMB.2.raw
  modified_base (286)..(286): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtgaagtgcagcgtggtggagtcgtgggggagcttggtacagcctggcaggtccctgagactctcctgtgcagcctctggacttctacctttgatgattangccatgctacgtcgggtccgacaacgccgtcccggaagggggaacgggtccgttgggaaggttcggggtctaccgaagggtttaattagggttaggaaattaaggtgtaacgttaagtaacggtacgaccctttaagtcgggacgtaacgttcgtagggtaggaaaccggggtcctaacgttaccctaaccacgttacccgtacccgaaaggaaccgaaccaaaacccggacccgtaaaacggggtaacccctttaccccgtagtttaacctaccgttaacgaaacctaaagttaacggaaacctaggttacgtagggaaaggcgtacgttagggaccggaccgacggttccttagtttcgttacgtggtagaacgtaagggagttagtaacgcgtaacg

SEQ ID NO: 428534 - DNA, 613 bp, Homo sapiens
  misc_feature: GZ8MTXP01ANWJL.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggcttattttaaaggtgtccagtgtgaagtgcagctgggtggagtcgtgggggagcttggtacagcctggcaggtccctgagactctcctgtgcagcctctggattcacctttgatgattatgccatgcacgtcggggtccgacaagctaccgagggggaggccgtggaggtggtctcgagggtatttacggtaggtaattagtgtcgtagtatacgccttagtcgggacgtacttgtaggtaggaacggggcctagttccaaccattaccgtaccaaggaacgaaccaaccgaacccgaaacgggtaaacccttcccgttacgtaattcccgtagacaaaagttacggaaactagtacgtaggagtaacgcgttagggaccggttaccgaccgggtccgtttagttactttaccgtggtagaacggtaaagggtggttagtaacgctaacggg

SEQ ID NO: 428535 - DNA, 763 bp, Homo sapiens
  misc_feature: GZ8MTXP01AV40K.19.53.E09.1.454.CMB.2.raw
  modified_base (658)..(658): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctgggtggagtcggtgggggagtcttggtacagccgtggcagggtccctgacgctctccgtgtgcagtcctgtggtacttcaccttttgatgtattatgtacagttcgccgtacgtcgggggtacccggacaaacggccgtacccgggaaggggggtaacggggtcccgttagggggacggtttcgggggtacctacggttaaggggtttaagtttagggttaacgggtaaattaaggttacgggacctttaaagggttactaacggtcccgtttaaagtccgggtacggtaaccgttccggttaggggtaacggggaaccgggtacccggtaactttacccaaacctcgtaccccgtacgaaggaacgaaacccgaacccggggaaccaaacggtaccctaccccgttagtacttaccgagaacctaaagtcggaaaacctcggggttaanaaggaacggacgtcggttaacgggtaaccggtaacccgttaccggttcgtttagttaacgttaggtaacggtacggaacggttaagggtaacgttaagtaaccgg

SEQ ID NO: 428536 - DNA, 577 bp, Homo sapiens
  misc_feature: GZ8MTXP01A6BR6.19.53.E09.1.454.CMB.2.raw
  modified_base (300)..(300): a, c, t, g, unknown or other
  modified_base (321)..(321): a, c, t, g, unknown or other
  modified_base (483)..(483): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggcttaatttaaaaggtgtccagtgtgaagtgcagctggtggagtcgtgggggagtcttggtacagccgtggcaggtccctgacgctctccgtgtcgcagcctcgtggtacttccacctttgatgatttangccatgccagtcgggtccganaacgtccgtacggaggggacggccgtggtaggtcgggtctagtaggtattaggtaggaatgcgtgtagtaatcgtctagtacggcgtactgtgggtaggaaccgggtcctaattccacctatcccgaccgagacgaccaaacgggtcaaacgtacctccgtntatccaagaacaaagtacgaatacgtagtaagagagcgaggacggtacgttacgttcgttagtaatacgtcgtagaggaggtaagttaagtaag

SEQ ID NO: 428537 - DNA, 750 bp, Homo sapiens
  misc_feature: GZ8MTXP01AT3HW.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctcggtggagtcggtgggggaggtcgttgggtacaggccgtgggcctacgggtcccctgacgtacctcctcctgtcgcacgtccctcgtggtacttcctacctttgatgtattatcgccatcggcctacggtcgggtcccggacgaacggcccgtacgggaagggggaacgggtccgtaggggtaggttcgggtactacggtaggtttaagtttaggtaagggtaattgtgtacgtaagtagtcgtacgtagtcggaccgtagtcggtaggtacgggaacgggtccttaactcccgaactcgtacctaccgaaggaaacgaacccgaaaccggcccgtaaaaccggtaacccttccccgttagtaacctccggtaacaacgtaaaaacgttcgaaaaccgtaggtttcccgtaagggaaacgacccggtaggttaccgggaaaccggggttaaccaacccgggggtttccttttaaggttaaccgtttacggtgggttaaccgggaaggggttaaaaccgggttaaggttaaacgtaaccgggg

SEQ ID NO: 428538 - DNA, 622 bp, Homo sapiens
  misc_feature: GZ8MTXP01BC8U7.19.53.E09.1.454.CMB.2.raw
  modified_base (588)..(588): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaggtgtccagtgtgaagtgcagctggtggagtcgtgggggagtcttggtacagcctggcaggtccctgacgactctcctgtgcagcctcgttgggtacttcctacgtttgatagtattagtcgctagtcgccgtacggtcggggtaccgacgaacgtcgtaccgggagggacggtcgtggtacggtcggtctaggtagttattacggtaagtagtgtcgtaagtagttagtactacgtgtacggcgtacgtcgtagggtagggaccggtacgtacttaccacctacgtacacgaacggaaccgaaacgaccggaaaccgtaaacgtacccttaccgtattacctacgtacaaagtaaactaacgaacgtacgtcgtaaggacgagtacgaggacgaacgttcgttnttacgtaatacgtgacgagaggtgttaacgtaag

SEQ ID NO: 428539 - DNA, 853 bp, Homo sapiens
  misc_feature: GZ8MTXP01DZRD9.19.53.E09.1.454.CMB.2.raw
  modified_base (269)..(269): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttaattttaaaaggtgtccagtgtgaagtgcagcgtggtggagtcgtgggggagtcttggtacagccgtggcgaggtccctgacgtactcctcctgtcgcagtcctntggacttctactttgatgtattagcgccagtcgaccgacgttcggggtacccgactaacggtccgtacccgggaagggggtaacggggtccgttaggggtaacgggttcggggttaccttaacggtaaggggtttaagttttaaggggtttaggggtaaaacgtttaagggttacgtaaccgttaaaggttaaacgttaacggtccccgttaaggtcgggtaccgggtaaccgttcgttagggtaacgggtaacgggggtacccttaacttacccgtaaacccctacgtttaccccaaccccgaaagggtaaaacccgaaacccgtaaaaccccggaacccgttaaaaaccggggttaacccctttacccccggttaaaggttaacctttacccgaacggtaaactaaaaacgtttacgggaaaccctaaagggttccgttaacgggaaagaacggggttaccgttaaacgggggaaacccggttaaacccgtaaccggggtttacccttttaaggggttacctttaccggtaagggtaggtaaaccggtaaaggggtaggttaactaacggaacgttaaccgg

SEQ ID NO: 428540 - DNA, 599 bp, Homo sapiens
  misc_feature: GZ8MTXP01ASLN0.19.53.E09.1.454.CMB.2.raw
  modified_base (179)..(179): a, c, t, g, unknown or other
  modified_base (245)..(245): a, c, t, g, unknown or other
  modified_base (258)..(258): a, c, t, g, unknown or other
  modified_base (285)..(285): a, c, t, g, unknown or other
  modified_base (299)..(299): a, c, t, g, unknown or other
tcagtactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccgagggaagggcctggagtgggtctnaggtattagttggaatagtgctagtatagcctatgcgactctgtgaaggccattcacatctcaganacaacgcaagacnccctgtatctgacaaatgaaacagtcngagagctggagacncggcctttgtattactgtgacaagggtacgtatagcagcttaaacgtggtaacgacgtaacgggtcggggacccaacggggtaaccctgggtaccctacccgttctcccgtcacgtccctccaacccgaacgggcccacgtccggtcccttcccccgtggcccgtcccacgtcgtcccgacggtacgcctaccgccgagacgccgaacgccggccgggccccgtgggccgtcgccgttcggtacgaacgggttacccttaccttaacccgaggtaagtacgtccgttggaacggcgggcg

SEQ ID NO: 428541 - DNA, 646 bp, Homo sapiens
  misc_feature: GZ8MTXP01EPKRT.19.53.E09.1.454.CMB.2.raw
  modified_base (285)..(285): a, c, t, g, unknown or other
  modified_base (305)..(305): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctaattttaaaaggtgtccagtgtgaagtgcagcgtggtggagtcgtgggggagcttggtacagcctggcaggtccctgacgactctcctgtgcagcctctggattctacctttgatgtattangccatgctagtcgggccganacgcgtcccgagggaacgggtccgtggaggtcgggtctaccgaggttagttaggttagaagttaagtgtaacgttaagtaagtacgtccgtaagtcgggacgtacgtcgtagtaggaacggggctacttaccgactactctacgagacgaacaaacgaccaaacggtaccttccgtagtactctaacgactaaagtacgaaactagtacgtagaaggtaacgtaccgttagggaacggttaaccggtaaccgggttacccgtttaggtttaacgtttacgttaacgggttaggaaccgggtaaaaggggtagggttaactaacgggttaacgtaacccggg

SEQ ID NO: 428542 - DNA, 694 bp, Homo sapiens
  misc_feature: GZ8MTXP01AD08N.19.53.E09.1.454.CMB.2.raw
  modified_base (615)..(615): a, c, t, g, unknown or other
  modified_base (669)..(669): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagcgtgggtggagtcgtgggggagcttgggtacagcctgggcaggtccctgacgactctcctggcgcagcctctggattcactttgatggtattagtgccatgccgtacgtcgggggtccgcaacggccgtaccggagggggaacgggtccgtggggtaggtcggggtactacgtaagggttattaggttaagggaaacttggttcgagtttaggtactacggtcctagtggtaccgggtacttcgtagggtacgggaaacggggtccccgtaatttacccgaacccgtataccccgttacccgaaagggtaacgaaaccccgaaaccggggttaaccccaaaacggtaccccttaccccggtagtaaacccttgacgaaaccctaaagttcggaaaactgtccgtaagganacggtcttgggaaacgtcccggttacggttcctttaggttaactacttgggganaccgaaaggggtaagttaagtaacg

SEQ ID NO: 428543 - DNA, 713 bp, Homo sapiens
  misc_feature: GZ8MTXP01CB3A3.19.53.E09.1.454.CMB.2.raw
  modified_base (297)..(297): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttattttaaaaggtgtccagtgtgaagtgcagcgtggtggagtcgtggggggagtcttggtacagccgtggcaggtccctgacgactctccgtgtgcagtcctctggactttccaccttttgacttgtaatttancgccctattcggacctaaccggtcgggggtacccggactaaacgggcccgttacccgggaaagggggaacgggtcccgttagggaggttcgggggttcctacggtaaggggttatttagggttaggtaagtaagggttgtcgtaagttagtacgtccgttaagtcgggacgtactcgttaggtacggaacggggtcctaatttcccgacctaacgtcccgtaaccgaacgaaacgaaacccgtaacgaacccgaaacgggtaaccttccccgttagtaacttcgaacgaactaaacgtacgaaaccgtaagttctaaggaaggtaacgtacgttagggaaccggaccgtaaccggtctttaggttaaacttcgttaacggtagaagtaaagggtggttaactcggaacgtaaccgg

SEQ ID NO: 428544 - DNA, 611 bp, Homo sapiens
  misc_feature: GZ8MTXP01CP2M3.19.53.E09.1.454.CMB.2.raw
  modified_base (270)..(270): a, c, t, g, unknown or other
  modified_base (275)..(275): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttccttttggcttattttaaaaggtgtccagtgtgaagtgcagctgggtgggagtcgtgggggaggcgttggtacggcctggcacggtccctgagctctcctgtgcngcctnggattctacttgatgattatgccagtgcacgtcggggtccgacgaacgccgtaccggagggggacggccgtgggaggtcgggtccctacggtagggttattaggtaggaaattaggtgtactagtactacgtcctagtcgcgtacttcgtaggtaggaacgggcctagttccacctatccaccagaacgacgacgaccggaaccaaacggtacccttcccgtagtacctctacgaactaaactacgaactcgttcgaaggaggacggccgttaagggaacggtccgaccggtttccttagttaactacgtggtagacgaagggtcgttaagtaacg

SEQ ID NO: 428545 - DNA, 463 bp, Homo sapiens
  misc_feature: GZ8MTXP01EVMLJ.19.53.E09.1.454.CMB.2.raw
  modified_base (267)..(267): a, c, t, g, unknown or other
  modified_base (318)..(318): a, c, t, g, unknown or other
  modified_base (449)..(463): a, c, t, g, unknown or other
tcagtactctcgtgcacgaccggtgctcgatttagagagagtgtgttgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactacgtggggccagggaaccctggtcaccgtctctcacgccnccacgacggcccagtccggtcctcccccgtggccgccctgctccgaggacncacctccgagacgccacgcgccggccctgggccctcggccgtggtaccgaacggtaacccttacccgttcccgaacggtagacggttaaccgtggacgggtcggggctgggaccgaaagggcgacaatagnnnnnnnnnnnnnnn

SEQ ID NO: 428546 - DNA, 608 bp, Homo sapiens
  misc_feature: GZ8MTXP01AJBVZ.19.53.E09.1.454.CMB.2.raw
  modified_base (287)..(287): a, c, t, g, unknown or other
  modified_base (529)..(529): a, c, t, g, unknown or other
  modified_base (590)..(590): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttattttaaaaggtgtccagtgtgaagtgcagcgtggtggagtcgtgggggagtcttggtacagcctggctaggtccctgagctctcctgtgcagcctctggacttcacctttgatgtattangccatcgcacgtcggggtccgacaaggctaccggaaggggacgggtccgtgggacgtggggtcctcgtagggttatttagggtgaattaaggtgcttagtactacgcctagtcggacggtacttcgtaggtacggaacggggcctaacgttccacctattaccacgaagacgaacaaccgtaccaaacgtaccgtccctagtaactctgactaaagtacgaactaggttcagaaggaaccgngttaggaaacggacgtacccggtacgtttagttacttaccgtgggtaggaacgtaaagggngttaaagcgaacgtaacg

SEQ ID NO: 428547 - DNA, 576 bp, Homo sapiens
  misc_feature: GZ8MTXP01E285V.19.53.E09.1.454.CMB.2.raw
  modified_base (322)..(322): a, c, t, g, unknown or other
  modified_base (426)..(426): a, c, t, g, unknown or other
  modified_base (516)..(516): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttccttttggcttattttaaaaggtgtccagtgtgaagtgcagctggtggagtcgtgggggagtcttggtacagcctggcaggtccctgagactctcctgtcgcagcctcgtggtacttctacctttgatgtattatcgccatgcacgtgggtcccganaagcctacggagggacgggcgtggagtcgggtctgaggtattaggtagaatgtgactagtatacgtctagtgcgatcgtgtaggacggccgtatccgacagtcnccgaagacgaaccaacggaccaaacgtaccctccgtataactactaaacgaaatctaactagtctaggaagacgttcgaggacggtaccnccggttacgtttcgttaaacttcggtgttaaccgaggtaagggacgttaagaagtaaccg

SEQ ID NO: 428548 - DNA, 814 bp, Homo sapiens
  misc_feature: GZ8MTXP01ERB5T.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagtcgttggtacagccgtggctaggtccctgacgtactctccgtgtgcacgtcctgtggtattccgtacctttggaacttgtatttagtcgcctagtcgcctacggtacgggggtccggacgtaacggtccgtaccgggaagggggtaacgggtcccgttagggggacggtttcggggtaccttacggtaaggggtttagttaagggttaagggtaaacgttgggttggtaccgtttaaagggttaacgttacggacccgtttaagtccgggtaccggttaacgttcggttagggtacgggaaaccgggggtcccgtttaaacgtttaccccaaacccttaccgttaccccgtaacccggaaggtaaacccgtaaacccccgaaaccggggtaaccccgtaaaacccgtaaaccccggtttacccctagggtttaacctccccggtttaaggaaaccctaaaaggttacgaaacccgtaggttaccgaagggtaagttacggtacgttacggggaacgtaaccggttacggttccgtttaagtaacggttaacgtggtaaccggacgttaaagggtcgtttaaggtaaccg

SEQ ID NO: 428549 - DNA, 639 bp, Homo sapiens
  misc_feature: GZ8MTXP01AYN8H.19.53.E09.1.454.CMB.2.raw
  modified_base (299)..(299): a, c, t, g, unknown or other
  modified_base (617)..(617): a, c, t, g, unknown or other
  modified_base (630)..(630): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagcgtgggtggagtcggtgggggagtcttggtacagcctggcaggtccctgacgactctcctgtgcagcctcgtggattcactttgatgtattancgccagtcgaccacggtcggggtacccggacaaacggcctaaccgggaagggggtaacggtccgtaggggtaggttcggggtacctaggtaagggttaattagggttagaaattggtgacttaaggttatacgtaccgtagtcggaccgtaactccggttagggtacgggaaaccgggtcgtaacttaccaacctactacctacccgaagaaacgaccaaacggacccaaagtaacccctccgtagtacttcagtaacaaatcgaaactagtcgaaggattacggccttgggaacgtacgaccggttcttagtcgtangtagacgttaagnggttaagcg

SEQ ID NO: 428550 - DNA, 670 bp, Homo sapiens
  misc_feature: GZ8MTXP01DFSCQ.19.53.E09.1.454.CMB.2.raw
  modified_base (175)..(175): a, c, t, g, unknown or other
  modified_base (268)..(268): a, c, t, g, unknown or other
  modified_base (584)..(584): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttagtttaaaggntccagtgtgaagtgcagcgtgggtggagttcggtggggggtagtcgttggtacagccctggcacggtccctgacgactctcctgtgcagcctntggacttctactttgattgtattatgaccatcgcgtacggtcgggtaccggacaacggcgtacccgggaagggggacgggtccgttaggggtacgtggggtaccttaccggtagggtttaagtttaggttaggaaattgggtagtaacgttaagtaaataacggtccttaaagtgggtaccggtacttcgtaggtacgggaacgggtcctacttaccgaactctaccgtacgaacgaaccaacgaaccgtacccaaacgggtaacccttcccgtaagtactacgtacgaacaaagttacgaactagtcgaggaagngtacggttgaaccgggaccgtacgggttcccttaggttaacttacgtgggtacgaacggtaaagggtacgttagtaacgcgtaacg

SEQ ID NO: 428551 - DNA, 669 bp, Homo sapiens
  misc_feature: GZ8MTXP01A6RJE.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttcctttggacttaattttaaaaggtgtccagtgtgaagtgcagctggtggagtcgtgggggagtcttggtacagccgtggcaggtccctgacgactctcctgtgcagcctgtggacttcacctttgattgtattatgcctatgcctacggtcgggggtacccgacaacgtccgtaccggagggggaacgggtcctaggggacggttcgggtctacgtaggttacgttaggttaaggaagttggtagtacgtaaggtactacggacctagtcggaccgtacttcgtgggtacggaacggggtacctacttaccacctacgtacctacccgaaggaaccgaacccgaaaccggggaccctaaacggtacccttaccccgtaggtaccttcggacaaaccgaaatcggtaaacctgtccgtaaggacgaggtccgttaggaacggtacgttaccggttcgtttaggttaattccggtgtacggtacggaagggtcgttaagtaaccgg

SEQ ID NO: 428552 - DNA, 609 bp, Homo sapiens
  misc_feature: GZ8MTXP01BYKON.19.53.E09.1.454.CMB.2.raw
  modified_base (489)..(489): a, c, t, g, unknown or other
  modified_base (494)..(494): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagcgtggtggagtcgtgggggaggtcttggtacagcctggcgacggtccctgacgacctctctgtgcagcctctggtacttctacctttgatgtattatgcctatcgcctacggtcgggggtcccgacgaacgtccgtaccggaagggggaacggccgtggggtaggtcgggtctagtaggttacttaggtaagaagtgtgacttagtatagcctagtgccgatcgtggtagacggtcgattcaccatcacaagagaaccaacgaccaaagtcctccctagtacncgtanaaactaatagaactgtcgtaagaagcgtacgttacgggaacggtacgttaccgggttcgtttacgttaagttaccggttaaggtacggaaggttaacggggtaagttaacgaacg

SEQ ID NO: 428553 - DNA, 776 bp, Homo sapiens
  misc_feature: GZ8MTXP01A8ACD.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttaattttaaaggtgtccagtgtgaagtgcagcgtggtggagtcgtgggggagcgttggtacagcctggcgacggtccctgacgtactctcctgtgcacgcctcgtgacttctaccgtttgatgtattagtcgaccctagtcgccgtacggttcgggggtaccccggacgaacggtcccgtacccgggaagggggtaaccgggggtcccgttagggggtaacggttcggggttaccttaccggttaaggggttttaacgtttaagggtttaaggggtaaagtttaacgggttacggtaacgtttaaaggttaaagttaccgtacccgttagtacgggtaccgggtaccttcggtaggtaacgggaacgggtaccgtaccttaccgaaaccctacgttaccgtaaccccgaaaggaaaccgaaacccgaaacccggtaaccccgaaacgggggttaaaccccttacccccggttaagttaacttaccgtaaaccggaaacctaaaagttacggaaactacggtactaggaacgaacggtcgttacgggaacgttaccgtacgggtccttagttcttacgtggtgaacgtaagggtcgttaataacggcgtaacgg

SEQ ID NO: 428554 - DNA, 614 bp, Homo sapiens
  misc_feature: GZ8MTXP01CZ5X8.19.53.E09.1.454.CMB.2.raw
  modified_base (370)..(370): a, c, t, g, unknown or other
  modified_base (392)..(392): a, c, t, g, unknown or other
  modified_base (521)..(521): a, c, t, g, unknown or other
  modified_base (595)..(595): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctattttaaaaggtgtccagtgtgaagtgcagctggtggagtcgtggggggagcttggtacagcctggcaggtccctgagctctcctgtgacagccctctggattcaccttttgattgattatgccatcgcacgtcggggtccgatacgctccgaagggggacgggtcctgggagtgggtctcgtaagggtattagtggaacttaaggngtctagttatacgggaccttancggcggtactcttgggtcggaaacggggccgtacttcaacccgtctacctccagacgaaaccaacccccgaaagacccgttacctcgttaatcgttccaactaaatcgtaaacccgagttcgtgaaggngtccgtgggacggtaaccggacgttcccggtttgttaaacgttttgcggttaaggacgaaagggtttaaggggnttacggaacgttcgtaacg

SEQ ID NO: 428555 - DNA, 681 bp, Homo sapiens
  misc_feature: GZ8MTXP01BTHY5.19.53.E09.1.454.CMB.2.raw
  modified_base (252)..(252): a, c, t, g, unknown or other
  modified_base (287)..(287): a, c, t, g, unknown or other
  modified_base (472)..(472): a, c, t, g, unknown or other
  modified_base (663)..(663): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttattttaaaaggtgtccagtgtgaagtgcagctggtggagtcgtgggggagcttggtacagcctggcacggtcctgacgactctcctgngcagtcctcgtgacttcactttgatcgtattagcnctaagtcgccgtacgtcggggtccgactacggcctacccggaaggggaacgggtcctagggtaggtcgggtcctacggagggtttaattagggtacggtaattaacgggtagtaacgtagttaaacgtacgtccgtagtcggacgtactgttaggacggtaacggggcctaacttccaaaccgtnttaccacgaacgaacgaaccgaaacgacccaaacggggtacccttccggttatacttccgacggaactaaagtacggtaaacctaggttccgtaaggaacgggtaacgtacggttagggaaccgttaccgaacgggtttccctttaggttaactttaccgtgggttagaaccggttaaagggacggtttanaaccggttcgtaaacggg

SEQ ID NO: 428556 - DNA, 503 bp, Homo sapiens
  misc_feature: GZ8MTXP01D5XMM.19.53.E09.1.454.CMB.2.raw
  modified_base (253)..(253): a, c, t, g, unknown or other
  modified_base (261)..(261): a, c, t, g, unknown or other
  modified_base (299)..(299): a, c, t, g, unknown or other
  modified_base (353)..(353): a, c, t, g, unknown or other
  modified_base (355)..(355): a, c, t, g, unknown or other
  modified_base (361)..(361): a, c, t, g, unknown or other
  modified_base (394)..(394): a, c, t, g, unknown or other
  modified_base (397)..(397): a, c, t, g, unknown or other
  modified_base (427)..(427): a, c, t, g, unknown or other
  modified_base (437)..(437): a, c, t, g, unknown or other
  modified_base (453)..(454): a, c, t, g, unknown or other
tcagtactctcgtgcacgaccggtgctcgatttagagagagtgtgttggctctgggagaggagcccccagccctgagattcccaggtgtttccattcagtgatcagcactgaacacagaggactcaccatggagttgagactgagctggtattttccttttggctaattttaaaaaggtgtccagtgtgaagtgcagctggtggagtctgggggagcttggtacagcctggcaggtccctgagactctcctgngcagcctntggattcacctttgatgattatgcatgcatgggtccgnaagctccgaagggaacgggcctggagtgggtctacgaggtatagtggaataagngntagtanaagcctatgcgatctgtagaggcattcacatcncanagacaacgccaaaggaactccctagtatcngacaaataanaatagtactgagaagnngagagacggtcttgttattactgtagaagaaggaggttataagttgaag

SEQ ID NO: 428557 - DNA, 747 bp, Homo sapiens
  misc_feature: GZ8MTXP01BVLVR.19.53.E09.1.454.CMB.2.raw
  modified_base (335)..(335): a, c, t, g, unknown or other
  modified_base (678)..(678): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagcttggtatttttccttttggacttaattttaaaggtgtccagtgtagaagtgcagcgtgggtggaggtcggtggggggtagtcgttagggtacaggtcccgtgggcgtacgggtcccctggacgtacctcctccgtgcgcacgtccctcgtggtactttctaccgtttgactgtattacgncctatgccgtacggtcgggtaccgacaacggccgtaccggaggggacggtccgtgggtaggtcggtcctagtaggttacgtttaaggtaaggtaattgtgtacttaaagtacgtacgtaccgttagtcgggaccggtactcggttacgggtagggaaccgggtacccttaaccgttacaaccctacgttacccgaccgaaggaaaccgaacccgaaacccgggtaaacccctaaagggttaacccccttccccgttagtaacctcgtacgaaactaaagtacggaacctagtcgtaagaacggttagtccgttaaacgggtacggaacccgttacccgggttnttttaacggttaacgtttaccggtgggtaacggtaacgggttaaagggttaaccgttaaagggtaacgg

SEQ ID NO: 428558 - DNA, 697 bp, Homo sapiens
  misc_feature: GZ8MTXP01DR7KF.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagcttggtatttttccttttggcttattttaaaaggtgtccagtgtgaagtgcagcgtggtggagtcgtgggggagcgttggtacagcctggcaggtccctgacgacttctcgtgtgctacgcctgtggacttctaccttttgatcgtattagtcgacctatgacctacggttcggggtaccgacgaacgtcccgtaccggacgggggaacgggtccgtaggggacggttccggggtacttacggtaaagggtttagtttaagggttaaggtaaattaagggtgtacgttaaagttacgtaacgcctagttcggacggtactcgtaggtagaacgggtcctattaccgactactaccgccgaaagaccgtaacaacggggaaccctaaaggttaccctaccgtagttacctccgttaaggaacctaaagttcgaaacgttacgccgttaagaaaggcgtacgttaggaaaccggtccgttaacggttccgtttaacgtcgtttacgtcggttacgaacggttaacggtaagggtttaactaacgg

SEQ ID NO: 428559 - DNA, 395 bp, Homo sapiens
  misc_feature: GZ8MTXP02IO7IX.19.53.E09.1.454.CMB.2.raw
  modified_base (393)..(395): a, c, t, g, unknown or other
tcagtactctcgtgcacgaccggtgctcgatttagagagagtgtgttgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccacaaggcccatcggtctcccctggccgccctgctccaggagcacctccgagagcacagcgccctgggcctgcctggtcaaggctactcccagagagtactgagcggggctggcaaggcgcatagnnn

SEQ ID NO: 428560 - DNA, 507 bp, Homo sapiens
  misc_feature: GZ8MTXP02IS6E3.19.53.E09.1.454.CMB.2.raw
  modified_base (395)..(395): a, c, t, g, unknown or other
  modified_base (445)..(445): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcacgtgggtcccggcaagcctcccgaggggaggcctggagtgggtctcgaggtattagtggaatagtgctagtatagcctatgcggactcgtgtgaagggcgattcacntctcagagacaacgccaaagaacctccctagtatcctgacaaatgaaacngtactgagagctgacggacacggtccttagtacttacgtgtagacgaaggaggtatagctag

SEQ ID NO: 428561 - DNA, 524 bp, Homo sapiens
  misc_feature: GZ8MTXP02J010L.19.53.E09.1.454.CMB.2.raw
  modified_base (383)..(383): a, c, t, g, unknown or other
  modified_base (411)..(411): a, c, t, g, unknown or other
  modified_base (416)..(416): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttggtacagcctggcaggtccctgagactctctgtgcagcctctggattcacctttgatgattatgccatgcacgtggggtccgcaagcctaccgaggggaacgggccgtgggagtcggggtctcgaggttattaggtggaatgtgctagtatagctangcgactctgtgaagggcattcactatcncaganacaacgcaagacctcctagtactctagacaaatgaaacagtctagagagcgtaggacggacaccggtccttaggtaacttacgtggtcgagaagggtaacgtagtacg

SEQ ID NO: 428562 - DNA, 510 bp, Homo sapiens
  misc_feature: GZ8MTXP02I82G4.19.53.E09.1.454.CMB.2.raw
  modified_base (404)..(404): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtgggggagcttggtacagcctggcaggtccctgagactctcctgtgcagcctctggattcacctttgatgattatgccatgcacgtgggtccgcaagctccgaggggaaggcctgggagtgggtctgaggtattaggttggaatgtgctagtatagctatgcgactctgtgaagggccgattccacatcncagagacaacgccaagaacctcctagatctgacaaaatgaaacagttcaggagagcgtagaacggacacggccttaggtaattactgtgacgtaaggacggtatag

SEQ ID NO: 428563 - DNA, 574 bp, Homo sapiens
  misc_feature: GZ8MTXP02I122C.19.53.E09.1.454.CMB.2.raw
  modified_base (472)..(472): a, c, t, g, unknown or other
tcagtactctcgtgcacgaccggtgctcgatttagagagagtgtgttgggtctggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccattcaccatctcagagacaacgccaagaactccctgtatctgacaaaatgaaacagtctgagagctgaggacacggtccttgtattactgtgacaaggaggtatagcagctactgggtacgactacgtggggccaggggaaccctggtccaccgtctcctcacgccctccaaccgacggcccagtcccggtccttcccccgtggcccgccctcgcctccgagggacgccaccgtccgagacncacgacgtcccggcccgtgggcctcggcccgttagggtaccgaaacgggtacccttacccgttaacccgaaccggagtaacgtacgtcggacgggccgggcg

SEQ ID NO: 428564 - DNA, 515 bp, Homo sapiens
  misc_feature: GZ8MTXP02JSC1E.19.53.E09.1.454.CMB.2.raw
  modified_base (298)..(298): a, c, t, g, unknown or other
  modified_base (444)..(444): a, c, t, g, unknown or other
  modified_base (483)..(483): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaggtgtccagtgtgaagtgcagctggtggagtcgtgggggagcttgggtacagcctggcaggtccctgagactctcctgtgcagcctctggattcacctttgatgattatgccatgcacgtgggtccgnaagctccgagggaggcctggagtgggtctcgaggtattagtggatagtgctagtatagcctagtgcggtactcgtgtaggaagggccgattccacatcctacagacacaacgccaaagacctcctagtactctagacaaatgaacngtcagagcgctggacggacacggtccttagtacttacgnggtacgacgaaagggtagtaatacggactaag

SEQ ID NO: 428565 - DNA, 600 bp, Homo sapiens
  misc_feature: GZ8MTXP02JFFK7.19.53.E09.1.454.CMB.2.raw
tcagtactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccattcaccatctcagagacaacgccaagaactccctgtatctgacaaatgaaacagtctgagagctggaggacacggccttgtattactgtgacaaggagtatagcagctaacgtggtacgactacgtgggggccaggggaaccctggtcaccgtctcctcacgccctaccaccgaacgggccccagtccggtcccttcccccgtgggccccgcccgtcgcctcccgagggacgaccacccgtccggagacgccaacgacgcccggcccgtgggggcctcggcccgttagggtacccgaaaacgggtacccttaaccttcccccgaaacggaacggtacggttaaccgtgggaacgggccggggtaccgg

SEQ ID NO: 428566 - DNA, 502 bp, Homo sapiens
  misc_feature: GZ8MTXP02FYDIH.19.53.E09.1.454.CMB.2.raw
  modified_base (399)..(399): a, c, t, g, unknown or other
  modified_base (441)..(441): a, c, t, g, unknown or other
  modified_base (445)..(445): a, c, t, g, unknown or other
  modified_base (478)..(478): a, c, t, g, unknown or other
  modified_base (496)..(496): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggctaattttaaaaggtgtccagtgtgaagtgcagctggtggagtcgtgggggagcttggtacagcctggcaggtccctgagactctcctgtgcagcctctggattcactttgatgattatgccatgcacgtgggtccgcaagctccgaggggaggcctggagtgggtctcgaggtatagtggaatagtgctagtatagcctatgcggactctgtgaagggccattcaccatctcaganacaaacgccaaagacctccctgtaatctagcaaaatgaaacngtcngagagctggacggacacggtccttagtattacngtcgacgaagggagtaanacgcag

SEQ ID NO: 428567 - DNA, 563 bp, Homo sapiens
  misc_feature: GZ8MTXP02JR91I.19.53.E09.1.454.CMB.2.raw
tcagtactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccattcaccatctccagagacaacgccaaagaactccctgtatctgacaaatgaaacagtctgagagctgaggacacggcctttgtattactgtgcaaggaggtatagcagctacgtggtacgactacgtcggggaccaggggaccctggtccaccgtctcctcacgccctcccacgaacgggcccactccggtcccttcccccgtgggccctccctgacctccgaggacgccacctccgagacgcacgcgccggtcccgtgggctcgccgtcgggtacaaacgggtacctaccgttcccgaacggaacgacggtaccgtcggacggccggtcg

SEQ ID NO: 428568 - DNA, 512 bp, Homo sapiens
  misc_feature: GZ8MTXP02G83NW.19.53.E09.1.454.CMB.2.raw
  modified_base (505)..(505): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtgggggagcttggtacagcctggcaggtccctgagactctcctgtgcagcctctggattcacctttgatgattatgccatgcacgtggggtccgcaagctccgaggggaacggcctgggagtgggtctcgaggtattagtggaatagtgctagtatagccctatgcggactcgtgtgaagggccgattcaccatctaccagacgacaacgccaaagactccctagtactctgacaaatgaaacagtctagagagcgtaggacggacacggtcttagtattactgtagacgaaggaggtaanacgacag

SEQ ID NO: 428569 - DNA, 408 bp, Homo sapiens
  misc_feature: GZ8MTXP02I5X5K.19.53.E09.1.454.CMB.2.raw
  modified_base (293)..(293): a, c, t, g, unknown or other
  modified_base (403)..(408): a, c, t, g, unknown or other
tcagtactctcgtgcacgaccggtgctcgatttagagagagtgtgttgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttccccnggccgccctgctccaggagccacctccgagagcacagccggcccctgggccctgcctggtccaaggactactcccacgagagtactgagcgggctggcaaggcgcatagnnnnnn

SEQ ID NO: 428570 - DNA, 511 bp, Homo sapiens
  misc_feature: GZ8MTXP02ICI4J.19.53.E09.1.454.CMB.2.raw
  modified_base (301)..(301): a, c, t, g, unknown or other
  modified_base (371)..(371): a, c, t, g, unknown or other
  modified_base (436)..(436): a, c, t, g, unknown or other
  modified_base (438)..(438): a, c, t, g, unknown or other
  modified_base (446)..(446): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggaggcttggtacagcctggcagggtccctgagactctcctgtgcagcctctggatcacctttgatgattatgccatgcacgtgggccgnaagctcgaggggaaggcccggagtggctgaggtattagtggaatagtgctagtatagcctatgcgactcngtgaagggccattcaccatcctccaagagacaaacgcctaaagaacctcctagtatcagacaaananaacagtanagagagacgagagacgacgtacgtacgtacttactagtgacgaaggaggtagtacgacgacgacg

SEQ ID NO: 428571 - DNA, 588 bp, Homo sapiens
  misc_feature: GZ8MTXP02JP26Y.19.53.E09.1.454.CMB.2.raw
  modified_base (474)..(474): a, c, t, g, unknown or other
tcagtactctcgtgcacgaccggtgctcgatttagagagagtgtgttgggtctggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccattcaccatctccagagacaacgccaaagaacctccctgtatctgacaaaatgaaacagtctgagagctggaggacacggcctttgtattactgtgacaaggaggtatagcagctaacgtgggtacgactacgtgggggaccaagggggaacccctgggtaccacccgtctccctcacgccctccaccgaacgggcccacgtccggtccttcccccgtggccgcccgtcgcctccgacgggacnccaccgccgacgacgccacgacgccggcccgtcggggcctcggcccgtcggtaccgaaacgggtaccttaaccgttcccgaacggaacgtacggtaccgtcggacggcgggcgg

SEQ ID NO: 428572 - DNA, 403 bp, Homo sapiens
  misc_feature: GZ8MTXP02IT09F.19.53.E09.1.454.CMB.2.raw
  modified_base (396)..(403): a, c, t, g, unknown or other
tcagtactctcgtgcacgaccggtgctcgatttagagagagtgtgttgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtctcccctggcgccctgctccaggagcacctccgagagcacagcgccctgggcctgcctggtcaaggcctactcccacgagagtactgagcggggctggcaaggcgcatagnnnnnnnn

SEQ ID NO: 428573 - DNA, 601 bp, Homo sapiens
  misc_feature: GZ8MTXP02F46VY.19.53.E09.1.454.CMB.2.raw
  modified_base (303)..(303): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggaggcttgggtacagcctgggcaggtccctgagactctcctgtgcagcctctggattcacctttgatgattatgccatgcacgtgggtccggnaagctccgaggggaggcctgggagtgggtctcgaggtattagtggaatagtgctagtatagcctagtgcggtacttcgtggtaggaaaggggccctaatttccgaacccattcccgtacccaagggaaaccgaaccgaaaacccgcccaaaggtaaaccccttccccgtaggttaactcctacgacaaaattcggaaacctaggtcctaggaaggtacgcgtagggaacggaccgaacggggtcctttaaggttacttaacgtggtagacgtaaaggggtaggtataacggctaacgg

SEQ ID NO: 428574 - DNA, 581 bp, Homo sapiens
  misc_feature: GZ8MTXP02G4TCI.19.53.E09.1.454.CMB.2.raw
  modified_base (304)..(304): a, c, t, g, unknown or other
  modified_base (363)..(363): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagcttggtacagcctggcaggtccctgagactctcctgtgcagcctctggattccacctttgatgattatgccatgcacgtcgggtccgnaagctaccgaggggacggctgggagtgggtctcgaggtattaggtgaatgtgctagtanagctatcgcgtactgtgtaggaacgggccattccactatccacaagacgaacaaacgccaaaagaccctcctagtactcctagaacctaaaagtacgaaaactcgttactaggaacgagtaccgtagggaaaccggaaccgtaaccggggtccctttaggttaactttaaccgtggttagaacggtaaaaggggtaggtaacgtacggaccgtaacgg

SEQ ID NO: 428575 - DNA, 597 bp, Homo sapiens
  misc_feature: GZ8MTXP02JS4LS.19.53.E09.1.454.CMB.2.raw
  modified_base (268)..(268): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggcttattttaaaggtgtccagtgtgaagtgcagctggtggagtcgtgggggagcttggtacagcctggcaggtccctgagactctcctgtgcagcctntggattccacctttgatgatttatgcctatgctacgtcggggtcccgacaacgcctaccggaaggggaacgggccgtggggaggtcggggtctcgtagggttattaggtaggaattggtgacttagtatacgtcctagtggaccgtactcgtggtaggaacgggcctattccgacctatccacagacgaaccgaacgaccaacgtaacctcccgtagtactcgtagaactaaatacgaaactagtctaggagacgacgtagggaacggtaccgtaaccggtcctttagtaacgtttacgtggttacgacggaagggtacggtagtacgg

SEQ ID NO: 428576 - DNA, 556 bp, Homo sapiens
  misc_feature: GZ8MTXP02IF644.19.53.E09.1.454.CMB.2.raw
  modified_base (269)..(269): a, c, t, g, unknown or other
  modified_base (365)..(365): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagcttggtacagcctggcaggtccctgagactctcctgtgcagcctntgacttcactttgatgattatgccatgcacgtgggtccgcaagctccgagggaacgggcctggagtcgggtctcgaggttattaggtggaatggtnctagtatacgtctagcgacggactcgtggtaggacgggccgtattaccgacctatcctaccgagaacgaaccgaaacgaccgaaacgtaacctccctagtactctagaaccaaatcgaactagtctagagacgctaggacggacgtaccggtcttaggtaattacgagttcgacgtaaggtacggtatacg

SEQ ID NO: 428577 - DNA, 543 bp, Homo sapiens
  misc_feature: GZ8MTXP02HUXAG.19.53.E09.1.454.CMB.2.raw
  modified_base (270)..(270): a, c, t, g, unknown or other
  modified_base (290)..(290): a, c, t, g, unknown or other
  modified_base (521)..(521): a, c, t, g, unknown or other
  modified_base (540)..(540): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagcctggcaggtccctgagactctctgtgcagcctcnggattcactttgatgattangccatgcacgtgggtccgcaagctccgaggggaggccgtggagtcgggtctgtaggttattaggttaggaatcggtgactagtatagcctatcgcgtactcgtgaggaacgggcctattccactatcctaccaggacaaccaaacgaccaaaagacccttcccgtagtaactcctagaacaaatcgaaactgtcagagagctaggacgacacggtctttagtaacttacgngtagacgtaaggacgttanacg

SEQ ID NO: 428578 - DNA, 405 bp, Homo sapiens
  misc_feature: GZ8MTXP02G7RK5.19.53.E09.1.454.CMB.2.raw
  modified_base (296)..(296): a, c, t, g, unknown or other
  modified_base (301)..(301): a, c, t, g, unknown or other
  modified_base (402)..(405): a, c, t, g, unknown or other
tcagtactctcgtgcacgaccggtgctcgatttagagagagtgtgttgggtctcaggtattagttggaatagtgctagtatagcctatgcggactctgtgaagggccgattcaccatctccagagacaacgccaagaactccctgtatctgcaaaatgaacagtctgagagctgaggacacggccttgtattactgtgcaagggaggtatagcagctactggtacgactactggggccagggaaccctggtccaccgtctcctcagcctccacaaggcccatccggtcttcccccnggccnccctgctccaggacgcacctccgagacgcacagccggccctgggccctgcctggcaaggctactcccagagagtactgagcgggctggcaaggcgcatagnnnn

SEQ ID NO: 428579 - DNA, 523 bp, Homo sapiens
  misc_feature: GZ8MTXP02J2TZX.19.53.E09.1.454.CMB.2.raw
  modified_base (452)..(452): a, c, t, g, unknown or other
  modified_base (496)..(496): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctatttaaaaggtgtccagtgtgaagtgcagctggtggagtcgtgggggaggcttggtacagcctggcaggtccctgagactctcctgtgcagcctctggattcacctttgatgattatgccatgcacgtgggtccggcaagctccgagggaagggcctggagtgggtctcagggtattaggttggaatagtgctagtatagcctatgcggactctggtgaaggggcccattcaccatctccagagacaacgccaaagacctccctgactctgaccaaatgaacagttacngagtacgacgtggaacggacacgggtccttaggtaactttacgngtacgacaagggaggttacaggcaagg

SEQ ID NO: 428580 - DNA, 522 bp, Homo sapiens
  misc_feature: GZ8MTXP02FM15P.19.53.E09.1.454.CMB.2.raw
  modified_base (357)..(357): a, c, t, g, unknown or other
  modified_base (450)..(450): a, c, t, g, unknown or other
  modified_base (495)..(495): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtctgggggagcttggtacagcctggcaggtccctgagactctcctgtgcagcctctggattcacctttgatgattatgccatgcacgtgggtccgcaagctccgaggggaggcctgggagtgggtctcgaggtataggttggaatagtgctagtanagcctatgcggactcgtgtggaagggccgattccaccatcctaccagacgacaaacgccaaagacctccctagtactctagacaaatgaaacngtctagagacgctaggacggacgacggtcctttagactttaacgngtcgacgaagggaggtaacacgacacg

SEQ ID NO: 428581 - DNA, 525 bp, Homo sapiens
  misc_feature: GZ8MTXP02IUT3P.19.53.E09.1.454.CMB.2.raw
  modified_base (308)..(308): a, c, t, g, unknown or other
  modified_base (455)..(455): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaggtgtccagtgtgaagtgcagctggtggagtcgtgggggagcttggtacagcctggcaggtccctgagactctcctgtgcagcctctggattcacctttgatgattatgccatgcacgtgggtccgnaagctcgaggggaaggcctggagtgggtctcgaggtattagttggaatggtgctagtatagctatgcgactcgtgtaggaagggccgattccacatctaccagagacaacgccaaagaccctcctagtatcctagacaaatgaaacngtctagagagctaggacggaccacggtcctttaggtaacttacgtggtacgacgaaggtaggtaatacgg

SEQ ID NO: 428582 - DNA, 528 bp, Homo sapiens
  misc_feature: GZ8MTXP02J1ILV.19.53.E09.1.454.CMB.2.raw
  modified_base (505)..(505): a, c, t, g, unknown or other
  modified_base (522)..(522): a, c, t, g, unknown or other
tcagtactctcgtgcacgaccggtgctcgatttagagagagtgtgttggctctgggagagtagccccagccctgagattcccaggtgtttccattcagtgatcagcactgaacacagaggactcaccatggagttgagactgagctggattttcctttggctattttaaaaggtgtccagtgtgaagtgcagctggtggagtctgggggagcttggtacagcctggcaggtccctgagactctcctgtgcagcctctggattcacctttgatgattatgccatgcacgtgggccgcaagctccgagggaggcctggagtggtctcgaggtattagttggaatgtgctagtatagcctatgcggactcgtggtgaacggggccgtattcccacctatcctacccgaagacgaacaaccggaccaaagaacctccctagtactctagaccaaagtcgaaactagtctagacgtacgctaggaggaccacgggtccttagtattacgngtcgacgaaggaggtanacgcag

SEQ ID NO: 428583 - DNA, 573 bp, Homo sapiens
  misc_feature: GZ8MTXP02G8F2B.19.53.E09.1.454.CMB.2.raw
  modified_base (302)..(302): a, c, t, g, unknown or other
  modified_base (330)..(330): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaggtgtccagtgtgaagtgcagctggtggagtcgtgggggaggcttggtacagcctggcaggtccctgagactctcctgtgcagcctctggattcacctttgatgattatgccatgcacgtgggtccgnaagctccgaggggaggctggagtggtcncgaggtattagtggaatagtgctagtatagcctagtggcggtactcgtggtaggaacggggcccgtattcccaacctactccctacccaaggaacgaaccaaaccggccaaaacggaacccttccctagttactctacgaacctaaaagtgaaactaggtctaggagacgcgtaggacggaccgacgggtccttaggttactttacgtggtacgacgtaaaggggtagtaactagcgtaacgg

SEQ ID NO: 428584 - DNA, 537 bp, Homo sapiens
  misc_feature: GZ8MTXP02GKAVD.19.53.E09.1.454.CMB.2.raw
  modified_base (372)..(372): a, c, t, g, unknown or other
  modified_base (459)..(459): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagcgtggatttcctttaggctatttaaaggtgtcagtgtgaagtgcagctggtggagtcgtgggggagcttggtacagcctggcaggtccctgagactctcctgtgcagcctctggattcacctttgatgattatgcctatgctactggggtccggcaagcctccgaggggaacgggcctgggagtggggtcctgaggttattagttagggaatggtcgnttaggtatagcctatgcggactctgtgaaggggcctatccaccatcaccagacgacaaacgccaagaacctccctatactctacganaactagacacgtacgtacgagagcgagacgacgacgtacgttacgtaagtacgtacgtacgagtaggtacgtagtacg

SEQ ID NO: 428585 - DNA, 531 bp, Homo sapiens
  misc_feature: GZ8MTXP02JLVJ2.19.53.E09.1.454.CMB.2.raw
  modified_base (310)..(310): a, c, t, g, unknown or other
  modified_base (388)..(388): a, c, t, g, unknown or other
  modified_base (460)..(460): a, c, t, g, unknown or other
  modified_base (463)..(463): a, c, t, g, unknown or other
  modified_base (466)..(466): a, c, t, g, unknown or other
  modified_base (470)..(470): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctaattttaaaaggtgtccagtgtgaagtgcagctggtggagtcgtgggggagcttggtacagcctggcaggtccctgagactctcctgtgcagcctctggattcacctttgatgattatgccatgcacgtggtccggnaagctccgaaggggaaggccgtgggagtggggtccagtaggttattaggtaggaatggtgactaggtatagccttaancggacgcttcgtggaggaacgggccctaatccaacatcacagacgacaacgactaaagactcctagatctanaanaanaganagacgagagagacgagacgacgacgtacgtagtaagtacgtagtacgagaaggagtagtag

SEQ ID NO: 428586 - DNA, 563 bp, Homo sapiens
  misc_feature: GZ8MTXP02H2ISV.19.53.E09.1.454.CMB.2.raw
  modified_base (242)..(242): a, c, t, g, unknown or other
  modified_base (291)..(291): a, c, t, g, unknown or other
  modified_base (332)..(332): a, c, t, g, unknown or other
  modified_base (414)..(414): a, c, t, g, unknown or other
  modified_base (456)..(456): a, c, t, g, unknown or other
  modified_base (495)..(495): a, c, t, g, unknown or other
  modified_base (561)..(561): a, c, t, g, unknown or other
tcagtactctcgtgcacgaccggtgctcgatttagagagagtgtgttgggtttgggaggcttggtacagcctggcaggtccctgagactctcctgtgcagcctctggattcacctttgatgattatgccatgcacgtgggtccggcaagctccgagggaagggcctggagtgggtctcaggttattagttggaatagtgctagtatagcctatgcggactctgtgaagggccattcacatcncagagacaacgccaaagaacctccctgtatctgacaaatgaaacagtcngaagagctaggaaggaccaacggtcctttaggtaatttacnggtgacgaaagggagtactagcagcttacgtggtaacactacgtggggacccaaggggaaccctgggacacccgtctccctnacgcctcccaaccgaacgggcccagttccgtcccttccccgnggccgcctcgctccgagacgccacgtccgagacgcaacncggccgccctgggcctgcctcggacaaacggcctacgtacccaagacgaagtacaggacgcggcgngg

SEQ ID NO: 428587 - DNA, 590 bp, Homo sapiens
  misc_feature: GZ8MTXP02FWYUH.19.53.E09.1.454.CMB.2.raw
tcagtactctcgtgcacgaccggtgctcgatttagagagagtgtgttgggtttggggagctctgggagaggagtcccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggaggcttggtacagcctggcaggtccctgagactctcctgtgcagcctctggattcacctttgatgattatgccatgcacgtgggtccgcaagctccgaggggacggctgggagtgggtctgaggtattagttaggaatgtgcttagtatagcctagtgcggactcgtgtggaaacggggtccgtattccaccatcctaccagacgaaccaacgtaccaaagaaccctcccgtagtactctagaactaaaaacttacgagttcaggaagacgtaccgtaggaaacgggtaaccgaacccgggtccgtttaggttaaactttaaccgtgggtacgaacgtaaaaggggtaacggtttaacacggtacg

SEQ ID NO: 428588 - DNA, 580 bp, Homo sapiens
  misc_feature: GZ8MTXP02F8S2X.19.53.E09.1.454.CMB.2.raw
  modified_base (315)..(315): a, c, t, g, unknown or other
tcagtactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaaggccattcaccatctccagagacaacgccaagaactccctgtatctgcaaatgaacagtctgagagctgaggacacggcttgtattacngtgcaaggagtatagcagctacgtggtacgactacgtggggacccaggggtaaccctgggtccaccgtctccctcacgccctccgacccacgggcccacgtccggtcccttcccccgtggcccgccccgtgccctccgacgggacgacccacccgtccggagacgccacgacggccggcccgtgggcctcggccgtcgggtaccaaacgggtcccttacccgttcccgaacggtaacggacgtaacctggaacggccgggggtcg

SEQ ID NO: 428589 - DNA, 521 bp, Homo sapiens
  misc_feature: GZ8MTXP02G18SV.19.53.E09.1.454.CMB.2.raw
tcagtactctcgtgcacgaccggtgctcgatttagagagagtgtgttggctctgggagaggagccccagccctgagattcccaggtgtttccattcagtgatcagcacttaacacagaggactcaccatggagttgagactgagctggattttcctttggctattttaaaaggtgtccagtgtgaagtgcagctggtggagtctgggggaggcttggtacagcctggcaggtccctgagactctcctgtgcagcctctggattcacctttgatgattatgccatgcacgtgggtccgcaagctccgaggggaaggcctgggagtgggtctcgaggtattagttggaatgtgctagtatagcctatgcggactcgtgtgaagggccgattcacatctcagagacaacgaccaagaactccctagtactctagacaaatgaaacagtctagagagactaggaggaccgacggtcctttaggtaattacgtgtaacggacaaagggtaggtatagcaggtaccg

SEQ ID NO: 428590 - DNA, 564 bp, Homo sapiens
  misc_feature: GZ8MTXP02I99G7.19.53.E09.1.454.CMB.2.raw
  modified_base (367)..(367): a, c, t, g, unknown or other
  modified_base (375)..(375): a, c, t, g, unknown or other
  modified_base (496)..(496): a, c, t, g, unknown or other
  modified_base (545)..(545): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctattttaaaggtgtccagtgtgaagtgcagctggtggagtcgtgggggagcttggtacagcctggcaggtccctgagactctcctgtgcagcctcgtggattcacctttgatgattatgccatgcacgtgggtccgcaacgctccgaggggacggcctggagtcgggtctcgaggtattaggtaggaatcggtntctagtanacgtctagtcgcgactcgtggtagaacggggtcctaattccaacctacttccgaccaaggaacaaccaaccgacccaaagaacccttcccgtagtaacttccgagaacaaaagtgaaaccngtacctaggagagccgtaggaacgacctacggtctttaggaacttacgngtacgagaaggagtacacg

SEQ ID NO: 428591 - DNA, 524 bp, Homo sapiens
  misc_feature: GZ8MTXP02JTM3X.19.53.E09.1.454.CMB.2.raw
  modified_base (256)..(256): a, c, t, g, unknown or other
  modified_base (297)..(297): a, c, t, g, unknown or other
  modified_base (347)..(347): a, c, t, g, unknown or other
  modified_base (391)..(391): a, c, t, g, unknown or other
  modified_base (399)..(399): a, c, t, g, unknown or other
  modified_base (470)..(470): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaggtgtccagtgtgaagtgcagctggtggagtctgggggagcttggtacagcctggcaggtccctgagactctcctgtgcagcctntggattcacctttgatgattatgccatgcacgtgggtccgnaagctccgaggggacggcctggagtggtctcgaggtattagtggaatgtnctagtatagcctatgcggactcgtgtgaacgggccgattcaccntctcaganacaaacgccaaagaacctccctagtactctgactaaatcgaaacagtctgaagacgcgtaggacggtaacncggtcctttaggtaactttacgtggtacgacgaaagggtaggtatacggctaag

SEQ ID NO: 428592 - DNA, 572 bp, Homo sapiens
  misc_feature: GZ8MTXP02HLDHG.19.53.E09.1.454.CMB.2.raw
  modified_base (246)..(246): a, c, t, g, unknown or other
tcagtactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaagggccattcaccatctccaganacaacgccaagaactccctgtatctgcaaatgaacagtctagagagctgaggacacggcctttgtattactgtgcaaggaggtatagcagctactggtacgcctacgtgggggcccaaggggaaccccttgggtaccacccgtctccctcacgccctcccacccgaacgggcccagtccgtccttcccccgtggccgcccctgccttccgacgggacgccaccgtccgacgacgccacgacgcggtcccttggcctcgcccgtacggtaccgaaacggtaccttaccgttcccaacggacgacgtacgtaggcggcggtcgacggg

SEQ ID NO: 428593 - DNA, 597 bp, Homo sapiens
  misc_feature: GZ8MTXP02GNNSY.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagtcttggtacagcctggcaggtccctgagctctctgtgcagcctctggattcacctttgatgtatttatcgcctatgctacgtggggtccgacaacgcctccgaaggggaacgggcctaggggagtcggggtctcgtaggttatttaggttaggaatggtgtactaagtatacgccttagtcggacgtacttcgtaggtacggaaacggggtcccgtattccgaacctagttcctaccaaggacgaaaccaaaccggacccaaacgtaaccctccctagtactctagaacaaaatcgaaactagtctaggagagcgtaggacggaccgacggtccttagtaacttacgtggtcgaacgaaggtagtatacgg

SEQ ID NO: 428594 - DNA, 627 bp, Homo sapiens
  misc_feature: GZ8MTXP02GEUXL.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttcctttggcttaattttaaaaggtgtccagtgtgaagtgcagctggtggagtcgtgggggagcttggtacagcctggcacggtccctgacgactctcctgtgcggcctctggattcacttgatgtattatgccagtcgctacggtcggggtcccgacaacggccgtacccggaaggggaacggggccgtggggagggttcggggtacctcggtaagggtttagtttagggttagggtaaagttaggtgtacgttaggtaatacggtcccttagtcggacggtactcgtggtacggaacggggctacgttccaacctatccctacgagaacgaccaaccgaccaaacgacctccctagacttcagaaccaaatacgaactagtctaggagagtacgtaggacggaccgtaccggtctttaggtaactttacgaggttaagacgtaaagggggactaggtaacgcgacgttaccg

SEQ ID NO: 428595 - DNA, 601 bp, Homo sapiens
  misc_feature: GZ8MTXP02GHRWD.19.53.E09.1.454.CMB.2.raw
  modified_base (330)..(330): a, c, t, g, unknown or other
  modified_base (352)..(352): a, c, t, g, unknown or other
tcagtactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccgagggaagggcctggagtgggtctcaggtattagttggaatagtgctagtatagcctatgcggactctgtgaagggccattcaccatctccagagacaacgccaagaactccctgtatctgacaaaatgaacagtctgagagctgaggacacggcctttgtattactgtgcaaaggnggtatagcagctacgtggtacncgtacgtgggggaccagggaaccctggtaccaccgtctcctcacgccctaccaccgaacggccccagtcccggtcccttcccccgtcggcccgtccctcgcccgtccgagggacgcccgacccgtccgacgacgaccgacgacggcccgggccccgtggggccgtcggccgttcgggtaccaaacgggtacccttacccgttacccgaacggtacgtacgttaccgtaggacggccggggtcgtcgggg

SEQ ID NO: 428596 - DNA, 606 bp, Homo sapiens
  misc_feature: GZ8MTXP02HHHTP.19.53.E09.1.454.CMB.2.raw
  modified_base (300)..(300): a, c, t, g, unknown or other
  modified_base (330)..(330): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttattttaaaaggtgtccagtgtgaagtgcagctggtggagtcgtgggggagcttggtacagcctggcaggtccctgagactctcctgtgcagcctctggattcacctttgatgattatgccatgcacgtgggtccgnaagctccgaggggaggcctggagtgggtcncgaggtattagtggaatagtgctagtatagcctagtcggcggtactcgtgtaggaacggggccgtatttccacctatcctacccgaagacgaaccaaaccggaccaaaaggaacccttccctaggttactaccctaggaacctaaaagttacggaaacctaggttaccgtacgggaaagtaacggccgttagggaacgggtaaccgaccgggttcctttaggttaactttacgtaaggttacgaacgtaaaggggtaggtaactaggacctaacgg

SEQ ID NO: 428597 - DNA, 575 bp, Homo sapiens
  misc_feature: GZ8MTXP02GC7CW.19.53.E09.1.454.CMB.2.raw
  modified_base (289)..(289): a, c, t, g, unknown or other
  modified_base (310)..(310): a, c, t, g, unknown or other
  modified_base (500)..(500): a, c, t, g, unknown or other
  modified_base (548)..(548): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggctaattttaaaaggtgtccagtgtgaagtgcagctggtggagtcgtgggggagcttggtacagcctggcaggtccctgagactctcctgtcgcagcctcgtggacttcctacctttgattgatttangccatgcacgtgggtcccganaagctccgaggggaggccgtggagtgggtctcgtaggttattaggttaggaattaggtgtcgttaagtatacgtacctagtcggacggacttcgtggtaggaacgggtccgtattcccgacctatacctaccaagacaaccgaaccgaccaaacgacccttccctagtactctacgaacaaagtgaaacngtacgtagacgacgcgtaggacggacctacggtccttagtacttacgngtcgacgtagggtagtatacgacgtag

SEQ ID NO: 428598 - DNA, 562 bp, Homo sapiens
  misc_feature: GZ8MTXP02HL8NH.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggaggcttggtacagcctggcaggtccctgagactctcctgtgcagcctctggattcacctttgatgattatgccatgcacgtcgggtccgcagcctccgaggggaacgggcctgggaggtcggggtctcgaggttattaggtaggaatggtgtactagtatagtcctagtcgcggtactcgtgtaggaacgggtccgtattccacctatcctacagacgacaacgacccaaagtacctccctagtactcgtacgaacaaatcgaaactagtactaggaagagcgtaggacggaccgacggtccttagtaacttacgtggtacgacgaaggtacggtatacgg

SEQ ID NO: 428599 - DNA, 539 bp, Homo sapiens
  misc_feature: GZ8MTXP02JC0W2.19.53.E09.1.454.CMB.2.raw
  modified_base (525)..(525): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaggtgtccagtgtgaagtgcagctggtggagtcgtgggggaggcttggtacagcctggcaggtccctgagactctcctgtgcagcctctggattcacctttgatgattatgccatgcactgggtccgcaagctccgaggggaaggcctggagtgggtctcgaggtattaggttggaatagtgctagtatagcctatgcggactcgtggtaggaacggggccgattcccacactctacccagacgacaaaccggccaaaagaaccttcccctagtatctagaccaaaatgaaactgtcagaagtacgcgtagacggaccacgggtccttaggtacttacgtgtcggactaaagggnggttaataggcaag

SEQ ID NO: 428600 - DNA, 604 bp, Homo sapiens
  misc_feature: GZ8MTXP02HLIQE.19.53.E09.1.454.CMB.2.raw
  modified_base (508)..(508): a, c, t, g, unknown or other
  modified_base (592)..(592): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttggtacagcctgggcaggtccctgagactctcctgtgcagcctctggattcacctttgatgattatgccatgcacgtgggtccggcaagctaccgaggggacggccgtggaggtgggtctccgaggtattaggtggaataggtgcttagtatagcctagtcgcggtactcgtggtaggaacgggcccgtattcccgaacctattccctacccgaaaggaacgaaccgaaaccgaccctaaaaggtaaccccttccccgtagttaactccgtagaacctaaaagttcgaaaacngggttacagggaagacgtaccgtgggaaacgggaccgacgggttcctttaggtaacttacgtggtagacggtaaagggagttanacgacgtaacgg

SEQ ID NO: 428601 - DNA, 608 bp, Homo sapiens
  misc_feature: GZ8MTXP02HJWYC.19.53.E09.1.454.CMB.2.raw
  modified_base (284)..(284): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttattttaaaaggtgtccagtgtgaagtgcagctggtggagtcgtgggggaggcttggtacagcctggcaggtccctgagactctcctgtgcagcctctggattcacctttgatgattangccatgcacgtcggggtccgcaagcctaccggaggggaacgggcctgggaggtggggtctccgaggttattaggttggaattggtgtctagtatagtacctagtcggcggtactcgtggtaggaacgggccgtaattccgacctagtccctaccgaaggacgaaccaaaccggaccaaaaggacccttacccgtaggttactaccgtaggaaacctaaaagtacgaaaacctaggttacctaggaacgagtaccgttagggaacggaaccgaccggttccttaggttaacttacgtgtagacgtaagggagtacaggtcaacgg

SEQ ID NO: 428602 - DNA, 546 bp, Homo sapiens
  misc_feature: GZ8MTXP02G0LMX.19.53.E09.1.454.CMB.2.raw
  modified_base (198)..(198): a, c, t, g, unknown or other
  modified_base (204)..(204): a, c, t, g, unknown or other
  modified_base (212)..(212): a, c, t, g, unknown or other
  modified_base (222)..(222): a, c, t, g, unknown or other
  modified_base (249)..(249): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagcgtgtagttccttaggctattaaagtgtcagtgtgaagtgcagngtgtgngtgtgggnggtgtgtagngcgtgcgcgtcgtgagctctctgtgcncgctcgtgtactctacttgtatgtatatgtctacgtcgcgtacgtcggtccgacgacgtcgtacggagggacggcgtaggtggtcggtcgtagtagtagttagttagtaagtgtagtagtagtagtagtacgtacgtcgtacgtacgtacgtaggtacggtaacggtacgtacgtaccgtacctactaccgtaccgaacgaaacgaaaccgaaaccgaaccgtaaaccgtaaccgtaccgtacgttacgttacgtaacgtaaacgtaaaacgtaaacgtaaacgtaacgttacgtaa

SEQ ID NO: 428603 - DNA, 547 bp, Homo sapiens
  misc_feature: GZ8MTXP02JJFZL.19.53.E09.1.454.CMB.2.raw
  modified_base (291)..(291): a, c, t, g, unknown or other
  modified_base (311)..(311): a, c, t, g, unknown or other
  modified_base (463)..(463): a, c, t, g, unknown or other
  modified_base (527)..(527): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttggtacagcctggcaggtccctgagactctcctgtgcagcctctggattcacctttgatgatttangccatgcacgtgggtccggnaagctcgaggggacggcctggagtcgggctcgaggttattaggtggaatgtgctagtatagcctatcggcgacttcgtggtaggaacggggcctattccgaacctatcctaccaagacgaccaaacgccaaagaccctcctagtactcgtanaacaaatcgaaactagtctaggagaggctaggaacggacctacggtccttagtaacttacgtgngacgaaggtacggtatacgg

SEQ ID NO: 428604 - DNA, 631 bp, Homo sapiens
  misc_feature: GZ8MTXP02IJBWA.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggaggcttggtacagcctggcacggtccctgagactctcctgtgcagcctctggtattccacctttgatgattatgccatgccacgtgggtccgacagcctacgaggggacggcctgggagtcgggtctcgtaggttattaggttaggaattggtgacttaagtatacgcttagtcggacgtactcgttggtagggaacgggtcccgtatttcccgaacctattccctaccgaagaacgaaacccaaaccggacccaaaacgtacccttcccgtagtaactcgtacgaactaaaagtcgaaaactgttctaggaacggtacgacggttaaggaaccggacccgtaaccggggttcctttaaggtaacgtttaccgtggtacggaacgtaaaggggtacgttaagtaacgg

SEQ ID NO: 428605 - DNA, 632 bp, Homo sapiens
  misc_feature: GZ8MTXP02JZF87.19.53.E09.1.454.CMB.2.raw
  modified_base (367)..(367): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttggtacagcctggcaggtccctgagactctcctgtgcagcctctggattcacctttgatgattatgccatgcacgtgggtccgcaagcctaccgaggggaacggcctggagtcgggtctcgaggttattaggtggaattggngtacgtagtatagcctagtggacggtactcgtaggtaggaacggggcccgtattccgaaccctagtcctacccgaagaacgaaccaaaccggacccaaacgtaaccctccccgtagtaacttccgtaggaacctaaaagtcgaaaccgtagttaccgtaggaaggacggtccgtaaggaacgggaacccgtaccgggttacccgtttaggttaacgtttaacccgtggttacggaaccgtaagggggtaacggttaagtaacggg

SEQ ID NO: 428606 - DNA, 557 bp, Homo sapiens
  misc_feature: GZ8MTXP02GLMGT.19.53.E09.1.454.CMB.2.raw
  modified_base (279)..(279): a, c, t, g, unknown or other
  modified_base (298)..(298): a, c, t, g, unknown or other
  modified_base (480)..(480): a, c, t, g, unknown or other
  modified_base (547)..(547): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctattttaaaaggtgtccagtgtgaagtgcagctggtggagtcgtgggggagcttggtacagcctggcaggtccctgagactctcctgtgcagcctctggattcactttgatgattangccatgcacgtgggtccgnaagctccgaggggacggtctagggagtgggtctcgtagggttatttaggtagggaaattggtgcgttagtaataggccttagtcggacggtactcgtgtacgacggggccagttccacattccaccgaagacgaacaaacggaccaaagtaacctcctagtactctagactaaatcgaaacngttacagacgagcgtaggacgacgacgggtcctttagtactttacgtgtagacggtaaaggagttanaggactaagg

SEQ ID NO: 428607 - DNA, 532 bp, Homo sapiens
  misc_feature: GZ8MTXP02GIVAU.19.53.E09.1.454.CMB.2.raw
  modified_base (300)..(300): a, c, t, g, unknown or other
  modified_base (334)..(334): a, c, t, g, unknown or other
  modified_base (463)..(463): a, c, t, g, unknown or other
  modified_base (506)..(506): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctaattttaaaaggtgtccagtgtgaagtgcagctggtggagtcgtgggggagcttggtacagcctggcaggtccctgagactctcctgtgcagcctctggattcacctttgatgattatgccatgcacgtgggtccgnaacgctaccgaggggacggcctgggagtgggtcncgaggttattagtggaatgtgctaagtatagcctagtggcgtactcgtggtaggaagggccgtattcaccatccaccagaacgacaaacgccaaagacctcctagtactctacgaacaaagtcgaaacngtacgtagagaagcgtaggacgacgacggtcttagtactacgngtagacgaaagggagtatacgctaag

SEQ ID NO: 428608 - DNA, 417 bp, Homo sapiens
  misc_feature: GZ8MTXP02F6KT5.19.53.E09.1.454.CMB.2.raw
  modified_base (413)..(417): a, c, t, g, unknown or other
tcagtactctcgtgcacgaccggtgctcgatttagagagagtgtgttgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactacgtggggccagggaaccctggtcaccgtctcctcagcctccaccaacgggcccatccggtccttccccctggccgcccctgcctccaggagccaccctccgagacgcacagccggccctgggccctgcctggtacaaggacctactcccacgagacgtactgagcgggctggcaaggcgcatagnnnnn

SEQ ID NO: 428609 - DNA, 565 bp, Homo sapiens
  misc_feature: GZ8MTXP02H47B0.19.53.E09.1.454.CMB.2.raw
  modified_base (188)..(188): a, c, t, g, unknown or other
  modified_base (364)..(364): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggngtccagtgtgaagtgcagctggtggagtcgtgggggagcttggtacagcctggcaggtccctgagactctctgtgcagcctctggattcactttgatgattatgccatgcacgtgggtccgcaagctccgaggggacggcctgggagtgggtctcgaggtattaggtggaatggtnctagtatagcctatcgacgtactcgtggtagaacggggccctaattcccaactactcctaccgaaggaacgaaccaaaccggacaaaacgtaaccctccctagtaactctagaacaaaatcgaacagttcagagagcgtaggacgggtaccacgggttccttagttaacttacgtggtacgacgaaggggtagttaacagg

SEQ ID NO: 428610 - DNA, 619 bp, Homo sapiens
  misc_feature: GZ8MTXP02ICKJV.19.53.E09.1.454.CMB.2.raw
  modified_base (259)..(259): a, c, t, g, unknown or other
  modified_base (264)..(264): a, c, t, g, unknown or other
  modified_base (286)..(286): a, c, t, g, unknown or other
  modified_base (305)..(305): a, c, t, g, unknown or other
  modified_base (336)..(336): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttaatttttaaaaggtgtccagtgtgaagtgcagctgggtggagtcgtgggggagcttggtacagcctggcaggtccctgagactctcctgtgcngcctntggattccactttgatgattangccatgcacgtgggtccgnaagctaccgagggacggcctgggagtggtcncgtaggttattagtggaatagtgctagtatacgcctagtggacgtactcgtgtacggaacgggccgtacgttccaccacttccacccgaagacgaaccgaaacccggacccaaacgaacccttaccccgtagttaactcgtacgaactaaagtacgaaacgtagttactacggtaacgaacggtccgtaggaacggtaacccgtaaaccggggttcctttaaggttactttaacgttggttacgaacggtaaagggtaacggttacgttaacggcctaaacgg

SEQ ID NO: 428611 - DNA, 606 bp, Homo sapiens
  misc_feature: GZ8MTXP02I1EQ4.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaggtgtccagtgtgaagtgcagctggtggagtcgtgggggagcttggtacagcctggcaggtccctgagactctcctgtgcagcctctggattcacctttgatgattatgccatgcacgtggggtccgcaagctaccgaggggaacggcctggagtggggtctccgtaggttatttaggttagggaaattaggtcgtcgttaaggttaatacggtaccccttagttcgggaccgggtactcgttgggttaggaaacgggggtcccgtaatttcccgaacccgtattcctacccgaagacgaaccaaaccgcccaaaagacccttcccgtagtactactgacaaatgaaacctaggtactaggacgagcgtaggacggaaactccgggtacctttaggttaatttagttgtagacgaaagggtagtataggctaagg

SEQ ID NO: 428612 - DNA, 534 bp, Homo sapiens
  misc_feature: GZ8MTXP02HF3T8.19.53.E09.1.454.CMB.2.raw
  modified_base (255)..(255): a, c, t, g, unknown or other
  modified_base (376)..(376): a, c, t, g, unknown or other
  modified_base (467)..(467): a, c, t, g, unknown or other
tcagtactctcgtgcacgaccggtgctcgatttagagagagtgtgttggctctgggagaggagccccagccctgagattcccaggtgcttccattcagtgatcagcactgaacacagaggactcaccatggagttgagactgagctggattttcctttggctatttaaaggtgtcagtgtgaagtgcagctggtggagtcgtgggggagcttggtacagcctggcaggtccctgagactctcctgtgcagccctntggattcacctttgatgattatgccatgcacgtgggtccgacaagcctaccgagggacgggcctgggaggtgggtccctacgagggttattaggttggaattgtgctaagtatagccttanggcggactgtgtagaacgggccgtattcaccatcctaccagagacaacgacaacgaacctccctagtatcctagacaaatcgaacagtacngagagactggaacggacgaccgtccgttagttactaacgtgtacggacgaaggtacgttacgaagcg

SEQ ID NO: 428613 - DNA, 590 bp, Homo sapiens
  misc_feature: GZ8MTXP02G7MUX.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttattttaaaggtgtccagtgtgaagtgcagctggtggagtcgtgggggagcttggtacagcctggcaggtccctgagactctcctgtgcagcctctggacttcacctttgattgattatcgccatcgcacgtcggggtcccgacaacgcctaccggaggggacgggcctaggggaggtggggtctacgtaggttattaggtaggaatagtgtcgttagtatacgtcctagtcggcggtactcgtggtaggacgggccgtattccacctactccgtaccgaaggaacgaaccgaaaccgaccaaagacccttacctagtactctagaactaaatagaaactgtacgtagaacgacgcgtaggacggaccgtacggtccttagtaacttacgtggtagaacggtaagggtagtaacgtacggactacgg

SEQ ID NO: 428614 - DNA, 557 bp, Homo sapiens
  misc_feature: GZ8MTXP02HWW1F.19.53.E09.1.454.CMB.2.raw
  modified_base (291)..(291): a, c, t, g, unknown or other
  modified_base (388)..(388): a, c, t, g, unknown or other
  modified_base (404)..(404): a, c, t, g, unknown or other
  modified_base (408)..(408): a, c, t, g, unknown or other
  modified_base (552)..(552): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggaggcttggtacagcctggcaggtccctgagactctcctgtgcagcctctggattcactttgatgattangccatgcagtgggtccgcaagctccgaggggaacggcctggagtcgggctcgaggtagttagttggaatgtgactagtatagcctatgcgactgtgngaaggctatcacatcncganagacaaacgcaaagactccctagtatactgaacaaatacgaaactagtctagaacggtagacctagggaaacggaccgaaccgggtttcccttaaggttaaacgttttacgtacggttagaaccgtaaagggtaaacggtttanaacgg

SEQ ID NO: 428615 - DNA, 617 bp, Homo sapiens
  misc_feature: GZ8MTXP02HZEXP.19.53.E09.1.454.CMB.2.raw
  modified_base (317)..(317): a, c, t, g, unknown or other
tcagtactctcgtgcacgaccggtgctcgatttagagagagtgtgttgggtttgggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccattcaccatctccagagacaacgccaaagaactccctgtatctgcaaatgaacagtctgagagctggagacacggcctttgtattacngtgacgaaaggagtatagcagctacgtggacgctacgtggggccagggaacccctgtaccacccgtctcctcacgccctcccaccgaacggcccctacgtccggtccttcccccgtggcccgtccccgtacggcctcccgagggaccgacccgacccgccgaacggaccgccaaccggacggtcccggcccgttcggggacctttccgggccgttcgggggtaacctaaacggggtacccttaacccgttaccccgaaacgacggtaacgttaccgtcggaacggtccgggacgtcgggg

SEQ ID NO: 428616 - DNA, 653 bp, Homo sapiens
  misc_feature: GZ8MTXP02JWGD8.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggaggcttggtacagcctggcaggtccctgagactctcctgtgcagcctctggattcacctttgatgattatgccatgcacgtggggtcccgcaagcctaccgaggggaacggccgtggaggtgggtctacggtaggtattaggtaggataggtgctagtatacgcctagtcggacgtactcgtggtacggaaacggggtccctaagtttcccaacgtcttcccgtaccgaaggaaccgaaaccgaaacccggaccaaaacggtaaccccttcccgttaggtactaccgtaaggaacctaaaagttacgaaacgtacggtttacgaggaacgtacggtacgtaaggggaaccggggtaaaccaccggggtttcccttaaggtttaacgttaccgtgggttacgaaacggtaaagggggtaagtttacgaaacggcgtaaaccgg

SEQ ID NO: 428617 - DNA, 577 bp, Homo sapiens
  misc_feature: GZ8MTXP02J0CXJ.19.53.E09.1.454.CMB.2.raw
  modified_base (266)..(266): a, c, t, g, unknown or other
  modified_base (430)..(430): a, c, t, g, unknown or other
  modified_base (510)..(510): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggaggcttggtacagcctggcaggtccctgagactctcctgtgcngcctcgtggattcacctttgatgattatgccatgcacgtgggtccgcaagctcgaggggaacggctgggagtcgggtctgaggttattaggtaggaatgtgactagtatagcctagtcggacgtactcgtggtaggaacggggccctattccgacctagttccnccgagacgaaccaaacgaccaaagacccttcccgtagtaactccgtagaacctaaagtcgaaaccgtagtcgtaggaagngaccgtaggacgggaccaccgggtcctttaggtaacttacgtggtacgagaagggtacgtaagtacg

SEQ ID NO: 428618 - DNA, 550 bp, Homo sapiens
  misc_feature: GZ8MTXP02I781U.19.53.E09.1.454.CMB.2.raw
  modified_base (278)..(278): a, c, t, g, unknown or other
  modified_base (297)..(297): a, c, t, g, unknown or other
  modified_base (508)..(508): a, c, t, g, unknown or other
  modified_base (525)..(525): a, c, t, g, unknown or other
  modified_base (542)..(542): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtgggggagcttggtacagcctggcaggtccctgagactctcctgtgcagcctctggattcactttgatgattangccatgcacgtgggtccgnaagctccgagggaggcctggagtggtctcgaggtatagtggaatagtgctagtatagcctagtggacggtactcgtggtaggaacggggtccgtaattcccgacctacttcctacccgaaggaacgaaccaaaccggaccccaaaaggaacccttcccgtagtaactctacgaactaaatcggaaacagtctaggagagctaggacgaacncggtcttagtacttagngtagacgtaaggagtanacgacgag

SEQ ID NO: 428619 - DNA, 639 bp, Homo sapiens
  misc_feature: GZ8MTXP02GEKWL.19.53.E09.1.454.CMB.2.raw
  modified_base (525)..(525): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagcctggcaggtccctgagactctcctgtgcagcctctggattcactttgatgattatgccatgcctacgtcgggtccgacaacgccgtaccggaaggggacgggcctaggggaggtcggggtctccgaggttattaggttaggaattaggtgtcgttaagtagtagtaccctagtcggccggtactcgtggtacggaacggggcctattacccgacctactcgtacccgaagaacgaaccgaaaccgacccaaacgtaacccttccccgtagttaacttcacgactaaaagtcgaaaacgngttacgaggaacgagtaccgtaggaacggaaacccgtacgggttaccctttaggttaactttaccggtaagttacggaacggaaacggggttaggttaataccgggactaacgg

SEQ ID NO: 428620 - DNA, 563 bp, Homo sapiens
  misc_feature: GZ8MTXP02GZ4PC.19.53.E09.1.454.CMB.2.raw
  modified_base (331)..(331): a, c, t, g, unknown or other
  modified_base (473)..(473): a, c, t, g, unknown or other
  modified_base (552)..(552): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggaggcttggtacagcctggcaggtccctgagactctcctgtgcagcctctggattcacctttgatgattatgccatgcacgtggggtccgcaagctccgagggagggcctggagtgggtcncgtaggtattagtggaatagtgctagtatacgctagtgcgactcgtgtaggaaggccgtattccaacatcctaccaagacgaaccaaaccggaccaaagtaacccttcccgtagtactacgtacgaactaaatggaaaaccnggtacctagaagacgcgtaggaacggtaccaccgggtcctttaggtactttagtggtacgaacgtaaaggggagttaanacggactacgg

SEQ ID NO: 428621 - DNA, 657 bp, Homo sapiens
  misc_feature: GZ8MTXP02HYU1S.19.53.E09.1.454.CMB.2.raw
tcagtactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtagaagggccgattcaccatctccagacgacaacgccaaagaacctccctgtatctgacaaatgaacagtctgagagctaggaggacacggtcctttagtatttactggtcgacgaaaggggagtaactaggccagtactagtcgggtaccacgtacgtgggggacccaacggggaacccgtggccacccgtctcctcacgccctccaaccgaagggcccctagtcccggtcccttcccccgtggcccgtccccgttgcccttaccgacgggacgccccgaaacccgtccggaacggaacgccaaccgtacggcccggggccccgttcgggccctttacgggcccgttcgggtaacccgaaacggggtacccttaaccttaccccgaaccgggtaataaccgttaccgtaggaccggtaccggggtcgtaccgggg

SEQ ID NO: 428622 - DNA, 568 bp, Homo sapiens
  misc_feature: GZ8MTXP02IEFWV.19.53.E09.1.454.CMB.2.raw
  modified_base (258)..(258): a, c, t, g, unknown or other
  modified_base (278)..(278): a, c, t, g, unknown or other
  modified_base (297)..(297): a, c, t, g, unknown or other
  modified_base (347)..(347): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctaattttaaaaggtgtccagtgtgaagtgcagctggtggagtcgtgggggagcttggtacagcctggcaggtcctgagactctcctgtgcagcctntgattcactttgatgattangccatgcacgtgggtccgnaagctccgaggggacggcgtggagtggtctcgaggtatagttggaattgngtctagtatgtacctagtgcgtatcgtgtgaacgggctattccactatcacagacacaacgccaaagaccttccctagttactccgtagaacctaaagtcgaaacgtagtacctaggaacgtacgacgttagggaacggtaacccgtaccgggttccttagtttaacgttaccgtaaggttacggacgtaaaaggggtaagtagttaacggacctaaacgg

SEQ ID NO: 428623 - DNA, 704 bp, Homo sapiens
  misc_feature: GZ8MTXP02GLJK4.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtgaagtgcagcgtggtggagtcgtgggggagtcgttggtacagcctggcaggtccctgacgactctcctgtgcagcctctggattctactttgatgattatcgcatgcacggtcggggtcccgacaacgccgtaccgaaggggaacgggccgtaggggtaggtggggtctacggtaggttagtttaggtagggtaaatagtggctaagtatacgtcctaagcggacgggacttcgtggtagaacggggcctattacccaacctactccgtaacccgaagaacgtaaaccgaaaccggtaccaaaaggtaaaccccttcccgttaagttacttaccgaagtaaacctaaaacgttggaaaacctaggttaccgtaggaacggtaacgccggttaagggaaaccggggaaaccgtaaccgggttccctttttaagggtaaaactttttaccgggaacgggttacggaaaaccggttaaaagggggtaacctttaaacggtaacggtaacgttaaaccggg

SEQ ID NO: 428624 - DNA, 667 bp, Homo sapiens
  misc_feature: GZ8MTXP02IDQWW.19.53.E09.1.454.CMB.2.raw
  modified_base (251)..(251): a, c, t, g, unknown or other
  modified_base (259)..(259): a, c, t, g, unknown or other
  modified_base (271)..(271): a, c, t, g, unknown or other
  modified_base (279)..(279): a, c, t, g, unknown or other
  modified_base (304)..(304): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggagcttggtacagcctggcaggtcctgagactcctctgtgcncgtctcgngtctcctacttnatgtatancgcatcgctacggtcgggtaccganaacgccgtaccgggaaggggaccggtcggtagggtacggtcgggttcctacggtaaggtttagtttaggttaaggtaagttaggtctaggttaagtacgtacgtaccttgtcgggacgtacttcggtaggtacggaccggggactacttcccaactccttacaccggaagaaccgaacccgaaacgaacccgaaacgtaacccctttcgtaaacgttctacgtacgaaactaaacgacgtaaacgtcgttacgaggaagtccgagtacggggaaacggtacccgaccgggtttaccttaagttaccgtttaaggtggtaacggtaaacgggtaaacgggtaagtacgttaacggaccggtacg

SEQ ID NO: 428625 - DNA, 611 bp, Homo sapiens
  misc_feature: GZ8MTXP02H0JB0.19.53.E09.1.454.CMB.2.raw
  modified_base (293)..(293): a, c, t, g, unknown or other
  modified_base (311)..(311): a, c, t, g, unknown or other
  modified_base (328)..(328): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctaattttaaaaggtgtccagtgtgaagtgcagctggtggagtcgtgggggagcttggtacagcctggcaggtccctgagactctcctgtgcagcctctggtattcacctttgatgattangccatgcacgtggtccgnagctcgagggacggcgnggagtggtctcgtaggtattaggtaggaattggtgtacttagtagtacgccttaagtcggcgtactcgtaggagggaacggggcccgtattcccaactagttcccacgaaggaacgaaccaaaccggacccaaagtaaccctcccgtagtacctcgtacgaactaaagtacggaaacacgttcgtaggaaggacgaccggttagggaaaccgggtaccgtaaccgggttccctttaggtaacgtttacgtgggtacgaacggtaaagggtacgtttaagacgg

SEQ ID NO: 428626 - DNA, 532 bp, Homo sapiens
  misc_feature: GZ8MTXP02GS7NZ.19.53.E09.1.454.CMB.2.raw
  modified_base (262)..(262): a, c, t, g, unknown or other
  modified_base (447)..(447): a, c, t, g, unknown or other
  modified_base (499)..(499): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggaggcttggtacagcctggcaggtccctgagactctcctgtgcagcctntgattcacctttgatgattatgccatgcacgtgggtccgcaagctaccgaggggaacggcctggagtgggtctcgaggttattagtgaatagtgctagtatagcctagtgcgactcgtgtaggaacgggcgattcaccatcctcagagacaacgccaaagacctcctagtactctagacaaagtnaaacgagtctgaagagcgtaggacggaccgacggtcctttagtactttacgnggttacgacggaaaggtaggttaactagcaagg

SEQ ID NO: 428627 - DNA, 572 bp, Homo sapiens
  misc_feature: GZ8MTXP02H41MB.19.53.E09.1.454.CMB.2.raw
  modified_base (292)..(292): a, c, t, g, unknown or other
  modified_base (437)..(437): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagcgtggtattttccttttggctattttaaaaggtgtccagtgtgaagtgcagctggtggagtcgtgggggagcttggtacagcctggcaggtccctgagactctctgtgcagcctctggattcacctttgatgatttangccatgcacgtgggtctggacaagctaccgaggggaacggcctgggacgtgggtctgaggttattaggttgattaggtgacttagtatagccttaatcgcggactcgtgtaggaacggggtccctaattcaccatctaccagganaacaacgaccaaagaacctccctagtactctgaactaaaatcgaaaactagttactaggaagcgacgtacggaacggaccgtaccggtcctttaagttaacgttaacgtggtacgaacggtaaagggtaacgtag

SEQ ID NO: 428628 - DNA, 511 bp, Homo sapiens
  misc_feature: GZ8MTXP02FQ48G.19.53.E09.1.454.CMB.2.raw
  modified_base (405)..(405): a, c, t, g, unknown or other
  modified_base (488)..(488): a, c, t, g, unknown or other
  modified_base (502)..(502): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtgggggaggcttggtacagcctggcaggtccctgagactctcctgtgcagcctctggattcacctttgatgattatgtcatgcacgtggtccgcagctccgagggaggctggagtcggtctcgaggtattagtggaatgtgctagtatagctatgcgtactcgtgtagagggcccattcgacatcacaganacacgacaagacctcctagtactctcgactaaagtcaaacagtcaggagagctagaacggacacggtctttagtaacttacgngtacgacgaaaggngttaacacg

SEQ ID NO: 428629 - DNA, 577 bp, Homo sapiens
  misc_feature: GZ8MTXP02IF0BB.19.53.E09.1.454.CMB.2.raw
  modified_base (270)..(270): a, c, t, g, unknown or other
  modified_base (315)..(315): a, c, t, g, unknown or other
  modified_base (379)..(379): a, c, t, g, unknown or other
  modified_base (552)..(552): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagcttggtacagcctggcaggtccctgagactctctgtgcagcctntggattcacctttgatgattatgcctatcgctacgtgggtcccgnaacgctaccgaggggaacggcctgggagtcgggtactcgaggttatttaggttagaattgggtntacgtagtatacggccttagcgcgtactcgtgtaggtaaacgggcccgtattccgaactatcctaccgaagacgaaaccaaaccggccaaaacggtaaccctcccgtagtactactagactaaatgaacagtctagagtgctaggacggacacggtccttagtaacgttacgnggtagacgagggtaacgtataacgg

SEQ ID NO: 428630 - DNA, 569 bp, Homo sapiens
  misc_feature: GZ8MTXP02IKM5H.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagcctggcaggtccctgacgactctcctgtgcagcctctggattcacctttgatgattatgccatgcagtgggtccgcaagcctaccgaggggacggcctaggagtcgggtctcgaggttattaggttggaattggtgactaagtatacgcctagtcggacgtactcgtgtaggaacggggtcccgtagttcccaacgtactcctaccaagaacgaaccaaaccggaccaaagaaccctccgttagtactacgtagactaaaatgaaactagtactagagagcgtaggacgacacggtcttagtaattacgtgtacgacgtaaggtacgtaatacg

SEQ ID NO: 428631 - DNA, 544 bp, Homo sapiens
  misc_feature: GZ8MTXP02FI1Y1.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggctattttaaaaggtgtccagtgtgaagtgcagctggtggagtcgtgggggaggcttggtacagcctggcaggtccctgagactctcctgtgcagcctctggattcactttgatgattatgccatgcacgtggggtccgcaagctccgaggggaaggcctggagtcgggtctgaggtattagtggaatgtgctagtatagctatgcgactcgtgtaggaaggggcccgtattccgaacctatcctaccagaacgacaacgaccaaagacctaccctagtactctagacaaatgaaactagtctagagagctaggacggaccacggcctttaggtaacttacgtaggtacgacgaaaagggtacggtaataacgg

SEQ ID NO: 428632 - DNA, 605 bp, Homo sapiens
  misc_feature: GZ8MTXP02IBG2U.19.53.E09.1.454.CMB.2.raw
  modified_base (295)..(295): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcgttggtacagccgtgggcaggtccctgagactctcctgtgcagcctctggattcacctttgatgattangccatgcacgtcggtccggacaagcgtaccgaggggaagggccgtaggaggtcgggtctcgaggttaagtttaggtaggaatgtgactaaggtatacgctagtcggacgtactcgtgtaggaaacggggtccgtaattccgaacctatacccgtaccgaaaggaacgaaccaaaccgtaccaaacgaaaccttcccgtagtactcgtacgaaacaaaggtacaaactacgtacgtagaaggacgccgtaagggacggaccgtacggtcctttagtaacttacgtgtacggagtaaagggtacgtagaacg

SEQ ID NO: 428633 - DNA, 605 bp, Homo sapiens
  misc_feature: GZ8MTXP02GO025.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagcctggcaggtccctgagactctctgtgcagcctctggattcacctttgatgattatgccatgctacgtcggggtccggcaaaggcctaccggaaggggaacggggccgtaggggtaggtcggggtctacgtagggttattaggttaggaaatggtgacttaagtatacgcctagtcggcggtacttcgtggtaggaacggggtcccgtattcccgacctactcctacccaaggaacgaaccaaaccgaccaaagaaccctcccgtagtactcctagaaccaaaatcgaaactacgtctaggagagccgtaggacggaccgacgggtcctttaggtaacttacgtggtacgacgaaagggtacgtataacg

SEQ ID NO: 428634 - DNA, 530 bp, Homo sapiens
  misc_feature: GZ8MTXP02IELK8.19.53.E09.1.454.CMB.2.raw
  modified_base (419)..(419): a, c, t, g, unknown or other
  modified_base (477)..(477): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggaggcttggtacagcctggcaggtccctgagactctcctgtgcagcctctggattcacctttgatgattatgccatgcactggggtccgcaagcctccgaggggaacgggcctgggacgtggggtctcgaggtattaggttggaatggtgctagtatagctatcgcggactctgtggaaaggggccagtttccacatcnccagagaacaaaccgccaaagaaccctcctagtatctgacaaatgaacagtctagagngctagacggacaccggtcttgtaattacgtgtacgacgaagggaaggttagag

SEQ ID NO: 428635 - DNA, 642 bp, Homo sapiens
  misc_feature: GZ8MTXP02HYFAK.19.53.E09.1.454.CMB.2.raw
  modified_base (273)..(273): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggaggtcgttggtacagcctggcaggtccctgagactctctgtgcagcctntggattccacctttgatgatttatcgccatcgcctacgtcggggtccgacaagcctaccgaggggaacggccgtggagtcgggtctcgtaggttatttaggtaggaattggtgtacttagtatacgcctagtcggacggtactcgtaggtggaacggggtccctattcccgaacctagtccctacgaagacgaaccaaaccgaccaaagtaacccctcctagtactacgtagaactaaaacgtcgaaactagtaccgtaggaaggtacgaccgtagggaaccgggtaaccgtaccggggttacttttacggtaaacttttaccgtaagggttcggaaacggtaaaacggggtaagggtttaacaacggg

SEQ ID NO: 428636 - DNA, 538 bp, Homo sapiens
  misc_feature: GZ8MTXP02IAANK.19.53.E09.1.454.CMB.2.raw
  modified_base (302)..(302): a, c, t, g, unknown or other
  modified_base (379)..(379): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctgggtggagtcgtgggggaggcttggtacagcctggcagggtccctgagactctcctgtgcagcctctggattcacctttgatgattatgccatgcactgggtccggnaagctccgagggaggcctgggagtgggtctcgaggtattagtggaatgtgctagtatagcctatggcgtactcgtgnggaacgggccgattccgacctatcctacccgagacgaacaaacggcccaaagaaccttccctagtactctgacaaatgaaactagtctagacgagctaggacggaaccgacggtccttagttacttacgtgtcgacgaagggtaggtactaggactagg

SEQ ID NO: 428637 - DNA, 515 bp, Homo sapiens
  misc_feature: GZ8MTXP02FJ66A.19.53.E09.1.454.CMB.2.raw
  modified_base (405)..(405): a, c, t, g, unknown or other
  modified_base (489)..(489): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttggtacagcctggcaggtccctgagactctcctgtgcagcctctggattcacctttgatgattatgccatgcacgtgggtcccggcaagcctaccgaggggaagggccctgggaggtggggtctccgaggtattagtggaatagtgctagtatagcctatgcggactctgtgaagggccgattcacatcncagagacaacgccaaagaactccctgtatctagacaaatgaaacagtctagagagctaggacggacacggtccttagtattacnggtgacgaaaggagtataggacacgg

SEQ ID NO: 428638 - DNA, 587 bp, Homo sapiens
  misc_feature: GZ8MTXP02HEONB.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagcctggcaggtccctgagactctcctgtgcagcctctggattcacctttgatgattatgccatgcacgtcggggtccgccagggcctccgagggcgaaggggctgggagtggggtgctagttatatcattagtgaagtagggtaaacgttaaataaaattactatgactaagacctccggtagaacggggtccgaattccgaacctatcctaccagaacgactaaattacccaaaagaacctacgactagtaactcgtagaactaaaagtcgaaaacacggcctagaaggaacgccgtaaggacggaaccgaacgggtactaggttacgttaattaccgtggttacgccgggg

SEQ ID NO: 428639 - DNA, 560 bp, Homo sapiens
  misc_feature: GZ8MTXP02JA6NY.19.53.E09.1.454.CMB.2.raw
  modified_base (415)..(415): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttggtacagcctggcaggtccctgagactctcctgtgcagcctctggattcacctttgatgtattatgccatgcacgtggggtccgcaagcctccggaggggaacggccgtggagtcgggtctccgtaggttattagttaggaataggtgctaagtatacgtcctagtgcggtactcgtgtggaacgggcctagttccacntctacagagaccaacgaccaaagtacctccctagtactacgtagacaaatacgaaactagtacgtagacgagcgtaggaacggacgtaaccggtcttacgtagttacgtggtacgtaacggaagggtaggtatacggactaacgg

SEQ ID NO: 428640 - DNA, 667 bp, Homo sapiens
  misc_feature: GZ8MTXP02GSJH4.19.53.E09.1.454.CMB.2.raw
  modified_base (282)..(282): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctattttaaaaggtgtccagtgtgaagtgcagctggtggagtcgtgggggaggcttggtacagcctggcaggtccctgagactctcctgtgcagcctctggattcacctttgatgatttancgccatgcacgtcggggtccgacaagctacccggaggggacgggccgtagggaggtggggtctcgtaagggtatttaggttagggtaaattaggtgtcgttaagtaatacggtccctaagttcggaccgggtacttcgttaggtacggaaacggggtcccgtaatttcccgaacctacttccctaaccaagggaacgaaaacccgaaacccgggaaccccaaaaacggtaaccccctttacccgtacggtttaaactccgttacggaacctaaaaagtcggaaaactacgtcgtaagacggagaccgtagggaacggtaccgtaccggtaccttaggttaacttacgtggtacgaacggtaaagggtagtagtacgacgtaacgg

SEQ ID NO: 428641 - DNA, 700 bp, Homo sapiens
  misc_feature: GZ8MTXP02G8M1F.19.53.E09.1.454.CMB.2.raw
  modified_base (252)..(252): a, c, t, g, unknown or other
  modified_base (259)..(259): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagcgttggtacagcctggcaggtcctgagctctctgtncagcctntggattcacctttgatgtattatcgacctatgccacggtcggggtcccggacgaacgcgtacccggaggggaacgggtcccgtaggggaggttcggggtctaccggtaagggttagtttagggttaggaaagttaggtcggtacgttaaggttaagtaccggtacccgttaagtcgggtaccgtaccgttcgtagggttacgggaaaacgggggtccctaactttacccgaacccttaacgttcccgtaacccgaaagggaaccaaaccgaaacccggaacccaaaacgtacccttccccgttaggttaactaccgtacgaacctaaaagttcggaaactagttccgagacggtagccgtaggaaacgggtccgaacggttcccgttagttaacgtttacgaaggttacggaacggtaaaggtaggtacgtaagcgtaacg

SEQ ID NO: 428642 - DNA, 573 bp, Homo sapiens
  misc_feature: GZ8MTXP02HFEH8.19.53.E09.1.454.CMB.2.raw
  modified_base (267)..(267): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttggtacagcctggcaggtccctgagactctctgtgcagcctntggattcacctttgatgattatgccatcgcacgtcgggtccgacaacgcctaccggaggggaacggccgtggggaggtcggggtctcgaggttattaggttaggaattggtgtacttaaggtatagtcctagtcgacggtactcgtgtaggaacggggcctattccaacctagtcctaccgaagaacgaaccaaaccgaccaaagtaaccctcccgtagtactcgtagaactaaagtacgaaacagtctagagagtcgaggacggacgacggtcttagtaattacgtgtacgagtaaggagtatag

SEQ ID NO: 428643 - DNA, 569 bp, Homo sapiens
  misc_feature: GZ8MTXP02HZACU.19.53.E09.1.454.CMB.2.raw
  modified_base (271)..(271): a, c, t, g, unknown or other
  modified_base (292)..(292): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagcctggcaggtccctgagactctcctgtgcagcctcnggattcacctttgatgattangccatgcagtgggtccgcaagctccgaggggacggctggagtcgggtctcgaggtattaggttggaattgtgctaagtatagcctatcggcgtactcgtggtaggacgggcctattccaccaatcctaccgagacgaccaacgaccaaagaacctcccagtactcctagaacaaagtcgaaactagtacagagacgcgtaggaacggaccgacgggttacctttaggtaactttaccggtagttacgggaacgaaaggggtacggtttaaaacgacg

SEQ ID NO: 428644 - DNA, 611 bp, Homo sapiens
  misc_feature: GZ8MTXP02J2Z4M.19.53.E09.1.454.CMB.2.raw
  modified_base (330)..(330): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctattttaaaaggtgtccagtgtgaagtgcagctggtggagtcgtgggggagcttggtacagcctggcaggtccctgagactctcctgtgcagcctctggattcactttgatgattatgccatgcacgtgggtccgcaagctcgagggaggctggagtggtctgaggtntagtgatgtgctagtatgctagtgcgggtactcgttagagaaacgggggccctaattccaccctatacccgtacccgaaaggacgaacctaaaccggacccaaaacggtaacccttcccctaggttaactcccgttgaaccaaaaagtcggaaaactaacggttcctaggaaacggtaacggacggtacggaacggaaccgtaccggtaccgtttaaggttaacctttaacgtggttaacgaacggtaaaacggggtaggttaacgtaacggtacgtaacg

SEQ ID NO: 428645 - DNA, 580 bp, Homo sapiens
  misc_feature: GZ8MTXP02JA8TI.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggctattttaaaaggtgtccagtgtgaagtgcagctggtggagtcgtgggggaggcttggtacagcctggcacggtccctgagactctcctgtgcagcctctggattcactttgatgattatgccatgcacgttcggggtccggacaagcctaccggaaggggaacgggccgtggggagtcggggtacctcgagggttattaggttaggaatggtgtcgttaagtatagcctagtcggcgtactcgtgaggaacggccgtattccacatcacagacgacaacgaccaaagaacctccctagtactcgagtacaaaagtcgaaactagtcgtaggaacgagtccgtaggaacggaccgacggtccgtttagtaacttacgtagttacggacgtaaagggtacgtaagtacgg

SEQ ID NO: 428646 - DNA, 570 bp, Homo sapiens
  misc_feature: GZ8MTXP02GAEFG.19.53.E09.1.454.CMB.2.raw
  modified_base (548)..(548): a, c, t, g, unknown or other
  modified_base (568)..(568): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggaggcttggtacagcctggcaggtccctgagactctcctgtgcagcctctggattccacctttgatgattatgccatgcacgtggggtccgcaagcctccggaaggggacgggccgtgggagtcgggtctgtaggtattaggtaggaatggtgactagtatacgcctagtggccggtacttcgtaggtggaaacggggccctaattccaacctatcctaccgaagaacgaaccaaaccgaccaaagacccttcccgtagtactctagaactaaatgaaactgtctagagagcgtaggacgacctacggtctttagtaacttacgngtacgaggtaacggtagtancg

SEQ ID NO: 428647 - DNA, 754 bp, Homo sapiens
  misc_feature: GZ8MTXP02HQLJJ.19.53.E09.1.454.CMB.2.raw
  modified_base (318)..(318): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagcctggcaggtccctgagactctcctgtgcacgcctctggtacttcctacctttgattgtattatcgcctatcgctacgtcggggtccccgganaaacggccgtacccggaagggggaacggggcccgttaggggaggttcggggtacttacccggtaagggttagtttagggttagggaaattacggttgtcgttaagtatacggtacccttaagtcggtaccggtaactccgttaggtacggggaaacgggggtcccgtaattacccgaaccctacgttcccgtacccgaaagggaaccgaaacccgttaaaacccggacccaaaacggtaaacccctttccccgtaaggttaacctacccttaaggaaaccctaaaagttacgtaaaaccgacggtttaccgaaggaacggtacgaccggttagggaaaccgggaccggtaaacccgggttccctttaggttaacctttaacggtggttaggaaccggttaaaagggggacgtttaacggaagttaccgtaaaccgg

SEQ ID NO: 428648 - DNA, 600 bp, Homo sapiens
  misc_feature: GZ8MTXP02HB2N2.19.53.E09.1.454.CMB.2.raw
  modified_base (303)..(303): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctaattttaaaaggtgtccagtgtgaagtgcagctggtggagtcgtgggggaggcttggtacagcctggcaggtccctgagactctcctgtgcagcctctggattcacctttgatgattatgccatgcacgtgggtcccggnaagctaccgaaggggaacgggcctaggggaggtggggttctcgaggttatttaggtaggataggtgcgtaagtatagcctagtcgacggtactcgtggtaggaacgggccgtattaccaccctatccctacccgaagacggaacccaaaaccggaccctaaaacggtaacccttcccccttaggttaaccttaccgttagaacctaaaagtacgaaactaggtactagaacggtagcgtaggacggaccgtacgggtcttacggtattaacgtgtgaacgaggtagtataggactag

SEQ ID NO: 428649 - DNA, 699 bp, Homo sapiens
  misc_feature: GZ8MTXP02GO0BQ.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagcttggtacagccgtggcacggtccctgacgactctcctgtgcagcctgtggattctactttgactgtattatcgccagtcgcgtacgtcggggtccggacaacggccgtccggaaggggaacggccgtggggacggttcggggtcctacgtaggttatttaggtaggaaagttaggtcgtagttaaggttatacgtactagtcggaccggtacttcgtagggtacggtaaacggggtcccgtaacttcccgaaccctaacgttccctacccgaaagaaaccggaaacccgaaacccgtaaacccgaaaacggtaaaccccttaccccgttaggttaaacttacctaacggaaacctaaaagtacgaaaacgtacgttacgtaacgacggtaaagtccgtaaggaacggaccgtaaccggtcctttaagtaacgtttacgtcggtaacgacggaaacggtacggtacgtaacgg

SEQ ID NO: 428650 - DNA, 536 bp, Homo sapiens
  misc_feature: GZ8MTXP02GFU2T.19.53.E09.1.454.CMB.2.raw
  modified_base (383)..(383): a, c, t, g, unknown or other
  modified_base (515)..(515): a, c, t, g, unknown or other
  modified_base (527)..(527): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttggtacagcctggcaggtccctgagactctcctgtgcagcctctggattcacctttgatgattatgccatgcacgtgggtccgcaagctccgaggggaacgggcctgggagtcggggtctcgaggttattaggtggaattggtgactagtatagctangcgtactcgtgtggaagggccgattccaaccatcctccagagaccaaacgccaaagaacttccctagtactctagacaaaatcgaaacagtctagagagcgtagacggacaccggtcttaggtaacttacgngtagacaaaggnggtatacgg

SEQ ID NO: 428651 - DNA, 628 bp, Homo sapiens
  misc_feature: GZ8MTXP02HSWNJ.19.53.E09.1.454.CMB.2.raw
  modified_base (595)..(595): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggaggcgttggtacagcctggcaggtccctgagactctcctgtgcagcctctggattcactttgatgtatttatgccagtgctacgtgggtccggacaagccgtcgaggggaacggtcgtggaggtcggtctcgtaggttattaggttaggaattgtgtactagttatacgccttagtcggacggtacttcgtagtacggaacggggtcctaatttcccgactatccgtaccgaagaacgaaccgaaaccgaacctaaaacgaaccccttcccgttaagtacttacgtacggaacctaaaagttcgaaaacgtacgtacgtacgaaggtagaccgtagggaacggaccgtaacgggtccctttagtaactttacgnggtacgaggtaaaaggtagggtttaaacgtacg

SEQ ID NO: 428652 - DNA, 552 bp, Homo sapiens
  misc_feature: GZ8MTXP02JCF7X.19.53.E09.1.454.CMB.2.raw
  modified_base (290)..(290): a, c, t, g, unknown or other
  modified_base (358)..(358): a, c, t, g, unknown or other
  modified_base (365)..(365): a, c, t, g, unknown or other
  modified_base (370)..(370): a, c, t, g, unknown or other
  modified_base (401)..(401): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctattttaaaggtgtccagtgtgaagtgcagctggtggagtcgtgggggagcttggtacagcctggcacggtccctgagactctcctgtgcagcctctggattcactttgatgattangccatgcacgtgggtccgcagctccgagggacggctggagtcggtctcgaggtattagtagaatggtnctagtangctangacgactgtgtaggagggcctattaccgacntccaccgagacaacaacgaccaaagaccctccgtagtactctacgactaaagtcgaaactagttcgaggagacgttacgaggaaccggtacgtacccggttcgttaggttaacttacgtggtacggacgtaaagggtacggtaataaccgg

SEQ ID NO: 428653 - DNA, 547 bp, Homo sapiens
  misc_feature: GZ8MTXP02GNZXK.19.53.E09.1.454.CMB.2.raw
  modified_base (326)..(326): a, c, t, g, unknown or other
  modified_base (508)..(508): a, c, t, g, unknown or other
  modified_base (536)..(536): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtgggggagcttggtacagcctggcaggtccctgagactctcctgtgcagcctctggattcacctttgatgattatgccatgcacgtgggtccgcaagctccgaggggaggctggagtggtcncgaggtattagtggataggtgctagtatacgcctagtgcggtactcgtggtaggaacggggcctattcgaccattcaccagacgacaaccgaccaaagaccttccgagtatctagaactaaagtcgaaaactgtcgtagagacgtctaggaacggaaccgcggtaccttggttaacttacgngggtacgaacggtaaaggggtagttaanacggactaagg

SEQ ID NO: 428654 - DNA, 602 bp, Homo sapiens
  misc_feature: GZ8MTXP02FRQ15.19.53.E09.1.454.CMB.2.raw
  modified_base (280)..(280): a, c, t, g, unknown or other
  modified_base (301)..(301): a, c, t, g, unknown or other
  modified_base (405)..(405): a, c, t, g, unknown or other
  modified_base (556)..(556): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttggtacagcctggcaggtccctgagactctcctgtgcagcctctggattcacctttgatgattangcctatgcacgtggggtccgnaagctccgagggaggcctggagtggtctcgaggttattagttggaatagtgtctagtatagcctagtgcggactcgtgtaggaacgggccgtattcccgaaccncttctacccgaagaacaaccgaaaccgacccaaaagtaacccttccctagttaactccgtagaacctaaaattcggaaaacctgttaccgtaggaaggaacgtcgtagggaacggtaacccgtaccggggtcctttaggtaattttaccgnggttacgaacggtaaaagggtgggtttaaaacgacggacgtaacgg

SEQ ID NO: 428655 - DNA, 569 bp, Homo sapiens
  misc_feature: GZ8MTXP02J3KQC.19.53.E09.1.454.CMB.2.raw
  modified_base (269)..(269): a, c, t, g, unknown or other
  modified_base (291)..(291): a, c, t, g, unknown or other
  modified_base (507)..(507): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggcttatttaaaaggtgtccagtgtgaagtgcagctggtggagtcgtgggggagcttggtacagcctggcaggtccctgagactctcctgtcgcagcctntggattcacctttgatgattangccatcgcacgtggggtccgcaagcctccgaggggaacgggcctgggagtcggggtctgaggttattaggtggaatgtgcttagtatagccttagtcgcggtactcgtggtaggaacggggcctagttccaacctatcctaccagacgaccaaaccggccaaagtaaccctcccgtagtaactcctagacaaaagttgaaactaggtctaggaagngaccgtaggacggacgacggtcctttaggtaacttacgtgtacgacaagggtagtaatacgg

SEQ ID NO: 428656 - DNA, 563 bp, Homo sapiens
  misc_feature: GZ8MTXP02HZUZJ.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttaattttaaaaggtgtccagtgtgaagtgcagctggtggagtcgtgggggagctttggacagcctggcagggtccctgagactctcctgtgcagcctctggattcacctttgatgattatgtcatgcacgtcggggtccgacaagccgtacgaggggaagggcctgggaggtgggtctcgagggttatttagtagggaattaggtgcttagtaatacgaccttagtcgacgggtacctgtggtaggaacgggccgattccacctatccaccagacgaacaaacgccaaagaacctccctagtactctagaacaaatacgaaacagtacgagagacgtacgtaggaacgacgaccggtcgttagtaattagtgtacgaacgaaggtagtatacgacgag

SEQ ID NO: 428657 - DNA, 573 bp, Homo sapiens
  misc_feature: GZ8MTXP02HT871.19.53.E09.1.454.CMB.2.raw
  modified_base (267)..(267): a, c, t, g, unknown or other
  modified_base (298)..(298): a, c, t, g, unknown or other
  modified_base (321)..(321): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttccttttggcttattttaaaaggtgtccagtgtgaagtgcagctgggtggagtcgtgggggagcttggtacagcctgggcaggtccctgagactctcctggtncagcctctggatttcactttgattgatttangccatcgcacgtcggggtccganaacgctccggaaggggacggcctgggagtcgggtactcgaggttattaggttggaattggtgacttagtagtacgaccttagtcggcgtactcgtggtaggaacggggtcctattccaactagtcccacgaagacgaccaacgaccaaagacccttccctagtactgtacgactaaaagtcgaaactaggtcaggaacgtgcctagacggacctacggtctagttaatacgtgacgacgaaggtcgtatacg

SEQ ID NO: 428658 - DNA, 609 bp, Homo sapiens
  misc_feature: GZ8MTXP02JJHYR.19.53.E09.1.454.CMB.2.raw
  modified_base (259)..(259): a, c, t, g, unknown or other
  modified_base (264)..(264): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtggggggaggtcttggtacagccgtggcaggtccctgagactctctgtgcngcctntgattcacctttgatgattatgccatgcctacggtcggggtcccggacaagcctaccggaggggaacggccgtggggaggtgggtctaccgtaggttagttagttaggaattaggtgtctagtaatacgtcctagtcggcggtacttcgtaggtacgggaaacggggtcctattcccgaacctagtcctaccgagacgacaaaccgcaaagaccctccgtagtactactacgaacaaagtcgaaacagttcgagaaggacgcgtaggaacggtaccgtaccggttccgtttagtacgttaacgtggttagaaccggtaaagggtacgtaatacgggactaaccgg

SEQ ID NO: 428659 - DNA, 570 bp, Homo sapiens
  misc_feature: GZ8MTXP02G0DB2.19.53.E09.1.454.CMB.2.raw
  modified_base (326)..(326): a, c, t, g, unknown or other
  modified_base (345)..(345): a, c, t, g, unknown or other
tcagtactctcgtgcacgaccggtgctcgatttagagagagtgtgttgggtttgggaggcttggtacagcctggcaggtccctgagactctcctgtgcagcctctggattcacctttgatgattatgccatgcactgggtccggcaagctccgagggaagggcctggagtgggtctcaggtattagttggaatagtgctagtatagcctatgcggactctgtggaagggccattcaccatctccagagacaacgccaagactcctgtatctgacaaatgaacagtctgagagctgaggacacggtcttgtattactgtgcaaaggngtatagcagctagtggacncgtacgtcggggccagggaccctggccaccgtctcctcacgccctccaaccgaacgggcccctaagtccggtccttcccccgtggcccgtccctgcccttaccgaggacgcccacccgtcgagacgcacgacgccggcccgtcggggcctcgccgtcggtaaccgaacggtacctacccgtacccgaacggtacgaacgttaccgaggacggcgggtactcgggg

SEQ ID NO: 428660 - DNA, 536 bp, Homo sapiens
  misc_feature: GZ8MTXP02FYMZK.19.53.E09.1.454.CMB.2.raw
  modified_base (254)..(254): a, c, t, g, unknown or other
  modified_base (275)..(275): a, c, t, g, unknown or other
  modified_base (294)..(294): a, c, t, g, unknown or other
  modified_base (453)..(453): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctatttaaaggtgtccagtgtgaagtgcagctggtggagtcgtgggggagcttggtacagcctggcaggtccctgagctctcctgtgcagcctntggattcactttgatgattangccatgcacgtgggtccgnaagctccgagggagggcctgggagtgggtctcgaggtattaggtgaatgtgctagtatagcctatcgcggtactctgtaggaagggccgtattccgaccatctaccagacgaacaacgccaaagaacctcccgtagtactctagactaaaatcgaaacngtctagagacgcgtaggaacggacctaacgggtcctttagtacttacgtggtcgacgaaaggggtcggtaatacggactaagg

SEQ ID NO: 428661 - DNA, 571 bp, Homo sapiens
  misc_feature: GZ8MTXP02GQSEW.19.53.E09.1.454.CMB.2.raw
  modified_base (265)..(265): a, c, t, g, unknown or other
  modified_base (284)..(284): a, c, t, g, unknown or other
  modified_base (288)..(288): a, c, t, g, unknown or other
  modified_base (443)..(443): a, c, t, g, unknown or other
  modified_base (462)..(462): a, c, t, g, unknown or other
  modified_base (559)..(559): a, c, t, g, unknown or other
tcagtactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccgagggaagggcctggagtgggtctcaggtattagttggaatagtgctagtatagcctatgcggactctgtgaaggccattcaccatctcagagacaacgccaagaactccngtatctgacaaatgaaacngtcngagagctggaggacacggtcttagtattactgtgacgaaggaggtatagcagctacgtggtacgactacggtgggggaccacggggaccctgggtccaccgtctcctcacgcctaccaccgaacggccctacgtccgtccttcccccgtggcccnccctgcctccgacgggacnccgaacccgtcgacgacgcaacgcggccgcccgtggggcctacggcccgttacggtccgaaacggaccttacccttccccgaacgacgtacgtacgnggacggcggtcg

SEQ ID NO: 428662 - DNA, 641 bp, Homo sapiens
  misc_feature: GZ8MTXP02ITXMB.19.53.E09.1.454.CMB.2.raw
  modified_base (295)..(295): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctgggtggagtcgtgggggagcttggtacagccgtggcaggtccctgagactctcctgtgcagcctctggattccactttgatgatttangccatgctacgtgggtccgacaacgctccggaggggaacgggccgtggaggtcgggtctacgtaggttagtttaggttggaaattggtcggtacttaagtacgtaacgtccgttaagttcggccgggtacttcggtggtaggaacggggccgtatttcccgaacacgttcctaccaagaacgaaccaaaccgccaaagaacctcccgtagtactcctagacaaaattcggaaacagttaccgaggaaacgcggtacgtacgggaacggaaccgtaccgggttacccgtttagttaacgtttaccgtgggttaccgaaaggtaacggggtaacgtttaagtaaccgg

SEQ ID NO: 428663 - DNA, 579 bp, Homo sapiens
  misc_feature: GZ8MTXP02G8VBM.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggaggcttggtacagcctggcaggtccctgagactctcctgtgcagcctctggattcacctttgatgattatgccatgcacgtggggtccgcaagcctccgaggggaacggcctgggagtggggtctccgaggttattaggtgtaatagtgcgttagtatagcctagtggcgactcgtgtaggaacgggccgattccaccgtatctaccaagacgacaaaccggaccaaacgaccttccctagtaactcgtacgactaaaatcgaaaactaggttcgagaagacgtacggtaggaaccggaacgtaccggtcctttaggtaactttacgtggtacgacgtaaaaggggacgtaagtacggactaagg

SEQ ID NO: 428664 - DNA, 634 bp, Homo sapiens
  misc_feature: GZ8MTXP02IHGDA.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttattttaaaaggtgtccagtgtgaagtgcagcgtggtggagtcgtgggggagcgttggtacagccgtggcaggtccctgagtactctcctgtgcagcctctggattcacctttgatgtattatgcctatcgcacgtgggtccgcaacgcgtaccgaaggggacggccgtggaggtcgggtctaccgaggttaattaggttaggaaattggtgtcgttaagtatacgtaccttagtcgacgtctcgttggacggtaaacgggcctagttacccacccgtattacccgtaccgaaggacgaaacccaaaccggacccaaaacggtaaacccttcccgtagttacctcgttacgaaacctaaaagtaggaaacctagttaccgagaacgacgtacgtagggaaacgtaccggtaccggttccgttaagtttaactacgtgtacggaacgtaacgggaagttatacgtacgacg

SEQ ID NO: 428665 - DNA, 574 bp, Homo sapiens
  misc_feature: GZ8MTXP02GI1ZX.19.53.E09.1.454.CMB.2.raw
  modified_base (318)..(318): a, c, t, g, unknown or other
  modified_base (441)..(441): a, c, t, g, unknown or other
  modified_base (447)..(447): a, c, t, g, unknown or other
tcagtactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccgagggaagggcctggagtgggtctcaggtattagttggaatagtgctagtatagcctatgcggactctgtgaaggccattcaccatctcagagacaacgccaagaactccctgtatctgacaaatgaaacagtctgagagctgaggacacggccttgtattacngtgacgaaggagtatagcagtctacgtggtacgactacgtgggggaccaacggggaaccctgggtaccaccgtctccctcacgccctccaaccgaacgggcccacgtccggtccttcccccgnggcccncccgtcgcctccgacggacgcccaacccgtccgagacgccaacgcgcccggtccgtcgggcctcgcccgtggtaccaaacggtaccttaccgtcccgaacgacggtacgtacgtcggacggcggtcg

SEQ ID NO: 428666 - DNA, 632 bp, Homo sapiens
  misc_feature: GZ8MTXP02I6DTO.19.53.E09.1.454.CMB.2.raw
  modified_base (282)..(282): a, c, t, g, unknown or other
  modified_base (377)..(377): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttaattttaaaaggtgtccagtgtgaagtgcagctggtggagtcgtgggggagcttggtacagcctggcaggtcctgagactctcctgtgcagcctctggacttcacctttgatgattangccatgcacgtcgggtccgacaacgcctaccgaggggaacgggccgtaggggacggtggggtctaccggtagttagttaggtaggaattagtgtntagttatacgtcctagtggcgtacttcgtggtaggaaacggggcctaattccgaactacttcctacccaaaggacgaaaccaaaccggacccaaaagtaaccccttcctagtacctacgtaggaaaccaaaagttcgaaaacgtacgttaccgagaaggacgtccgtaagggaaaccggaccgtaaccgggtcctttaaggttacttaccgttaaggacggaaacgaaaagggtaggttaaacacggacgtaacg

SEQ ID NO: 428667 - DNA, 598 bp, Homo sapiens
  misc_feature: GZ8MTXP02HB0F2.19.53.E09.1.454.CMB.2.raw
  modified_base (316)..(316): a, c, t, g, unknown or other
  modified_base (596)..(596): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagcttggtacagcctggcaggtccctgagactctcctgtgcagcctctggacttcacctttgatgatttatgccatgcacgtcgggtccganaacgcctccgaggggaacggccgtgggagtcggggtctcgtaggtattaggtaggaatgtcgactaagtatacgtcctagtcggacggtacttcgttaggagggaaacggggtccctatttacccaaccctaatccctaccgaaggaacgaaccaaacgacccgtaaaagtaaccccttcccgtagtaaccttcagaactaaatcggaaacagtctagagagctaggaacgaccgacggtcctttaggtaacttacgtggtacgacgaaaggtggttaancg

SEQ ID NO: 428668 - DNA, 568 bp, Homo sapiens
  misc_feature: GZ8MTXP02I6SZI.19.53.E09.1.454.CMB.2.raw
  modified_base (542)..(542): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctatttaaaaggtgtccagtgtgaagtgcagctggtggagtcgtgggggagcgttggtacagccgtggcaggtccctgagactctcctgtgcagcctctggattcactttgatgattatcgccatgcacgtgggtccgcaagctaccgaggggacggccgtggaggtgggtctcgtaggttagttaggttaggaagttaggtgcgttaagtatacgtccttagtcggcggtacttcgtggtaggaaacgggggccatttcccaaccacttcctacccaaggacaaccaaaccgccaaaagtaccctccctagtactactcgacaaaagtcgaaactgtacgtagacgaggtcaggacgacgaaccgttcttagtacttagngtacgacggaggagtacgacgacacg

SEQ ID NO: 428669 - DNA, 640 bp, Homo sapiens
  misc_feature: GZ8MTXP02ILFAN.19.53.E09.1.454.CMB.2.raw
  modified_base (279)..(279): a, c, t, g, unknown or other
  modified_base (301)..(301): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaggtgtccagtgtgaagtgcagctggtggagtcgtgggggagcttggtacagcctggcaggtccctgagactctcctgtgcagcctctggattcacctttgattgattangccatgcacgtggggtccgganaaggcctaccgaggggaggccgtgggagtggggtctcgaaggttattaggttaggaattagtgtcgttagtaatacgtaccttaagtcggacgtactcgtggtacggaacggggcctagtttacccaaccgattccgtacccgaaggaacgaaccgaaaaccggaccccaaaaggtaaccccttacccccgtaggttaactacccgttaagaacctaaaagttcggaaaactcggttacaaggaaggtacgacggttaacggacggtaaaccggaccggttaccgtttagtaactttaacgtggtacgacgtaaaagggtagtttacaggactaaacgg

SEQ ID NO: 428670 - DNA, 695 bp, Homo sapiens
  misc_feature: GZ8MTXP02FNA8S.19.53.E09.1.454.CMB.2.raw
  modified_base (199)..(199): a, c, t, g, unknown or other
  modified_base (227)..(227): a, c, t, g, unknown or other
  modified_base (260)..(260): a, c, t, g, unknown or other
  modified_base (287)..(287): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagcgtgtatttccttggctatttaaaggtgtcagtgtgaagtgcagntggtggagtcgtgggggagcttggtacngcctggcaggtccctgagactctccctgtgccncgctgtgtactctacttgatagtattntcgctatcgctacggtcgggtcgacgacgcgtaccgggaagggtacggtcgtagggtcggtcggtacgtaggtaaggttagttaggtaaggtaagttggtacgtacgttaagtacgtacgtacgtagtcggtaccgtacgttacggtagggtacgggtaaccgggtaccgttactacccgaacctacgttacccgaccgaaggaaaccgaaccgaaaccggaacccgtaaacgttacccttacccgttataactcgtaacgtaaactaaacgtaacgtaaacgtaacgtacggtacgtacggtacggtacggtacggtaacggtaccggtaccggttaccggtttacgttaacggtttacggttacggttacgggtaacggtaaacggggtaacggtaacggtaacgg

SEQ ID NO: 428671 - DNA, 609 bp, Homo sapiens
  misc_feature: GZ8MTXP02GATIE.19.53.E09.1.454.CMB.2.raw
  modified_base (325)..(325): a, c, t, g, unknown or other
  modified_base (478)..(478): a, c, t, g, unknown or other
  modified_base (607)..(607): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggcttaattttaaaggtgtccagtgtgaagtgcagctggtggagtcgtgggggagtcttggtacagcctggcacggtccctgagactctcctgtgcacgcctctggacttcctacctttgatgtaattatcgccatcgctacgtcggggtcccganaacggcctaccggaaggggaacggccgtgggtaggttcggggtactacgtaagggttagtttaggttagggaaattgggtacgtacgttaagttaacgtacggtccttaagtcggacggtacttcgtggtaggaacgggcccgtatccaactntcacagacgaaccaacgaccaaagaccctcccgtagtaacttcgacgactaaaatcgaaactgtactagacgatcgtaggaacggtaccacggtccttagtaacttagtagtacgagaaaggtcgttanag

SEQ ID NO: 428672 - DNA, 546 bp, Homo sapiens
  misc_feature: GZ8MTXP02HSGTM.19.53.E09.1.454.CMB.2.raw
  modified_base (179)..(179): a, c, t, g, unknown or other
  modified_base (402)..(402): a, c, t, g, unknown or other
  modified_base (404)..(404): a, c, t, g, unknown or other
  modified_base (436)..(436): a, c, t, g, unknown or other
  modified_base (440)..(440): a, c, t, g, unknown or other
  modified_base (450)..(450): a, c, t, g, unknown or other
  modified_base (456)..(456): a, c, t, g, unknown or other
  modified_base (468)..(468): a, c, t, g, unknown or other
tcagtactctcgtgcacgaccggtgctcgatttagagagagtgtgttgggtctgggggaggcttggtacagcctggcaggtccctgagactctcctgtgcagcctctggattcaccttttgatgattatgccatgcactgggtccggcaagctccagggaagggcctggagtgggtctnaggtattagttggaatagtgctagtatagctatgcggactctgtgaagggccattcaccatctccagagacaacgccaaagaactccctgtactctgacaaatgaacagtctgagagctagaggacacggtcctttaggtattacgtgtgacaaagggacgtatagcagcttacgtggtacgtactacgtggggcccaaggggaccctggtcccacgtctccncncgcctaccacgacgcctacgtccgtcctccgngccnccgtcgaccncgagcncaccgacgagcncacgcgccgcgtggctcgcgtacgacgaacgtaccttaccgtaaccgaacggtaacgacgtacgtcggacggcggtcg

SEQ ID NO: 428673 - DNA, 609 bp, Homo sapiens
  misc_feature: GZ8MTXP02FYE48.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggaggcttggtacagcctggcaggtccctgagactctcctgtcgcagcctctggacttctacctttgattgtattatgcctatcgcacgtcggggtcccggcaacggcctaccggaggggaacggggcctgggaggtgggtctacgtaggttagttaggttaggaattaggtgtcgttagtacgtagtacctagttcggcggtacttcgtaggtaggaacggggccctattcccgaacctgtcctaccaggaaacgaccgaaaccggacccaaaacgtacccttccgttagtaactcgtacgaaactaaacgtacgaaaactggtacgtaggagtacgcgtaggacgaccgacggtcttagtacttacgtgacgtacgaagggtagtagacgacgtacg

SEQ ID NO: 428674 - DNA, 533 bp, Homo sapiens
  misc_feature: GZ8MTXP02FMVYL.19.53.E09.1.454.CMB.2.raw
  modified_base (299)..(299): a, c, t, g, unknown or other
  modified_base (433)..(433): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctattttaaaaggtgtccagtgtgaagtgcagctggtggagtcgtgggggagcgttggtacagcctggcaggtccctgagactctcctgtgcagctctggattcactttgatgattatgccatgcacgtgggtccganagctccgaggggacggcctggagtgggtctccgaggtattaggtggaatgtgctagtatgcctagtgacggactgtgtaggagggtccgtattccaccatcaccagacacaacgccaaacgacctccgtgtacnctacgacaaatgaacagtactgagacgcgtaggaacggaacctacgggtcctttagactttaacgtggtacgtacggaaagggtagtactagacgtaagg

SEQ ID NO: 428675 - DNA, 610 bp, Homo sapiens
  misc_feature: GZ8MTXP02GOI7S.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggaggcttggtacagcctggcaggtccctgagactctcctgtgcagcctctggattcacctttgatgatttatgccatcgctacgtggggtccggacaacgcctaccggaggggaacggccgtggggagtcggggtctcgtaggttattaggttaggaattggtgacttagtatacgtcctaagtcggcggtacttcgtggtagggaaacggggcccgtaattcccaacctacttcctaccgaggaacgaaccaaaccggaccaaaagaccccttcccgtagtactccgtagaacctaaaagtcgaaacctagtctaggagagtcgtaggacggaaccgacggtcctttaggtaacttcgtaggtcgaacgaaagggtacgtaatacgg

SEQ ID NO: 428676 - DNA, 535 bp, Homo sapiens
  misc_feature: GZ8MTXP02GBS5U.19.53.E09.1.454.CMB.2.raw
  modified_base (292)..(292): a, c, t, g, unknown or other
  modified_base (318)..(318): a, c, t, g, unknown or other
  modified_base (443)..(443): a, c, t, g, unknown or other
tcagtactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaaggccattcaccatctccagagacaacgccaagaactccctgtatctgacaaatgaaacagtctganagctgaggacacggccttgtattacngtgacaaggagtatagcagctactggtacgactacgtggggccagggaaccctgggtcaccgtctcctcacgcctccaccaacgggcccatccggtcttccccctggccgccctgctccaggacncacctcgagacgcacgacgccggtccgtcgggctcgccgtcggtacgaacggtacctacctaaccgaacgagacgtacgacggacggcggcg

SEQ ID NO: 428677 - DNA, 607 bp, Homo sapiens
  misc_feature: GZ8MTXP02JXTLC.19.53.E09.1.454.CMB.2.raw
  modified_base (290)..(290): a, c, t, g, unknown or other
  modified_base (294)..(294): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagcgtggtatttcctttaggctatttaaaggtgtcagtgtgagtgcagctggtggagtgtgggggagcttggtacagcctggcaggtccctgacgctctcctgtgcacgccctgtgattctacctttgatgtatttancgcntcgacgtacggtcgggtaccgacacgccgtacggaaggggacggtccgtagggtaggtcggtctagtaggttagttaggttagtaagtggtcgtacgttaagttagtacgtaccgttagtcgggtaccgtacgttcggtagggtacgggacggtaccgtactacccactactaccgaccgaagacgtaaccgaaccgtaccgtaaacgaccttaccgtagtacttcgagacgtaacgtagacgtacgtacgtagagagcgacgacgacgtacgtacgtacgtaagtacgtacgtacgagtaggtacgtagtag

SEQ ID NO: 428678 - DNA, 610 bp, Homo sapiens
  misc_feature: GZ8MTXP02IEO1P.19.53.E09.1.454.CMB.2.raw
  modified_base (290)..(290): a, c, t, g, unknown or other
  modified_base (311)..(311): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttaattttaaaaggtgtccagtgtgaagtgcagctgggtggagtcgtgggggagcttggtacagcctgggcagggtccctggacgactctcctgtgcagcctctggattcacctttgattgattangccatgcacgtcggggcccgnaagcctccggaggggacggccgtagggagtgggtctcgaagggttattaggtaggaattaggtcgcttagtatacggtacctagtcggcgtacctgtaggtaggaacgggccgtacttccaacctactacctacccgaaggacgaaccaaaccgacccaaaacgtaacccttaccctagttaacttcctaacgaactaaaatacgaaactagttacgaggaagtagcgtaagggacgtaaccgaccggttaccttagttaacttacgtgtacgaacgtaagggtagtactaaggcaacg

SEQ ID NO: 428679 - DNA, 562 bp, Homo sapiens
  misc_feature: GZ8MTXP02IOG5S.19.53.E09.1.454.CMB.2.raw
  modified_base (269)..(269): a, c, t, g, unknown or other
  modified_base (290)..(290): a, c, t, g, unknown or other
  modified_base (538)..(538): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagcctggcaggtccctgagctctcctgtgcagcctntggattcactttgatgattangccatgcacgtcgggtccgacagcctacggaggggaacgggccgtgggaggtcgggtctcgtagggttattaggttaggaattggtgtactagtatagtcctagtcgcggtactgtggtaggaacgggccgtattaccacctatccacagacacaacgacaaagacctacccgtagtactctagactaaagacgaaactgtactacggagacgtactagggacgaaccgcgtccttagtaagttacgngtacgagtaaggacggtataacgg

SEQ ID NO: 428680 - DNA, 535 bp, Homo sapiens
  misc_feature: GZ8MTXP02F3MF9.19.53.E09.1.454.CMB.2.raw
  modified_base (310)..(310): a, c, t, g, unknown or other
  modified_base (470)..(470): a, c, t, g, unknown or other
  modified_base (510)..(510): a, c, t, g, unknown or other
  modified_base (528)..(528): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggaggcttggtacagccgtggcaggtccctgacgactctcctgtgcagcctcgtgattccactttgatgtattatgcctatgctacgtgggtcccganaagcctaccgaggggacggccgtgggagtggtctcgtaggtattaggtaggaatgtgctagtatagcctatggcgtactcgtggtagacggctacttcgaccatcaccgagaacgacaacgaccaaagtaacctcctagtactctagacaaatcgaaacngtacgagacgagcgagacgacctacggtcttagtattcgngtagacgaaggtagtaancgactag

SEQ ID NO: 428681 - DNA, 642 bp, Homo sapiens
  misc_feature: GZ8MTXP02HFZWL.19.53.E09.1.454.CMB.2.raw
  modified_base (280)..(280): a, c, t, g, unknown or other
  modified_base (618)..(618): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttccttttggcttaattttaaaaggtgtccagtgtgaagtgcagcgtgggtggagtcggtgggggagtcgttggtacagccgtggcacggtccctgacgactctctgtcgcagcctntggacttccactttgatgtatttatcgcctagtcgactacggtcggggtccgacaacgcctacggagggacggccgtgggaggtcggtcctacgtagggttagttaggtaggaattggtcgtataaggttatacgtacctagtcgggacgtacttcggtggtacgggaaacgggtccgtatttaccgacctactccgacaaggaacgaacaaaccggaccctaaacgtaaccctcccgttaagtactacgtacgaaactaaacgtacgaaaactggttactaggggaagtaccgtaggtaacggaacggtacgtaccggttcttaagtaacgttacgngtacggagaaggttacgtagtacg

SEQ ID NO: 428682 - DNA, 570 bp, Homo sapiens
  misc_feature: GZ8MTXP02GWSIG.19.53.E09.1.454.CMB.2.raw
  modified_base (280)..(280): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtgggggagcgttggtacagcctggcaggtccctgagactctcctgtgcagcctctggattcacctttgatgattangcctatgctacgtggggtccggcaacggcctaccggaggggaacgggccgtgggaggtcggggtctacgagggttatttaggtaggtaataggtgtctagtatacgcctagtgcggtactcgtgtaggaacggggccgtaattccgactatcctacgagacgacaacgccaaagaccttccgtagtactcgtagactaaactgaactagtcgtagagactcgtaggacgacgacgggtaccttaggtaactttacgaaggtcgaacggtaaggaggtagtcgacgtaacg

SEQ ID NO: 428683 - DNA, 654 bp, Homo sapiens
  misc_feature: GZ8MTXP02F0Y5A.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggcttaattttaaaaggtgtccagtgtgaagtgcagctgggtggagtcgtgggggagtcttggtacagcctggcaggtccctgagactctctgtgcagcctcgtggattcctacctttgattgatttagtcgcctagtcgccgtacgtcggggtcccggacaaacggtcctaccgggaaggggaacggggccgtaggggtacggttcggggtacctcgtaagggtttacgtttaggttacggaaattgggtgtacgttaagtacgtacgtaccttagtcggcggtacttcgtaggtacggaacgggcccgtatcccaactactcccgaccgaaggtaacgaaccaaaccgacccgaaagacccttacccgtatactaccgtagaacaaaagtcgaaactaggtactaggagacgtcgtaaggacggtaccgtaacggtcctttaggtaactttacgtaggtacgacgtaagggtacgtaatacgg

SEQ ID NO: 428684 - DNA, 673 bp, Homo sapiens
  misc_feature: GZ8MTXP02HHWBJ.19.53.E09.1.454.CMB.2.raw
  modified_base (671)..(671): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcgttggtacagcctggctacggtccctgacgactcctccgtgtcgcacgcctcgtggtactttccacctttgattgtaatttatcgacctagtcgacctaacggtcggggtccccggacaaacggtcccgtaccggaagggggaacggggtcccgtggggaacggttcggggtacttacgtaggggttaatttagggttaggaaattagggtcgtacttaagttatacggtcctagttcggacggtactcgtgtaggaacggtccgtattccgacctactcctaccgaagaccgaaccaaaccgacctaaagaacccttcccgtagtacttacgacgaactaaaagttacgaaacgtacgttacgtaggaacgtagaccgtagggaaacgtaccgacgtaccgtttagtaacgtttacgacgtcgaaacgtacggtacggttaacncg

SEQ ID NO: 428685 - DNA, 541 bp, Homo sapiens
  misc_feature: GZ8MTXP02I4F6V.19.53.E09.1.454.CMB.2.raw
  modified_base (284)..(284): a, c, t, g, unknown or other
  modified_base (302)..(302): a, c, t, g, unknown or other
  modified_base (370)..(370): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttaattttaaaaggtgtccagtgtagaagtgcagctggtggagtcgtgggggagcttggtacagccgtggcaggtccctgagactctctgtgcagcctctggacttcacctttgatgattancgcatgcacgtgggccgnaagcctacgaggggacggctggagtggtctcgtaggtattaggtaggaatgtgctagtatacgctagngacgtactcgtgtaggaacgggcctattccactactcaccgagacgacaaacgccaaagacctcctagtactctagaacaaatcgaaactgtacagagtacgcgtaggacggtacacggtcttaggtattacgtaagtacgaacgtaaagggagtaacgtacgacgtaacg

SEQ ID NO: 428686 - DNA, 623 bp, Homo sapiens
  misc_feature: GZ8MTXP02FTOIL.19.53.E09.1.454.CMB.2.raw
  modified_base (252)..(252): a, c, t, g, unknown or other
  modified_base (277)..(277): a, c, t, g, unknown or other
  modified_base (586)..(586): a, c, t, g, unknown or other
tcagtactctcgtgcacgaccggtgctcgatttagagagagtgtgttggctctgggagaggagccccagccctgagattcccaggtgtttccattcagtgatcagcactgaacacagagactcacatggagttgagactgagctggtattttcctttggcttaattttaaaggtgtccagtgtgaagtgcagctggtggagtcgtgggggagcttggtacagcctggcaggtccctgagactctcctgtgcngcctctgattcactttgatgattangcctatgctacgtggggtcccgacaacgcctaccggaaggggaacgggtcctgggaggtcggggtctacgtagggttattagggttaggaaataggtgtcgttagtaactaggccctagtcggacggtacctgtggtaggaacggggtcctacttcaacccattcctacccgaagaacgaaccaaaccggaccaaaacgtaacccttccccgtagttactacctacgaaccaaaagttcggaaaactcgtacgaggaagacggtcgtaggaaccggaacgtaccggttcctttaaggtactttaccggnggtacgaacggtaaaggtaggtaactacggactaacg

SEQ ID NO: 428687 - DNA, 551 bp, Homo sapiens
  misc_feature: GZ8MTXP02F0RCD.19.53.E09.1.454.CMB.2.raw
  modified_base (299)..(299): a, c, t, g, unknown or other
  modified_base (364)..(364): a, c, t, g, unknown or other
  modified_base (525)..(525): a, c, t, g, unknown or other
  modified_base (543)..(543): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttggtacagcctggcacgtccctgagactctcctgtgcagcctctggattcacctttgatgattatgtcatgcacgtgggtccgnaagctccgaggggaggcctggagtgggtctcgaggtattagtgaatgtgctagtatagccttagnggcggtactcgtggtggaaacgggcccgtaattccaccattcctacccgaagaacgaaccaaaccgcccaaacgaaccctccctagtactctacgacaaaagtcgaaaactgtaccgtagaacggagcgtaggacggacgtacggtcctttagtattacgngtcgacgaagggagttanacgactag

SEQ ID NO: 428688 - DNA, 643 bp, Homo sapiens
  misc_feature: GZ8MTXP02JCXLB.19.53.E09.1.454.CMB.2.raw
  modified_base (640)..(640): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtgggggagcttggtacagcctggcaggtccctgagctctcctgtgcagcctctggattcactttgatgattatcgccagtcgctacgtcggggtccggactaagggcctaccggaaggggaacggggcccgtggggaggttccggggtacctacgtaagggttatttaggtacgggaaattcgggtgacgttaagtattacggtccttaagtcggaccggtaacttcgtaggtacgggaaacggggtccctaattccaaccgtatcccgtaccgaagaacggaacccaaaccggacccaaagtaacccttcccgttagtaactccgtagaactaaaagtgaaaccgtagttccgaggtagacgtcgaggaaacggcgtaaccggtcctttagtaacttacgtgtacgagtaaacgggacggttaanacg

SEQ ID NO: 428689 - DNA, 581 bp, Homo sapiens
  misc_feature: GZ8MTXP02HKEOU.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggaggcttggtacagcctggcaggtccctgagactctcctgtgcagcctctggattcacctttgatgattatgccatgcacgtcggggtccgacaaggcctacccgaggggaacgggccgtgggaggtggggtctcgaggtattaggtggaatagtgctagtatagcctatgcggtactcgtggtaggaagggccgtattccgacctatcctacccgaagaacgaaccaaaccgaccaaaacgtaacccttcccgtagtactcctagaacaaatagaaaccagtctagacgacgcgtaggaacggaccgtaacgggtcctttagtaactttaccgtaaggtcgaacgtaaaggggagttagacgacgtaacg

SEQ ID NO: 428690 - DNA, 632 bp, Homo sapiens
  misc_feature: GZ8MTXP02G5ZEV.19.53.E09.1.454.CMB.2.raw
  modified_base (289)..(289): a, c, t, g, unknown or other
  modified_base (389)..(389): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttattttaaaaggtgtccagtgtgaagtgcagctggtggagtcgtgggggaggcttggtacagcctggcaggtccctgagactctccgtgtgcagcctcgtggtacttcctacctttgatgtattangccatcgctacgtcggggtccgacgaacgccgtacccggaggggaacgggccgtaggggaggtcgggtctaccgtagggttatttaggtggaattaggtncgttagtatacgtcctagtcggacgtactcgtgtacggggaaacgtccgattccgaactgtcctacgaagacgaaccaaacgccaaaagacccttcccgtattacgtactagaacctaaagtacgtaaactagttcaggaacggaagccgtaagggacgtaaaccggcggttacccgtttaggtaacttttaccgggtaaggtaacggtaacggtaaacgggtagtaacgtacggacgtaacg

SEQ ID NO: 428691 - DNA, 533 bp, Homo sapiens
  misc_feature: GZ8MTXP02FU6TZ.19.53.E09.1.454.CMB.2.raw
  modified_base (330)..(330): a, c, t, g, unknown or other
  modified_base (507)..(507): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggaggcttggtacagcctggcaggtccctgagactctcctgtgcagcctctggattcacctttgatgattatgccatgcacgtgggtccgacaagctccgagggagggcctggagtggtcncgaggtatagtgaatagtgctagtatagtcctatgcggactcgtggtagaaggggcctaattccgaccatcctacccaggaacaccaaaccggcccaaaataacccgtccctagtactctagaacaaaatgaaactagtcgtagagaagctaggacgacacggtccttagattacgngtagacgaaggagtaagacgactaag

SEQ ID NO: 428692 - DNA, 670 bp, Homo sapiens
  misc_feature: GZ8MTXP02GYE8V.19.53.E09.1.454.CMB.2.raw
  modified_base (304)..(304): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttccttttggcttaattttaaaaggtgtccagtgtgaagtgcagcgtggtggagtcgtgggggagtcgttggtacagccgtggcacggtccctgagacctctcctgtgcacgcctctggacttcacctttgatgtatttancgacctatgcctacggttcggggtacccggacaaacgccgtaaccggaagggggaacgggtccgtaggggtaggttcggggtctacgtaagggttagtttacggtaggtaaagtggtgtactaaggtatcgtacctagtcggtacgtacttcgtagtacgggaacgggtcccgtattaccacgtacttccacccgaaggaacgaaccgaaaccgcccgaaaacgtaaccctccccgttagtaaccttcgaacgaaactaaagtacgaaaccgtagtccgtaaggaggaacgtcggtaggaaacggcgtaaccgggtcctttaggtaaccttcgtacggtacgaacgtaaaggggtaggtactaacg

SEQ ID NO: 428693 - DNA, 503 bp, Homo sapiens
  misc_feature: GZ8MTXP02HRGKF.19.53.E09.1.454.CMB.2.raw
  modified_base (270)..(270): a, c, t, g, unknown or other
  modified_base (292)..(292): a, c, t, g, unknown or other
  modified_base (309)..(309): a, c, t, g, unknown or other
  modified_base (325)..(325): a, c, t, g, unknown or other
  modified_base (336)..(336): a, c, t, g, unknown or other
  modified_base (398)..(398): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagcttggtacagcctggcaggtccctgagactctcctgtgcagccctntggattcacctttgatgattangccatgcagtggtccgnaagctcgagggacgcnggagtcggtcngaggtattagtggaatcgtgactagtatagctatcggcgactgtgagacgggcatcacatcncagacgacaacgacaagaacctccctagtactcagacaaaatcgaacagtacgacgagagacagagacgacgaccgtagtaattactacgtcgagaggagtagag

SEQ ID NO: 428694 - DNA, 606 bp, Homo sapiens
  misc_feature: GZ8MTXP02GVFWH.19.53.E09.1.454.CMB.2.raw
  modified_base (187)..(187): a, c, t, g, unknown or other
  modified_base (415)..(415): a, c, t, g, unknown or other
  modified_base (526)..(526): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggcttaattttaaaggtntccagtgtagaagtgcagcgtggtggagtcggtgggggagtcgttggtacagccgtggctacggtccctgacgtactctcctgtgcacgcctctggtacttcctacctttgatgtatttagtcgcctatcgctacggtcggggtccgcaagccgtaccggaggggacggccgtgggagtcgggtctgtaggtagttagtagaagtgtcgtacttagtatacgtctagngccgatgtgaggacggcctatccactgtccacgagaacgacgaaaccgaccgaaacgtaccctcctagtaacctctacgaacaaatacgaactagtaccgtaggagtacgngtaacggacggaccgtacggtttacctttaaggtaactttacggtaggtaccgaaaggtaagggtaaccggtataaccgg

SEQ ID NO: 428695 - DNA, 578 bp, Homo sapiens
  misc_feature: GZ8MTXP02IVDEG.19.53.E09.1.454.CMB.2.raw
  modified_base (266)..(266): a, c, t, g, unknown or other
  modified_base (288)..(288): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaggtgtccagtgtgaagtgcagctggtggagtcgtgggggagcttggtacagcctggcaggtccctgagactctctgtgcagcctntggattcacctttgatgattangccatgcacgtgggtccgcaagctcgagggaggcctgggagtgggtctcgaggttattaggtggaatggtgcttaggtatacgcctagtcgcgggtactcgtgtaggaaggggcccgtatttcccgaacctatcctaccagacgaccaacgaccaagaaccttcccgtagtaactctaggacctaaaagtcgaaactcgtcgtaggacgaacggtcgtaggaacgggtaccgtaacgggtccctttaggttaacgttacgtggttacgacgtaaaggaggttagtaacgg

SEQ ID NO: 428696 - DNA, 570 bp, Homo sapiens
  misc_feature: GZ8MTXP02HCTUN.19.53.E09.1.454.CMB.2.raw
  modified_base (260)..(260): a, c, t, g, unknown or other
  modified_base (280)..(280): a, c, t, g, unknown or other
  modified_base (300)..(300): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagcctggcaggtccctgagactctcctgtgcagcctntggattcactttgatgattntgccatgcacgtgggtccgnaagctccgaggggaaggcctgggagtgggtctcgtaggtattaggtggtaatagtgctagtatacgtcctatcggcggtactcgtggtacggaacggggtccgtaattcccgaccctagtccctaccgaagacgaaccaaacggacccaaaggtaacccttcccgtagtactcgtagaaccaatagaacaggttcagagacgctaggacggacgaccggtccttagttacttacgtggcgtaacgaaggtaggttaacacggactaacgg

SEQ ID NO: 428697 - DNA, 587 bp, Homo sapiens
  misc_feature: GZ8MTXP02F51S7.19.53.E09.1.454.CMB.2.raw
  modified_base (306)..(306): a, c, t, g, unknown or other
  modified_base (383)..(383): a, c, t, g, unknown or other
  modified_base (407)..(407): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggaggcttggtacagccgtggcaggtccctgacgactctcctgtgcagcctctggattcacctttgatgattatcgcatgcacgtgggtccganaacgctaccgaggggacggcctggagtggtctcgagtagttagtagaatagtgcgtagtatagcctagtgcgactcnggtaggaacgggccattccacctntcctacaagacacgaaaccgccaaaagtaaccctcccgtagtaactctacgaacaaacgttacgaaaacgtgtacgtaggaacgtaacggcgttaggaacggtaaccgaacggtttccttaaggttaactttacgtgtacggaaacgtaaaggggtagtaaacgtacggacgttaaccgg

SEQ ID NO: 428698 - DNA, 608 bp, Homo sapiens
  misc_feature: GZ8MTXP02F66ZY.19.53.E09.1.454.CMB.2.raw
  modified_base (284)..(284): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggaggtcttgggtacagcctggcaggtccctgagactctcctgtgcagcctctggattcactttgatgattangccatgcacgtggccgacaagctaccgagggacggcctaggagtggtctcgaggttatagtggaatgtgctagtatagcctagtcgcggtatgtaggtagaacgggtccagttccaaccgattccacgagacgaccaaacggcccaaaagtaccctcccgtagtactccgtacgaactaaacgtacgaaacctagttcgtaggaacggaacgtccgtaaggaaacgggtaaacccgaaccggggttcctttaaaggtaactttaccgtaacgggttacgaaaacgggtaaaacggggtaagtttaaacgacgggacctaacggg

SEQ ID NO: 428699 - DNA, 638 bp, Homo sapiens
  misc_feature: GZ8MTXP02GTYC4.19.53.E09.1.454.CMB.2.raw
  modified_base (307)..(307): a, c, t, g, unknown or other
  modified_base (340)..(340): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagtcttggtacagcctggcaggtccctgagactctctgtgcagcctctggattccacctttgatgtattatgcctatgcacgtcggggtccgnaacgctccgaggggacggcctgggagtgggtcncgtaggttatttaggtaggaataggtgtcgtaagttatacggccttaagtcggacggtacttcgtggtaacggaacggggaccctattcccgaacctaactccgtaacccgaaagaacgaaccaaaccggaccctaaaagtaaccccttcccgtagtaacttccgaacgtaacaaaagttcggaaacacgttacgaggggaaagacggtcgtagggaaaccggtaccgtaccggttacctttaagttaacttacgtggtaacgaacgggtaaagggtacgtaagtaccggacgtaacg

SEQ ID NO: 428700 - DNA, 588 bp, Homo sapiens
  misc_feature: GZ8MTXP02IC33D.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggctattttaaaaggtgtccagtgtgaagtgcagctgggtggagtcgtgggggagcttggtacagcctggcaggtccctgagactctcctgtgcagcctctggattcacctttgatgattatgccatgcacgtcgggtccgcaagcctccgaggggaacgggccgtagggaggtgggtctcgagggttattaggttaggaattaggtgtcgtagttaatacgtaccttaagtcggcgtacttcgttggaggtaacggggcctattcccaacctattcctaccgaaggacgaaccgaaaccgtacccgaaagaacccttccctagtactctagacaaatgaaactgtctagacgagcgtaggaacggaccgaaccggtccttaggttacttacgtggtacgaacgtaaaggggagttacaggacaacgg

SEQ ID NO: 428701 - DNA, 545 bp, Homo sapiens
  misc_feature: GZ8MTXP02FHKDV.19.53.E09.1.454.CMB.2.raw
  modified_base (298)..(298): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctatttaaaaggtgtccagtgtgaagtgcagctggtggagtcgtgggggagcttggtacagcctggcaggtccctgagactctcctgtgcagcctctggattcacctttgatgattatgccatgcacgtgggtccgnaagctaccgaggggacggcctggagtgggtctcgtaggttataggttaggaatagtgtctagtatagcctatgcgatctgtagacggcatccacatcaccagacgacaaacgccaaagtaaccctccctagtactctacgacaaagtagaacagtcgtagaaggacgactagggaacggaccgtacgggtccctttaggtaactttaacgtggtacgacgaaaggggtagttaagacggacgtaacg

SEQ ID NO: 428702 - DNA, 681 bp, Homo sapiens
  misc_feature: GZ8MTXP02JEA9Z.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagtcgttggtacagccgtggcacggtccctgacgactctccgtgtcgcacgcctcgtggtactttcctaccttttgatgtaatttatcgcctatcgcctacggtcggggtcccggacaacgccgtaccggaaggggacgggccgtaggggtacggtcgggtctcggtaaggttagtttaggttaggaattggtgtacgtagttatacgtacctagtcggaccgtattcgtagggtacggaacggggtccctacttcccaccgtacttccgaccgaagaacgaacccgaacgacccaaagtaccctccgtagtactcgtacgaactaaagtcgaaactgtacgtaggaaacgacgtaccgtaagggaaccgggtaccgtaaccgggttccgttttaagtaacgtttacggtacgggttaacggaacggtaaaacggggttaggtttaacgtaaccggg

SEQ ID NO: 428703 - DNA, 538 bp, Homo sapiens
  misc_feature: GZ8MTXP02FF2AB.19.53.E09.1.454.CMB.2.raw
  modified_base (252)..(252): a, c, t, g, unknown or other
  modified_base (339)..(339): a, c, t, g, unknown or other
  modified_base (473)..(473): a, c, t, g, unknown or other
  modified_base (508)..(508): a, c, t, g, unknown or other
tcagtactctcgtgcacgaccggtgctcgatttagagagagtgtgttggctctgggagaggagccccagccctgagattccaaggtgtttccattcagtgatcagcactgaacacagaggactcaccatggagttgagactgagctggtattttccttttggctaattttaaaaggtgtccagtgtgaagtgcagctggtggagtcgtgggggagcttggtacagcctggcaggtccctgagactctcctgngcagcctctggattcacctttgatgattatgccatgcacgtggggtccgcaagcctccgaggggaacgggcctggggagtggggtcncgaggtataggttggaatgtgctaagtatagcctatgccggatcgtgtggaaggggcattccacatctaccagacgacaaacgccaaaagacctccctagtactctagacaaaagtgaacagtctaggagacgntaggacggaacacggtacctttagtaactttacgngtacgacgaaaggtaggtaatacgcgaacg

SEQ ID NO: 428704 - DNA, 634 bp, Homo sapiens
  misc_feature: GZ8MTXP02IQ09J.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaaggtgtccagtgtgaagtgcagctgggtggagtcgtgggggagcttggtacagcctgggcaggtccctgagactctcctgtgcagcctctggattcacctttgatgtattatgccatcgcacgtggggtcccggacaagcctacccgaaggggaacgggcccgtaggggtaggtcggggtctaccggaagggttatttaggttaggaattaggttgccgttaagtaatagccttagtcggcggtactcgtgtacggaaggggccgtattccgacctagttccaccgaagacgaaccgaaaccgaaccgtaaacgaacccttacccgtagttaactacctacgaactaaaagttacgaaacgtacgttcgagaacggtaacgccgtagggacggaaccgtaccggtcccgtttagtaacttaccgttgacggtaacgaaacgggtaggtaactacggactaacgg

SEQ ID NO: 428705 - DNA, 691 bp, Homo sapiens
  misc_feature: GZ8MTXP02H9OXU.19.53.E09.1.454.CMB.2.raw
  modified_base (259)..(259): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagcgttggtacagccgtggcacggtccctgagactctcctgtgcngcctctggtacttctacctttgatgtattatcgcctatcgctacggtcggggtccggacaacggtccgtacggaaggggaacgggccgtaggggacggtcggggtctacgtagggtttaagtttagggttagggtaaattacggttagtacgttaagttaagtaccgtaccttagtcggacggtactcgtggagggaaacgggtcctaacttcccgaacctacttccaccgaaacggacgaaccgaaacccgaacccgtaaaacgtaacccgttacccgttagttactacctacggaaacctaaaagttccgaaaacgtacggtaccgtaggtaaacggacgtcggttaagggaacggtaacccggtaccggttaccgttgtttaaccggttagtcggtaagaacgtaaggggtaagtacgtacgaccacgg

SEQ ID NO: 428706 - DNA, 649 bp, Homo sapiens
  misc_feature: GZ8MTXP02I3RYZ.19.53.E09.1.454.CMB.2.raw
  modified_base (276)..(276): a, c, t, g, unknown or other
  modified_base (646)..(646): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggaggtcgttggtacagccgtggcacggtccctgacgactctcctgtgcagcctntgtcttcctacctttgatgtattatcgcctagtcgctacggtcggggtcccggacaacggtcctaccggaaggggaaacgggtccgtaggggtacggttcggggtctacggtaggtttagtttaggttaggtaagttacggtgtactaagttagtacgtaccgttagtcggacgtacttcgtaggtacggaacgggtcctattccaacgtactccgacgagaacgaaccgtaaccgaccctaaacgtaacccctcccgttaagtacctacgttacgaaactaaagtacgaaactacgtcgaagacgtacgacgtagggaacgtaccgacggtcctttaggtaacttcgacgtacgaagtaaggtacgtanacg

SEQ ID NO: 428707 - DNA, 680 bp, Homo sapiens
  misc_feature: GZ8MTXP02I3SJ9.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagcgtgggtgggagtcgtgggggaggtcgttggtacaggcctggcacggtccctgagactctcctgtgcacgcctctggacttctacctttgatgtatttatgcctatcgcctacggtcggggtcccggacaacgccgtaccggaagggggaacgggtcccgtaggggtacggttcggggtacctacggtagggttaagttttaggttagggtaaattgggttagtacgttaaggttagtacgtaccttaagttcgggaccggtaacttcggtaggtacgggaacggggtcccgtaatttcccgaacctacttccctaccgaaggaacgaaacccgaaaccgacccaaaagtaaccccttccgtagtaactccgtagaacctaaaagtcgaaaactgtactaggagacgtcgtagggaacgacaccggttctttaggttaacttcgtaggtacgacgtaagggacgttaagtaacg

SEQ ID NO: 428708 - DNA, 526 bp, Homo sapiens
  misc_feature: GZ8MTXP02HFUBH.19.53.E09.1.454.CMB.2.raw
  modified_base (280)..(280): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattangccatgcacgtgggtccgcaagctccgaggggaggcctggagtgggtctcgaggtattagtggaatgtgctagtatagcctatgcgtactcgtgtggaagggccgtattcacatctccgagacgacaaacgccaaagacctccctagtactctgacaaatgaaacagtactagaacgtagctaggacggactaccgggtcttaggtaattacgtggtacgacaaaggggtgtaagtacgctaacgg

SEQ ID NO: 428709 - DNA, 603 bp, Homo sapiens
  misc_feature: GZ8MTXP02JGC4I.19.53.E09.1.454.CMB.2.raw
  modified_base (263)..(263): a, c, t, g, unknown or other
  modified_base (308)..(308): a, c, t, g, unknown or other
  modified_base (576)..(576): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctattttaaaaggtgtccagtgtgaagtgcagctggtggagtcgtggggggagtcgttggtacaggcctggcaggtccctgacgctctcctgtgcagtcctntggtacttcacctttgatgtattatgccatgcacgtgggtccganaacggctaccggaggggacggccgtagggacggtggggtctacgtagggttagtttaggtaggtaattaggtcgtacgttaagtagtacgcccttaagtcggaccgggtactcgttaggtacgggaacggggtcctagttccaacctacttcgtaccgagaaccgaacaaaccgaccgaaaacgtaaccctcccgtagtactacctagaactaaagtcgaaactgtactagagtagcgtaggacgacgacggtccttagtacttacgngtacgtaacgaggtgtatacggctacg

SEQ ID NO: 428710 - DNA, 708 bp, Homo sapiens
  misc_feature: GZ8MTXP02IZMRW.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagcgtggtggagtcggtgggggagtcgttggtacagccgtgggcacggtccctggacgaccttcctcctggtcgcacgtccctgtggtacttacctaccgttttgattgtaatttagtcgacctagtcgaccgtacggtcggggtacccgacaaacgtccgtaccggaagggggaaccggtccgtaggggtacggtcgggtcctaggtaaggttagtttaggttaggtaattggtgtacgttaagttaacgtacgtaccttagtccgggacggtacttcggttagggtaacgggaacgggtcccgtacttcccaacctacttacccgaccgaaagaaccgaaaccaaccgaacccgtaaacgtaacccctccgtataactccgagaaacctaaagttcgaaaactcgtactaaggacgacggtacgagggaaacggaccgtaccgggttccttagttaacgttacggttaggaccggtaaggtaaagggtacggttaataccgg

SEQ ID NO: 428711 - DNA, 637 bp, Homo sapiens
  misc_feature: GZ8MTXP02JCYUI.19.53.E09.1.454.CMB.2.raw
  modified_base (271)..(271): a, c, t, g, unknown or other
  modified_base (298)..(298): a, c, t, g, unknown or other
  modified_base (322)..(322): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtagaagtgcagcgtggtggagtcgtgggggagtcgttggtacagccgtggcgacggtccctgacgactctcctggtgcacgcctntggtacttctacctttgatgtaattangccatcgctacgtcgggtcccganaacgccgtaccgaggggaacggccgtaggaggtcgggtctacggtaggttagttagttaggtaaattacgtgtacgttagtaatacgtaccttaagtcggaccggtacttacgtggtaacggaaacggggtccctagttacccactacgtccctaaccgaagaacgaacccgaaaccgtaccaaacgtaacccttcccgtagaacttcaagtaacaaagtcgaaactgtacagaagtactcgagaaacggactaccggttccttaggttacttaacggtgtacggaacggaagggtagtaacgtagaaccgtacg

SEQ ID NO: 428712 - DNA, 572 bp, Homo sapiens
  misc_feature: GZ8MTXP02I2231.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagtcttggtacagccgtggcaggtccctgagctctcctgtgcagcctctggacttcactttgattgattatcgcatgcacgtgggtccgcaagcctccgagggacggcctggagtggtctcgagttattagtggaatgtgcttaagtatacgtcctatcggcggtactcgtggtaggaacggggccgtattccgacctactctaccgaagacgaccaaaccggaccaaacgtaaccctttcccgtattactacctacgaacctaaaagtcgaaaacgtcgtactaggaagtacgcgtaggacggaactcgggtccttagtacttagtgtagacgaaagggtaggtatacggactaacgg

SEQ ID NO: 428713 - DNA, 561 bp, Homo sapiens
  misc_feature: GZ8MTXP02JXAVN.19.53.E09.1.454.CMB.2.raw
  modified_base (294)..(294): a, c, t, g, unknown or other
  modified_base (468)..(468): a, c, t, g, unknown or other
  modified_base (536)..(536): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttccttttggcttattttaaaaggtgtccagtgtgaagtgcagctggtggagtcgtgggggaggtcttggtacagcctggcaggtccctgagactctcctgtgcagcctctggattcacctttgatgattntcgccatgcacgtggggtccgcaacgcctaccgaggggaaggccgtgggagtgggtctgaggtattagtggaatgtgctagtatgctatgcgactcgtgtaggaacgggtcctattccacctatcctaccaagacgacaacgaccaagaacctccgtagtactctagacaaaancgtaaacagtcgtagacgtaggacgtaggaacggaccgacgggtccttaggttaacttacgttacggngtaaccggaaaggtacggtaatacg

SEQ ID NO: 428714 - DNA, 511 bp, Homo sapiens
  misc_feature: GZ8MTXP02H5EUF.19.53.E09.1.454.CMB.2.raw
  modified_base (279)..(279): a, c, t, g, unknown or other
  modified_base (298)..(298): a, c, t, g, unknown or other
  modified_base (434)..(434): a, c, t, g, unknown or other
  modified_base (490)..(490): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttggtacagcctggcaggtccctgagactctcctgtgcagcctctggattcactttgatgattangccatgcacgtgggtccgnaagctccgagggacggcctggagtgggtctcgaggtattagtgaatgtgctagtatagcctagtcgcggtactcgtggtagaaggggcctattccaccatctaccagacgacaaacgtaccaaagacctcctgtanctagacaaagtgaacagtcagagaggctaggacggtacacggtcttagtacttacngtgacgaaggagtacagcaag

SEQ ID NO: 428715 - DNA, 632 bp, Homo sapiens
  misc_feature: GZ8MTXP02JLWA7.19.53.E09.1.454.CMB.2.raw
  modified_base (608)..(608): a, c, t, g, unknown or other
  modified_base (627)..(627): a, c, t, g, unknown or other
tcagtactctcgtgcacgaccggtgctcgatttagagagagtgtgttggctctgggagaggagccccagccctgagattcccaggtgcttccattcagtgatcagcactgaacacagaggactcaccatggagttgagactgagctggtattttcctttggcttattttaaaaggtgtccagtgtgaagtgcagcgtggtggagtcgtgggggagtcgttggtacagcctggcaggtccctgagactctcctgtgcagcctcgtggtacttcctacctttgatgtattatgcctatcgcctacggttcggggtccggacgaaacggtcccgtacccggaagggggaaacgggtcccgttaggggacggttcggggtccccgttacgtaagggtttaagtttagggtttaggaaaagttgtgtaccttaaggttagtacgtaccgttagtcggacgggtacctgttaggtacgggaacgggtcctaattccacctattcgaccagacgaaccaccgacaaagtaccctccgtagtaactcctagaaactaaatcgaaactagtacgagaacgcgactaggacgaaccgacggtcctttagtaaccttgnggtacgagaaggtcttaancgacg

SEQ ID NO: 428716 - DNA, 588 bp, Homo sapiens
  misc_feature: GZ8MTXP02GME1P.19.53.E09.1.454.CMB.2.raw
  modified_base (273)..(273): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttccttttggcttaattttaaaaggtgtccagtgtgaagtgcagctggtggagtcgtgggggagcttggtacagcctggcacggtccctgagactctcctgtgcagcctntggattcacctttgatgattatcgccatgcacgtgggtccgcaacgctccgaggggaacggccgtgggagtcggggtctacgtaggttatttaggttaggaattggtgacttagttatagccttagcggcggtacttcggtgtacgggaagggtcccgtacttaccacctatcctacccgaagacgaaccaaaccgccaaacgaacccttccctagtactctacgaactaaaatgaaacagtacgtaggacgagcgtaggacgtaccgacggtccttagtaacttcgtgtacgacgaaagggtacgttagtaacg

SEQ ID NO: 428717 - DNA, 551 bp, Homo sapiens
  misc_feature: GZ8MTXP02IMVB5.19.53.E09.1.454.CMB.2.raw
  modified_base (282)..(282): a, c, t, g, unknown or other
  modified_base (287)..(287): a, c, t, g, unknown or other
  modified_base (302)..(302): a, c, t, g, unknown or other
  modified_base (325)..(325): a, c, t, g, unknown or other
  modified_base (354)..(354): a, c, t, g, unknown or other
  modified_base (474)..(474): a, c, t, g, unknown or other
  modified_base (522)..(522): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagcctggcaggtccctgagactctcctgtgcagcctctggattcacctttgatgattangccangcacgtgggtcccgnaagctccgaggggacggcctggngtggtctcgaggttattaggtgaatggtncgtagtatagcctagtggcggtactcgtgtaggaacgggccgtattcccgaccattcctacaaggacgaacaaaccgacccaaaagtaccctccctagtactcgtagacaaagtgaaacngtactagaagacgctaggacggtaccacggttccttagttacttacgngtacgaacgaaggtagtatacggactagg

SEQ ID NO: 428718 - DNA, 551 bp, Homo sapiens
  misc_feature: GZ8MTXP02ILV8I.19.53.E09.1.454.CMB.2.raw
  modified_base (299)..(299): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggcttattttaaaggtgtccagtgtgaagtgcagctggtggagtcgtgggggagcttggtacagcctggcaggtccctgagactctcctgtgcagcctctggattcactttgatgattatgccatgcacgtcgggtccgnaagcctccgaggggacggcctggagtgggtctcgagtagttagtggaatagtagagtacgtatagacctagtgcggtactcgtagtggaaacggcgattccacatctaccgaagacgaacaaaccgccaaaacgaacctccctagtactactacgacaaagttcgaaacagttcagaagactcggagacgggaaccacgggttcccttagttactttaacgtgtacgacggaaaggaggtagtacgagtacg

SEQ ID NO: 428719 - DNA, 512 bp, Homo sapiens
  misc_feature: GZ8MTXP02FQ0RT.19.53.E09.1.454.CMB.2.raw
  modified_base (291)..(291): a, c, t, g, unknown or other
  modified_base (455)..(455): a, c, t, g, unknown or other
  modified_base (508)..(508): a, c, t, g, unknown or other
tcagtactctcgtgcacgaccggtgctcgatttagagagagtgtgttgggtttggggatctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgatttangccatgcactggggtccgcaagctccgagggaagggcctgggagtggggtctcaggtattagtggaatgtgctagtatagctatgcggactcgtgtggaagggccgtatcaccatctccagagaacaacgccaagaacctccctgtactctgacaaatgaaacngtctgagagctgacggacacggccttagtaattacgtgtgactaaggagttanaacg

SEQ ID NO: 428720 - DNA, 519 bp, Homo sapiens
  misc_feature: GZ8MTXP02IZRPG.19.53.E09.1.454.CMB.2.raw
  modified_base (242)..(242): a, c, t, g, unknown or other
  modified_base (298)..(298): a, c, t, g, unknown or other
  modified_base (367)..(367): a, c, t, g, unknown or other
  modified_base (454)..(454): a, c, t, g, unknown or other
  modified_base (462)..(462): a, c, t, g, unknown or other
  modified_base (507)..(507): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaggtgtccagtgtgaagtgcagctggtggagtctgggggagcttggtacaggcctggcaggtccctgagactntcctgtgcagcctctggattcacctttgatgattatgccatgcacgtgggtccggnaagctacccgaggggaaggcctggagtgggtctcgaggtattagttggaatgtgctagtatagcctagngcgactcgtgtggaagggccgattcgaccatctccagacgacaaacgccaaagtaaccctcccttagtatctacgacaaatgaaacngtactganaggctaggacggacacggtcttacgtattacgtgtcgacgaaggngtactagactag

SEQ ID NO: 428721 - DNA, 523 bp, Homo sapiens
  misc_feature: GZ8MTXP02IT6GN.19.53.E09.1.454.CMB.2.raw
  modified_base (300)..(300): a, c, t, g, unknown or other
  modified_base (407)..(407): a, c, t, g, unknown or other
  modified_base (446)..(446): a, c, t, g, unknown or other
  modified_base (495)..(495): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtgggggagcttgggtacagcctggcaggtccctgagactctcctgtgcagcctctggtattcacctttgatgattatgccatgcacgtgggtccgnaagcctccgagggaagggcctgggagtggggtctcgtaggtattagtggaatgtgctagtatagcctatgcgtactcgtgtagaagggcgattcacatcgccaaganacaaacgccaaagaacctcctagtactctagacaaagtnaaactagtactgaagtcgactaggacggacacggtccttagtacttagngtagacgaggtaaggtactagacgtaag

SEQ ID NO: 428722 - DNA, 573 bp, Homo sapiens
  misc_feature: GZ8MTXP02GX1TX.19.53.E09.1.454.CMB.2.raw
  modified_base (328)..(328): a, c, t, g, unknown or other
  modified_base (345)..(345): a, c, t, g, unknown or other
  modified_base (452)..(452): a, c, t, g, unknown or other
  modified_base (559)..(559): a, c, t, g, unknown or other
  modified_base (570)..(570): a, c, t, g, unknown or other
tcagtactctcgtgcacgaccggtgctcgatttagagagagtgtgttgggtttggggaggcttggtacagcctggcaggtccctgagactctcctgtgcagcctctggattcacctttgatgattatgccatgcactgggtccgcaagctccgagggaaggcctggagtgggtctcgaggtattagttggaatagtgctagtatagcctatgcggactcgtgtgaagggccattcaccatctcagagacaacgccaagactcctgtatctagacaaatgaacagtcagagagctgaggacacggctttgtattactgtgacaaagggngtaatagcagtcttagnggtaacgacgtacgtcgggggaccctaaggggaacccctggtaccacccgtctccctacgacgccctaccaacccgaacgggccctacgtccggtcccttcccccgnggcccgcccgtacgcctaccgaggacgccaaccgtccgagacgacacgacgtccgccgtcgggctcgcctggtaccgaacggacctacgtaccaacgacgacgtacngacggcggacncgg

SEQ ID NO: 428723 - DNA, 628 bp, Homo sapiens
  misc_feature: GZ8MTXP02IHQ6A.19.53.E09.1.454.CMB.2.raw
  modified_base (282)..(282): a, c, t, g, unknown or other
  modified_base (286)..(286): a, c, t, g, unknown or other
  modified_base (302)..(302): a, c, t, g, unknown or other
tcagtactctcgtgcacgaccggtgctcgatttagagagagtgtgttggctctgggagaggagccccagccctgagattcccaggtgtttccattcagtgatcagcactgaacacagagactcaccatggagttgagactgagctggattttccttttggcttaattttaaaaggtgtccagtgtgaagtgcagctggtggagtcgtgggggaggcttggtacagcctggcaggtccctgagactctcctgtgcagcctctggatcactttgatgatttacngcangcacgtcgggtccganaacgcctaccggaaggggacggccgtagggaggtggtctcgtaaggttagttaggtaggaattaggtcgtgttaagtaacgttacgtaccttagtcggtacgtacttgtaggtaggaaacggggtctacgttacccacccgtacttacgaccgaaagacgaaccgaaaccgtaaccaaacgtaacccttcccgtagttactaccgtacgaactaaaagtacgaacgtacgtacgtagtagacgtacgtacggacgtacggtaccggtaccgttacgttacgttacgttaacgtacgtacgtaacggtaaggtacgtacgacgtacg

SEQ ID NO: 428724 - DNA, 572 bp, Homo sapiens
  misc_feature: GZ8MTXP02F1UA9.19.53.E09.1.454.CMB.2.raw
  modified_base (538)..(538): a, c, t, g, unknown or other
  modified_base (563)..(563): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttggtacagcctggcaggtccctgagactctcctgtgcagcctctgattcactttgatgattatgccatgcacgtgggtcccggctaacgctacccgaggggaacgggtccgtagggagtggggtctaccgaggttagttagtaggtaatagtgtcgtagtatagtcctagtgcgtactcgtggtagaagggccgtattcgacctatcctaccgaagaacgaacaaaccgaccaaagtaaccctccctgtaactactacgaactaaagtcgaaaacgtgtacagagtaagcgtaggacggaccacggtccttaggttacttagnggttagacgaaaaggggtagttaanacggactag

SEQ ID NO: 428725 - DNA, 545 bp, Homo sapiens
  misc_feature: GZ8MTXP02JD13K.19.53.E09.1.454.CMB.2.raw
  modified_base (234)..(234): a, c, t, g, unknown or other
  modified_base (315)..(315): a, c, t, g, unknown or other
  modified_base (344)..(344): a, c, t, g, unknown or other
  modified_base (365)..(365): a, c, t, g, unknown or other
  modified_base (381)..(381): a, c, t, g, unknown or other
  modified_base (524)..(524): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtgagtcgtgggggagcttggtacngcctggcaggtccctgagactctctgtgcagcctcgtggacttcactttgatgattatgcctatcgctacgtgggtccganacgctcgagggaggcctggagtcgggtcncgaggtattagtaggaatgtnacgtagtatcgctagngacgactcgtgacggaagggtcctattccacattccgccaagaacgaccaaaccgaccaaacgaccttcccgtagtaactccgtagaactaaagtgaaactgtataggagagcgtaggacgacgacggtcttagaattcgtgngtaacgaggtacggtatacgg

SEQ ID NO: 428726 - DNA, 654 bp, Homo sapiens
  misc_feature: GZ8MTXP02HW10N.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttaattttaaaaggtgtccagtgtgaagtgcagctggtggagtcgtgggggaggcttggtacagccgtggcacggtccctgagacctctcctgtgcacgcctcgtggattccacctttgattgtattatgccatcgccacgttcggggtcccggacaacggccgtaccggaaggggtaacggggcccgtggggacggtggggttcctaccgtagggtttaagtttaggttagggtaattaggtgtcgttagttaatacgtccttaagtcggacgtactcgtaggtacggaacgggccgtacttccgacctacgtcctaccgaagacgaaacccaaaccggtacccaaaaggtaacccttcccgttagttactccgtagaacctaaagttacgaaactaggtcctaggacgtacgacgtagggaacggaccgacggttccgttagtaacttcgtaaggtacggaacgtaagggagtacgtacgtacgaacg

SEQ ID NO: 428727 - DNA, 622 bp, Homo sapiens
  misc_feature: GZ8MTXP02GLAO3.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttcctttggcttaattttaaaaggtgtccagtgtgaagtgcagctgggtggagtcgtgggggagtcttggtacagcctggcaggtccctgagctctcctgtcgcagcctctggtattctactttgatgtattagtcgcctatcgctacgtcggggtacccgacaacgccgtacggaaggggaacgggtccgtaggggaggtgggtactcgtaggtatttaggtggtaacttggtgcgttagtatacgtcctagtcggcggtactcgtaggtaggaacggggtcctattaccgacctacgttcctaccgaaagacgaaccgaaaccgaccaaacgtacccttcccgtagtactaccgtagaactaaagtacgaaacgtgtacgtagacgtacgtcgtaggacggtaccgtacggtcccgtttagtacgttaagtggtacgaacgtaaagggtaggtacgtacgacgtacg

SEQ ID NO: 428728 - DNA, 644 bp, Homo sapiens
  misc_feature: GZ8MTXP02G3GLQ.19.53.E09.1.454.CMB.2.raw
  modified_base (601)..(601): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttattttaaaaggtgtccagtgtgaagtgcagctggtggagtcgtgggggagcttggtacagcctggcaggtccctgagctctcctgtgcgcctcgtggacttctaccttgatgattatgccatcgcacgtcgggtccggacaaggcctccggaaggggacggccgtgggagtgggtctcgagggttattaggtaggaattaggtgtacgtagtatacggtaccttagtcgaccggtactcgttaggggtaaggaaccggggtccctaatttcccgaaacccttacttcccgaacccggaaggaacccgtaaaacccaaaccggaacccaaagtaaaccccttcccgttagtaactccgtaagaaacctaaaatcggaaaactggttcaggaacgacgtcgtaggaacggtaccacgggttccttaggtaactttacgngtaacggagtaaaagggggtactataaccggcacgttacccgg

SEQ ID NO: 428729 - DNA, 572 bp, Homo sapiens
  misc_feature: GZ8MTXP02JM9JW.19.53.E09.1.454.CMB.2.raw
  modified_base (262)..(262): a, c, t, g, unknown or other
  modified_base (281)..(281): a, c, t, g, unknown or other
  modified_base (372)..(372): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagtcgttggtacagccgtggcaggtccctgagactctcctgtgcagcctntgattcactttgatgattntcgccatgcacgtgggtccgcaagctaccgagggacggcgtgggagtggtctcgtaggtattaggtgatagtgcgtagtatacgccttagngcgtactcgtgtaggaacggcacgttccacctatctaccagaacgaccaaacggaccaaagtaaccctccgtagtactactacgaacaaagtcgaaactagtacgtagaacggacgtcgaggaacggaccgacggttccttaggttacttaacggttggtacggtaacgtaaacggggaagttagtaacggacgtaacgg

SEQ ID NO: 428730 - DNA, 740 bp, Homo sapiens
  misc_feature: GZ8MTXP02HYVHK.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggaggcttggtacagccgtggcacggtccctgacgactctcctgtgcagcctgtggacttcacctttgatgatttatgcctagtcgctacgtggggtccggacaacggccgttaccggaaggggaacgggtcccgtaggggtacggttccggggtcgtaccgtaagggttaagttttaggttagggtaaattagggtcgtaacgttaaggttacgttaacgtacccgttaagttcgggaccgggttaaccttcggtagggttacggggaaacggggtccccgttaaattccccaaacgttacttaccccgtaccgaaaggaaaccgaacccgaaaaccggaccccctaaaacggtacccctttacccccggtattaaacgtccgtaacgtaaacctaaaaagttccgaaaaacctgggttctaagggaagaacggtcgtaagggggaaacgtacccggaacgggtttcctttaagggttaacttacgtaggtacgaacgaaaggggtagttaacgagg

SEQ ID NO: 428731 - DNA, 653 bp, Homo sapiens
  misc_feature: GZ8MTXP02JCN2C.19.53.E09.1.454.CMB.2.raw
  modified_base (353)..(353): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttggtacagcctggcaggtccctgagactctcctgtgcagcctctggattcacctttgatgattatgccatgcacgtcggggtcccggcaagcctccggaggggacgggcctgggagtggtctcgagtattagtgatgngctagtatagcctagtggacggtactcgtggtaggaacggggtccgatttcccaaccgactttacccgtacccgaaagggaaccgaaaccaaacccggaacccctaaaacggtaacccctttaccccgttaggttaccttaccgtagaaccctaaaagtcggtaaaacacggttactagggaaacggacggtacgtagggaaacggggtaaccaccgggggttcccttttaaggtaacgtttaaccgtgggttacggtaacggtaaaagggggtacggttaacgttacgggactaacggg

SEQ ID NO: 428732 - DNA, 547 bp, Homo sapiens
  misc_feature: GZ8MTXP02F0HC5.19.53.E09.1.454.CMB.2.raw
  modified_base (368)..(368): a, c, t, g, unknown or other
  modified_base (384)..(384): a, c, t, g, unknown or other
  modified_base (405)..(405): a, c, t, g, unknown or other
  modified_base (408)..(408): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccctttggctattttaaaaggtgtccagtgtgaagtgcagctggtggagtcgtgggggaggcttggtacagcctggcaggtccctgagactctcctgtgcagcctctggattcacctttgatgattatgccagtcgcacgtggggtccgacaagcctaccgaggggacggctgggagtcgggtctgaggtattagtggaatgtgntagtatgctatcgcgntcgtgtggaggctagtcaccntcncagacgacaacgcccaaagaccctaccctgtaactctagactaaaatgaaaactgtactagaacgagtcgtaggacggtaccaccgggtacctttaggtaatttacgtggtacgaagtaaacggggacggttataacgg

SEQ ID NO: 428733 - DNA, 691 bp, Homo sapiens
  misc_feature: GZ8MTXP02H49W0.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttattttaaaaggtgtccagtgtgaagtgcagctggtggagtcgtgggggaggcgttggtacagcctggcacggtccctgagactctcctgtgcagcctctggattcacctttgatgattatgccatgctacgtcggggtccgacaacgccgtaccggaaggggtaacgggcccgtaggggtacgggttcggggtcctaccggtaggggtttaagtttaagggttagggtaaatttaggtcgtacgttaaggttaatacggtcccttaagtcggaccggtactccgtggacggtaaacggggccctaagttcccaaccgtattcccgtaccgaagaacgaaccgaaacccgtaaccaaacggtaaacccttccctaggtacttaccgtagaaacctaaattacggaaactacggttcgtaaggaacggtagaccggtaggaacggtaaccggaccgggttacctttaggttaacttaccgtggttacggaaacggtaaagggtaaggttaactacggaacctaacgg

SEQ ID NO: 428734 - DNA, 586 bp, Homo sapiens
  misc_feature: GZ8MTXP02HSML2.19.53.E09.1.454.CMB.2.raw
  modified_base (260)..(260): a, c, t, g, unknown or other
  modified_base (299)..(299): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagcctggcaggtcctgagactctcctgtgcagcctcnggattcacctttgatgattatgccatgcacgtggtccgnaagctcgaggggaggctggagtggtctcgaggttattaggtagaatacgtgcttaagtatacgccttaagtcgacggtactcgtaggtaggaacgggccgtattcccgactacgtcctacgacgagaccaaaaccggccaaaacgtacccttacccgtagtactcctagaccaaaattacggaaacctaggtactagaacgagacgtaggaaacgtaccgacggtcctttaggtaactttacgaaggtagtaaccggaaagggaggtttaacgaggtaccgtaacgg

SEQ ID NO: 428735 - DNA, 534 bp, Homo sapiens
  misc_feature: GZ8MTXP02GRY4Q.19.53.E09.1.454.CMB.2.raw
  modified_base (300)..(300): a, c, t, g, unknown or other
  modified_base (373)..(373): a, c, t, g, unknown or other
  modified_base (484)..(484): a, c, t, g, unknown or other
  modified_base (509)..(509): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctaattttaaaaggtgtccagtgtgaagtgcagctggtggagtcgtgggggagcttggtacagcctggcaggtccctgagactctcctgtgcagcctctggattcactttgatgattatgccatgcacgtgggtccganaacgctccgaggggacggcctggagtgggtctcgtaggttattagtaggtaatggtgctagtatacgcctagnggacgtactcgtggtaggaacgggcctattaccacattcaccgagacgaacaaaccgtaccaaagaccctccgtagtaactcgagacaaatcggaacagtcagagagtcgnggacgacacggtctagtacttacgngtacgagaggtagtacacgacgacg

SEQ ID NO: 428736 - DNA, 599 bp, Homo sapiens
  misc_feature: GZ8MTXP02G4DOJ.19.53.E09.1.454.CMB.2.raw
  modified_base (300)..(300): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttaattttaaaggtgtccagtgtgaagtgcagctggtggagtcgtgggggagcttggtacagcctggcaggtcctgagactctctgtgcagcctctgattcactttgatgattatcgcatcgctacgtggggtccganaacgccgtccggaggggaacgggtccgtaggggaggtcggggtctacgtaggttattaggtaggaataggtgtcgttaagtatacgtcctagtggcgtactcgtaggtacggaaacggggtcctaattcccaaccgtactaccgtacccgaaagaacgaaaccgaaaccggaccctaaaaggtaaccccttcccgttagttaactacccgtagaaacctaaaagtcgaaactgtacgagaacgagcgtaggacgacacggtctagtactacgtgtacgacgaaggtagtatcgactacg

SEQ ID NO: 428737 - DNA, 548 bp, Homo sapiens
  misc_feature: GZ8MTXP02J2E8D.19.53.E09.1.454.CMB.2.raw
  modified_base (184)..(184): a, c, t, g, unknown or other
  modified_base (266)..(266): a, c, t, g, unknown or other
  modified_base (286)..(286): a, c, t, g, unknown or other
  modified_base (304)..(304): a, c, t, g, unknown or other
  modified_base (321)..(321): a, c, t, g, unknown or other
  modified_base (332)..(332): a, c, t, g, unknown or other
  modified_base (347)..(347): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttcctttggctattttaaaaggngtccagtgtgaagtgcagctggtggagtctgggggagcttggtacagcctggcaggtccctgagactctcctgtgcagcctntggattcactttgatgattngccatgcacgtggtccgnagctccgagggaggccnggagtgggctnaggtatagtggatgngctagatagcctagtgcgtctcgtgtaggaaggggccagttccacctatcctccagacgacaaacgccaagacctccctagtactactaacaaatggaaacctagtacgtagaggacgtcgtacggacggaaccgtacgggtacctttaggtaacttaaccgtggttacgacgtaaaggggacggttaaacgtacggtacg

SEQ ID NO: 428738 - DNA, 667 bp, Homo sapiens
  misc_feature: GZ8MTXP02GCTKK.19.53.E09.1.454.CMB.2.raw
  modified_base (219)..(219): a, c, t, g, unknown or other
  modified_base (226)..(226): a, c, t, g, unknown or other
  modified_base (235)..(235): a, c, t, g, unknown or other
  modified_base (259)..(259): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagcgtgtagttccttaggctatttaaagtgtcagtgtgaagtgcagctggtggagtcgtgggggagngttgganagcctggcnggtccctgacgctcctcgtgcgcncgcctcgtcgtacttaccttaccgttagtagtagtagttagtacgtaccgtacgtcgtacgtacggtacgggtccggtaccggtaccgtaccgtaccggaacgggtaacgggtacggtacgggtacggtccggtcgtacgtaggttagttaggttaggtaagtagtagtacgtagtagtacgtacgtacgtacgtacgtacgtacgtagtacggaacggtaccgtacgtacctactacgtacgtacgacgaacgaaaccgaaccgaaccgaaaccgaaccgtaccgtacgtacgtacgtacgtaacgaacgtaacgtaacgtacgtagtacgagacgtacgacggacggacgtacgtacgttacgttaacgttacgtacgtacgtacggtaacggtacggtacgtacg

SEQ ID NO: 428739 - DNA, 567 bp, Homo sapiens
  misc_feature: GZ8MTXP02GC79S.19.53.E09.1.454.CMB.2.raw
  modified_base (253)..(253): a, c, t, g, unknown or other
  modified_base (256)..(256): a, c, t, g, unknown or other
  modified_base (261)..(261): a, c, t, g, unknown or other
  modified_base (485)..(485): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggctaattttaaaaggtgtccagtgtgaagtgcagctggtggagtcgtgggggagcttggtacagcctggcaggtccctgagactctcctgtnacngcctntggattcacctttgatgattatgcctatgcacgtgggtcccgcagctccgaggggacgggcctggagtggtctcgaggtattaggtggaatagtgctagtaatgcctatcggccggtactcgtggtagaacggggtcctacttcaccgtactcctacgaagaacgaaccgtaaccgaaccaaagtaaccctcccgtagtactactacgactaaatacgtaaacngttacgagaaacgcgacgtaggacggtacgtacgggtccttagttacgttactggtcgagtaacggtaggtactaggactag

SEQ ID NO: 428740 - DNA, 572 bp, Homo sapiens
  misc_feature: GZ8MTXP02IQI5R.19.53.E09.1.454.CMB.2.raw
  modified_base (307)..(307): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcgttggacagcctggcacggtccctgacgactctcctgtgcagcctctggattcactttgatgattatcgcctatgctacgtggggtcccgngaacgcctccggagggaggccgtagggagtggggtctacgaggttattaggttaggaatagtgtcgtagtatacgtcctagtggcgtactcgtggtaggaacgggcgtattccgactactctacgaagacgaaccaacgaccaaacgaacctcctagtactcctacgactaaaagtcgaaacgtagtacgtagagtacgcgtaggacgtaacgacgggtccttagtacgttacgtggtacgacgtaagggtagtagacgagtacg

SEQ ID NO: 428741 - DNA, 569 bp, Homo sapiens
  misc_feature: GZ8MTXP02I5XCI.19.53.E09.1.454.CMB.2.raw
  modified_base (362)..(362): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggctatttaaaaggtgtccagtgtgaagtgcagctggtggagtcgtgggggaggcttggtacagcctggcagggtccctgagactctcctgtgcagcctctggattcacctttgatgtattatgccatgccacgtgggtccgcaacgcgtaccggaggggaacggccgtaggagtgggtctacgaggttattagtggaatgngtctagtatagcctagtcggcgactcgtgtagaacgggggccagtttcccaactacgtacctccgaacgacgaacaaaccgcccgaaagacccttcccgtagtactactagaacaaagtcgaacagtactgaacggagtcgtggaacggactacggtccttagtacttacgtggtcgaacggaagggtagtaagtacgacgtaacgg

SEQ ID NO: 428742 - DNA, 824 bp, Homo sapiens
  misc_feature: GZ8MTXP02IR924.19.53.E09.1.454.CMB.2.raw
  modified_base (325)..(325): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagtcgttggtacagccgtggccaggtccctggacgtactctcctgtcgcagcctgtgtacttcactttgattgtattatcgcctatcgacctacggtcggggtacccgganaaacggtcccttaccgggaagggggtaacgggtcccggttgggggtacggtcggttaccggtacgggttaaaggtttaggtttagggtaaagttaagggttacggtacgttaggttaagttaacggtacccgttaaacgttcgggtaccgggtaaccgttttccgtaagggggtttgggaaaacccgggggtacccgtaacctttacccggtaacccctaactaccccgttaaccgaaacggaaacgggaaccaaaacccggaacccgtaaaacccgtaaacccttaccccgttagttaacctacggttaccgaaacttaaaacgtacggtaaacgaaaccggtttcgtaagggaacgaacggtacggtaccgggtaaacggggaaaccgttaaccgggtttaccgttttacgtttaaacgtttaaccggttacgggtaacggtaaacgggtaaaacgggttaacgggtaacgttaacggtaccgtaacgggtttaacg

SEQ ID NO: 428743 - DNA, 638 bp, Homo sapiens
  misc_feature: GZ8MTXP02FRWYG.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggcttattttaaaggtgtccagtgtgaagtgcagcgtggtggagtcgtgggggagcttggtacagccgtggcaggtccctgacgactctcctgtgcacgcctgtggtacttcctacctttgatgtatttatcgcctatcgactacgtcggggtaccgacaacggcctaccggaaggggacgggccgtgggaggtcggggtctcgtaaggttagtttaggtaggaattggtcgtactaagtagtacgcctagtcggtacgtacttcgtggtaggaacgggtccgtatccactactccacagaacgaaccaaacgaccgaaactacccgttaccctagtacctctacgaactaaagtacgaacgtacgtacgtaaggacgacgtacgtaacggaacggtaccgtaccgggttacctttagggtaactttacgtaggtacggtaacggtaaacgggtacggttaagtaacgg

SEQ ID NO: 428744 - DNA, 633 bp, Homo sapiens
  misc_feature: GZ8MTXP02JV5Y8.19.53.E09.1.454.CMB.2.raw
  modified_base (251)..(252): a, c, t, g, unknown or other
  modified_base (334)..(334): a, c, t, g, unknown or other
  modified_base (598)..(598): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctattttaaaaggtgtccagtgtgaagtgcagctggtggagtcgtgggggagcttggtacagcctggcacggtcctgagctctctgtgcnnctctggtacttcacttgatgtatatcgccatcgctacgtcggggtccggacaacgccgtaccggaggggacgggccgtaggnggtcggggtctacgtagggttacgtttaggttagggaattaggtgtacgttaagtaacgtaacgtccgttagtcgggtacgtacttcgtggtaaggtacgggcgtacttcccgacctactacgtacccgaagtacgaacccaaaccgaccgaaacaacccttcccgtatacctacgtacgaaacctaaattacgaacctagtcgtaaaggacgtacgtaggtacggaacggtaaccgtaccgggttaccttgttaacgttacgngttacgaacggtagggtacgttacgaagctaacgg

SEQ ID NO: 428745 - DNA, 625 bp, Homo sapiens
  misc_feature: GZ8MTXP02IK5UY.19.53.E09.1.454.CMB.2.raw
  modified_base (243)..(243): a, c, t, g, unknown or other
  modified_base (272)..(272): a, c, t, g, unknown or other
  modified_base (412)..(412): a, c, t, g, unknown or other
tcagtactctcgtgcacgaccggtgctcgatttagagagagtgtgttgggtctgggggaggcttggtacagcctggcaggtccctgagactctcctgtgcagcctctggattcaccttttgatgattatgccatgcactgggtccggcaagctccgagggaagggcctggagtgggtctcaggtattagttggaatagtgctagtatagcctatgcggactctgtgaaggccattcaccatcnccagagacaacgccaagaacctcctgtanctagacaaatgaaacagtctggagagctagacggacacggtctttgttaattactgtgacgaaaggaggtatagctagacttacgtggtaccgactaacggcgggggacccaaggggaacccctggtacccacccgttcnccctacgacgcccttacccacccgaacgggcccctacgtcccggtacccttcccccgtacggccccgtcccgtcgccgttacccgaggaccgccacccgtaccggaagcgaccacgacggcccggtcccgtcgggcctcggaccgttacggaccgaaacggtaccttaccgtaacccgaacggtacgtaacgtacgtggaccggacggtacgg

SEQ ID NO: 428746 - DNA, 565 bp, Homo sapiens
  misc_feature: GZ8MTXP02GALV2.19.53.E09.1.454.CMB.2.raw
  modified_base (250)..(250): a, c, t, g, unknown or other
  modified_base (458)..(458): a, c, t, g, unknown or other
  modified_base (477)..(477): a, c, t, g, unknown or other
  modified_base (489)..(489): a, c, t, g, unknown or other
tcagtactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccgagggaagggcctggagtgggtctcagggttattagttggaatagtgctagtatagcctatgcggactctgtgaagggccattcaccatctcaganacaacgcaagactccctgtactctgacaaatgaaacagtctagagagctgaaggacacggtcctttgtattactgtgacgaaggagtatagcaagtctaactcgggtacgactacggtcgggggacccaacggggaacccttgggtaccaccgtcctcctcacgccctaccaccgaacggccctagtccgtccttccccgtggacccnccgtcgccaccgacggacnccacgcgagacncacgcgccgccgtggctcgcgtacggtacgaacgtacctaccgtaaccgacggacgtacgtacgcggacggcggcg

SEQ ID NO: 428747 - DNA, 661 bp, Homo sapiens
  misc_feature: GZ8MTXP02G3Z08.19.53.E09.1.454.CMB.2.raw
  modified_base (264)..(264): a, c, t, g, unknown or other
  modified_base (271)..(271): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctaattttaaaggtgtccagtgtgaagtgcagctggtggagtcgtgggggagcttggtacagcctggcacggtccctgagactctcctgtcncagcctnggtattccacctttgatgattatcgcctatgcctacggtcgggtccgacaacggtcctaccggaagggggaacgggccgtaggggtagttccggggtactcgtagggttatttaggtaggaattgggtcgtataagtatacgtacttagtcggtaccgggtacttcggtaggtaggggtaaacgggcccgttacgttacccaccgtaacttcccacccgaagaacgaaaccgaaaccgaccctaaaacgaacccttcccgtaagtaccttccgtagaactaaaagtcgaaaaccgtgtacgtaagacggaacgtccggtaggaaacgggaccctacgggttcccttagttaacgttacggtaggtacgtaagaagggtacgtaagtacgg

SEQ ID NO: 428748 - DNA, 692 bp, Homo sapiens
  misc_feature: GZ8MTXP02JA8G9.19.53.E09.1.454.CMB.2.raw
  modified_base (304)..(304): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagcttggtacagcctggcaggtccctgagctctcctgtgcagcctctgattcactttgatgattatgccatcgctacgtggggtcccganaacgtcctacccgggaaggggaacgggtcccgtaggggacggtcggggtcctaccggtaagggtttagtttaagggttagggtaaattaggtaggtacgttaaggttaagtacggtcccttaagttcgggaccgggtacttcgtaggtacggaacggggcccgtaaattccaacctacttccgaccgaagaaccgaaccaaaccggtaacccgaaactaacccgttaccccttagtaacttcgtacgtaaacgtaaaactacgaaaacgtaccgtagtacgaaggaacggtcgtacgggaaacggaccgtaacccgggtaccgtttaacgtaagttttaaccgtaaggtaacgaacggtaaagggtaacggtacgtacggacgtaacg

SEQ ID NO: 428749 - DNA, 572 bp, Homo sapiens
  misc_feature: GZ8MTXP02HYQLH.19.53.E09.1.454.CMB.2.raw
  modified_base (318)..(318): a, c, t, g, unknown or other
  modified_base (331)..(331): a, c, t, g, unknown or other
  modified_base (345)..(345): a, c, t, g, unknown or other
  modified_base (555)..(555): a, c, t, g, unknown or other
tcagtactctcgtgcacgaccggtgctcgatttagagagagtgtgttgggtttgggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactcctgtatctgacaaaatgaacagtctagagagctgaggacacggccttgtattacngtgcaaggagtanagcagctatggacnctacgtgggggaccagggaacccctggtacacccgtctcctcacgccctcccaccaacgggccccatccggtcccttcccccgtggccgccccgtgcctccgacggacgccaacccgtccgacgacgacgaccgagtccgggccccgtggggcctcggcccgtgggtaccaacgggacccttaccttacccgaacggaacgacggttacncggacggcgggcgtcgg

SEQ ID NO: 428750 - DNA, 554 bp, Homo sapiens
  misc_feature: GZ8MTXP02F5BD1.19.53.E09.1.454.CMB.2.raw
  modified_base (280)..(280): a, c, t, g, unknown or other
  modified_base (353)..(353): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaaggtgtccagtgtgaagtgcagctggtgagtctgggggagcttggtacagcctggcaggtccctgagactctcctgtgcagcctctggattcgacctttgatgatttacngcatgctagtcgggccgacacgcctacgaggggacggctgggagtggtctcgaggttattaggtagatgtgtntagtatagcctagtcggacgtactcgtggtacggacgggtacctattaccgacctattccacgaagacgaaccaaaccgtaccaaagtaccctcccgtagtactcgtacgaactaaacgtcgaaactgtacgagacgacgtcgtagaacgtacgcgtacttagtacttacgtgtagacgtaaggtagtatacgacgtaacg

SEQ ID NO: 428751 - DNA, 623 bp, Homo sapiens
  misc_feature: GZ8MTXP02FJSUW.19.53.E09.1.454.CMB.2.raw
  modified_base (525)..(525): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggctattttaaaaggtgtccagtgtgaagtgcagctggtggagtcgtgggggaggcttggtacagcctggcaggtccctgagactctcctgtgcagcctctggattcacctttgatgtattatgccagtcgcacgtcggggtccgcaacgcctaccggaaggggaacgggccgtaggggtaggtcggggttcctacgagggttatttaggtaggaattggtgcttaagtatagcctaagtgggaccgtacttcgtaggtaggaacggggcccgtaattccaaccattcccaccgaagaacgaccaaaccgcccaaagaaccctccctagtactccgtagaaccaaaatcgaaaacncggttacaggaacggagtccgtaaggaaccggtaccgtaaccgggtccttttaggtaactttacgtggttacgaacgtaaagggtacggtaataacgg

SEQ ID NO: 428752 - DNA, 583 bp, Homo sapiens
  misc_feature: GZ8MTXP02I5LBH.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaggtgtccagtgtgaagtgcagctggtggagtcgtgggggaggcttggtacagccgtggcaggtccctgagactctcctgtgcagcctctggattctacctttgatgattatgccatgcacgtcgggtccggcaagcctcgaggggaacgggcctgggagtcggggtctacgtaagggtattaggttggaaacttggtgacttaggtatagtcctagtggccggattcgtggtacggaaggggtcccgtaattccacctatcctaccgagaacgacaaaccggaccaagaacctccctagtacgtctacgactaaatcgaaactagtctacggagacgctacggaacggaccgaacggtccttagtaaccttagcggttacgacgaagggtacgtaagtacgg

SEQ ID NO: 428753 - DNA, 603 bp, Homo sapiens
  misc_feature: GZ8MTXP02H5ULF.19.53.E09.1.454.CMB.2.raw
  modified_base (513)..(513): a, c, t, g, unknown or other
  modified_base (537)..(537): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagcctggcaggtccctgagactctcctgtgcagcctctggattcacctttgatgattatgccatgcacgtgggtcccggcaagcctaccgaggggaaacgggccgtagggaggtcggggtctcgtagggttatttaggttaggaaattgtgactaaggttatagccttagtcgacgggtactcgttggtaggaaagggcccgtatttcccaacctactacctcccaagggtacaaaccaaaccggacccaaaagacccttaccccgtagttaactcgtanacaaaatgaaacagttctagaagngacgtaggaacggaccgaccgggtcctttagtaattacgtggttacgacgaaagggtagaacgtag

SEQ ID NO: 428754 - DNA, 711 bp, Homo sapiens
  misc_feature: GZ8MTXP02GO0IQ.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggcttaattttaaaaggtgtccagtgtgaagtgcagcgtggtggagtcggtgggggaggtcgttggtacagcctggcgacggtccctggacgtacctcctcctgtcgcacgtcctcgtggtacttcctacctttgatgtaatttatcgacctagtcgcctacggtcggggtcccggacaaacgcgtaccggaaggggaacggccgtagggtaggtcggggtctacgtaggttagtttaggtaggtaatggtcgtagtaagttatacgtacctagtcgggacgtacttcggtggtaacgggtaacgggtacccgtaattcccaaccgtacgtccctaccgaagaaaccgaaccgaaaccgacccgaaacgtaacccttcccgttacgtaacttcgaacgtaaacgtaaaacgttacgaaaacgtacggtaccgtaaggaaacgtaccgtacggtaaggaaaccggtaccgtaaccggttccgttaagtttaaccgttaacgtaggttacgaaccggtaaaacgggtacggttaaagtaaccgg

SEQ ID NO: 428755 - DNA, 602 bp, Homo sapiens
  misc_feature: GZ8MTXP02JZV13.19.53.E09.1.454.CMB.2.raw
  modified_base (266)..(266): a, c, t, g, unknown or other
  modified_base (578)..(578): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagcgttggtacagcctggcaggtccctgagactctcctgtcncagcctctggattctacctttgatgattatgccatgcacgtcgggtccggacaacgctccggaaggggacgggccgtgggaggtcgggtctgaggttatttaggttaggaagttggtgtacgtaagtatacgccttaagtcggaccgtactcgtggtaggacggggcctacttccaaccactcctacagaacgaccaaaccgaccaacgtaccctcctagtacttcgtacgactaaagtacgaaacgagtacgtggagacggcgtagggacggtaccgaccggttccgtttagtaacgttacgtacggttanacggtaaaggtacggtaagtacgg

SEQ ID NO: 428756 - DNA, 576 bp, Homo sapiens
  misc_feature: GZ8MTXP02JVIKZ.19.53.E09.1.454.CMB.2.raw
  modified_base (270)..(270): a, c, t, g, unknown or other
  modified_base (381)..(381): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggcttattttaaaaggtgtccagtgtgaagtgcagctggtggagtcgtgggggaggcttggtacagcctggcaggtccctgagactctcctgtgcagcctntggattcacctttgatgtattatgccatgcacgtcgggtccggcaagcctcggagggaacgggccgtagggagtcggggtctcgtaggtatttagtggaatgtgctagtanagcctatgcgactcgtgtggaaggcccgtattccgaaccatcctcagacacgaaccgcaaagtacctccctagtactctagacaaagtcgaaactagtaccgtaggaaggagaccgtaggaaccgggacgaacccggggtcctttaaggttaacgttacgtaggttacgaacggaagggtacggtaacgtaacgg

SEQ ID NO: 428757 - DNA, 573 bp, Homo sapiens
  misc_feature: GZ8MTXP02HS1EO.19.53.E09.1.454.CMB.2.raw
  modified_base (256)..(256): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtgggggagcttggtacagcctggcaggtccctgagctctcctgtgcagcctntggattcacctttgatgtattatcgccattcgcacgtggggtcccggacgaagcctacccggaaggggaacggccgtggggaggttcgggtcgtaccggtaggttagtttaggttaggaattaggtgcttaaggtatacggaccttagtcgcgtactcgtagtaggacggccgtatccacactctccaagacgaacaaaccgaccaaacgtaacctccctagtactaccgtagacctaaatcggaaactgtactagagtagcgtaggacgacgacggtccttagtactacgtgacgacgaaggagtacgtagactag

SEQ ID NO: 428758 - DNA, 588 bp, Homo sapiens
  misc_feature: GZ8MTXP02I6UYG.19.53.E09.1.454.CMB.2.raw
  modified_base (553)..(553): a, c, t, g, unknown or other
  modified_base (560)..(560): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaggtgtccagtgtgaagtgcagctggtggagtcgtgggggagcttggtacagcctggcaggtccctgagactctcctgtgcagcctcgtggtacttcacctttgattgattatcgccatcgctacgtggggtcccggcaaggtcctccgaggggacggccgtagggagtcgggtctccggtaggttagtttaggtaggtaagtacggtgacgttagtatacggtcctaagtcggcggtacctgtagtaggaacggggtcctagttccacgtactcctaccaaggacaacgaaccgacaaacgtccttccctgtactctacggacaaagtcgaaactgtacgtagacgtgaccgttggaaaccggacgtacggttcttacgggtnttacggngtacggacgaggtagtactacggactcg

SEQ ID NO: 428759 - DNA, 681 bp, Homo sapiens
  misc_feature: GZ8MTXP02JQ17A.19.53.E09.1.454.CMB.2.raw
  modified_base (188)..(188): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggcttaattttaaaaggtntccagtgtgaagtgcagcgtgggtggagtcggtggggggagtcgttgggtacaggcccgtgggcctacggtccctgacgtactcctccgtgtgcacgcctctggactttccacgtttgatgtaattatcgccatgctacgtgggtccgacaacgcgtacggaaggggaacggtccgtagggtaggtcgggtactacggtaaggttagttaggtagaaacgttggtgtaacttaaggtatacgtaccgtagtcgggacgtaaccgttggttacggtagggaacggtacccgtagttacccaccgtacttcccgacgaacggaaaccgaaaccaaaccggaccctaaacgtaacccttcccgtaagtactacgtacgaaacaaacgttagaaacttagaccgtaggacgtaacgtcgaaggaacgggtaaccgacggttacctttaaggtaacttaacggtcggtaacggaagtaaacgggtacgttaagaacgg

SEQ ID NO: 428760 - DNA, 547 bp, Homo sapiens
  misc_feature: GZ8MTXP02HMFHC.19.53.E09.1.454.CMB.2.raw
  modified_base (314)..(314): a, c, t, g, unknown or other
  modified_base (541)..(541): a, c, t, g, unknown or other
  modified_base (546)..(546): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctaattttaaaaggtgtccagtgtgaagtgcagctggtggagtcgtgggggaggcttggtacagcctggcaggtccctgagactctcctgtgcagcctctggacttcacctttgatgatttatgtcatgcacgtgggtccggnaagctccgaggggaacggcctgggagtcgggtctcgtaggttatttaggtaggaatcgtgctagtatagcctagtgcgtactcgtgtaggaagggcccgtaattccaacctactcctaccgagaacgaaccaaacgaccaaaagaaccctccctagttactctagacaaatcgaaacagtctagagagctaggacgacgaccgtctgtaacttagcgtcgagaaggngtaang

SEQ ID NO: 428761 - DNA, 578 bp, Homo sapiens
  misc_feature: GZ8MTXP02IIKSH.19.53.E09.1.454.CMB.2.raw
  modified_base (270)..(270): a, c, t, g, unknown or other
  modified_base (312)..(312): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttccttttggcttattttaaaaggtgtccagtgtgaagtgcagctggtggagtcgtgggggagcttggtacagcctggcaggtccctgagactctctgtgcagcctntggattcacctttgatgattatgccatgcacgtgggtccggnaacgctcgagggaggccgtggagtcgggtctgaggttattaggttaggaatggtgacttagtatagctagtcgcggacttcgtggtaggaacggggcccgtattcccgaacctacttcctaccgaagaacgaaccaaacgcccaaagtacccttcccgtagtactcgtagaactaaagtcgaaacaggtctaggagtgacgtaggacggtaccgacggtcctttaaggtaatttacgtggtacgacgtaaagggaggttaacacgg

SEQ ID NO: 428762 - DNA, 659 bp, Homo sapiens
  misc_feature: GZ8MTXP02HY79F.19.53.E09.1.454.CMB.2.raw
  modified_base (303)..(303): a, c, t, g, unknown or other
  modified_base (467)..(467): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagcgttggtacagcctggcacggtccctgacgactctctgtcgcacgcctctggtacttctacctttgatgtaatttancgcctatcgacacggtcgggtccgacaaggtccgtacggaggggaacggtccgaggggacggtcgggtctacgtaggttagtttaggttaggaattggtgtacttagtatacgtcctagtcggcgtactcggaggtaggaacgggctattccgaaccagtaccncgaaagaacgaccgaaaccgcctaaaacgtacccttcctagtactccgtaagaaccaaagtcaaaacgtcgttacacgggaagaacggtcgaaacgggaaacggtaccccgtaacgggttcccttttaaggtaaacgtttttcctagggtaaccgggaaaacggtaaaacggggtcgtttaaaacgaacggg

SEQ ID NO: 428763 - DNA, 586 bp, Homo sapiens
  misc_feature: GZ8MTXP02HXZ89.19.53.E09.1.454.CMB.2.raw
  modified_base (253)..(253): a, c, t, g, unknown or other
  modified_base (255)..(255): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttattttaaaaggtgtccagtgtgaagtgcagctggtggagtcgtgggggagcgttggtacagcctggcaggtccctgagctctctgtncngcctctggattcacctttgatgtattatcgccatgcacgtgggtccgacaaggctccgaaggggacgggtccgtgggacggtgggtctcgtaggttattaggttaggaattagtgcttagtatagtcctagtcggcgtactcgtgtaggaacggccgtatccaccatccgtaccagaacgaccaaacgtaccaaacgtaccttcctagtactcctagaacaaagtcgaaactggtactaggaacgagcgtaggaacggacgtaaccgggttcctttagttaacttacgttggtacggacggtaaaggggtagttaacgtacggagtaacgg

SEQ ID NO: 428764 - DNA, 528 bp, Homo sapiens
  misc_feature: GZ8MTXP02FQ2UP.19.53.E09.1.454.CMB.2.raw
  modified_base (259)..(259): a, c, t, g, unknown or other
  modified_base (331)..(331): a, c, t, g, unknown or other
  modified_base (452)..(452): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagcttggtacagcctggcaggtccctgagactctcctgtgcagcctntgattcactttgatgattatgccatgctacgtgggtccgcaagctccgaggggacgggcctggagtgggtcncgagtatagttggaatggtgctagtatagcctagtgcgactgtgtggaaggcattccacatcaccagacgaccaaacgaccaaagtaaccctcccgtagtactctagactaaagtgaaacngtactgacgagcgtggaacggcaaccgggtcttaggttattacgtggtacgacgtaagggtaggtataggcgaacg

SEQ ID NO: 428765 - DNA, 641 bp, Homo sapiens
  misc_feature: GZ8MTXP02HGZI6.19.53.E09.1.454.CMB.2.raw
  modified_base (260)..(260): a, c, t, g, unknown or other
  modified_base (613)..(613): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagcttggtacagcctggcaggtccctgagctctctgtgcagcctcnggtattcactttgatgattatgcctagtcgactacggtcggggtccggactaaacggccgtacccggaaagggggaaccgggtcccgtaggggtaggtcggggtactaccgtaggggttaatttagggttaggtaaatacggtgtcgttaaggtaatcgaccttaagtcggaccgggtaactcgttaggtaggtaaacggggcctaattcccacgtaactccgtaccgaagaacgaaccaaacccggaccaaacgtaacccttcccgtagtactacgtacgaactaaaatcggaaacctagttacaggaaacgcgacgtaggacgaccgtacggtacctttagtactttacgngtagaacgtaggtagtacgacgactacg

SEQ ID NO: 428766 - DNA, 510 bp, Homo sapiens
  misc_feature: GZ8MTXP02FLNBD.19.53.E09.1.454.CMB.2.raw
  modified_base (282)..(282): a, c, t, g, unknown or other
  modified_base (326)..(326): a, c, t, g, unknown or other
  modified_base (343)..(344): a, c, t, g, unknown or other
  modified_base (365)..(365): a, c, t, g, unknown or other
  modified_base (381)..(381): a, c, t, g, unknown or other
  modified_base (384)..(384): a, c, t, g, unknown or other
  modified_base (389)..(389): a, c, t, g, unknown or other
  modified_base (479)..(479): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggctaattttaaaaggtgtccagtgtgaagtgcagctggtggagtcgtgggggagcttggtacagcctggcaggtccctgagactctcctgtgcagcctctggattcacctttgatgattangccatgcagtgggtccgcagctccgagggaggctggagtggtcncgagtatagtgaatgtnntagatagcctatgcgactcgngtagacggcattcacntcncaganacacgaccaaacgtacctcctagtatctgaacaaatcgaaacagtctagatacgcgtaggacggacctacggtacctttagtatttacgngtacgacgaaagggtagtagtacggcaacgg

SEQ ID NO: 428767 - DNA, 630 bp, Homo sapiens
  misc_feature: GZ8MTXP02ILG4U.19.53.E09.1.454.CMB.2.raw
  modified_base (451)..(451): a, c, t, g, unknown or other
  modified_base (595)..(595): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggaggcttggtacagcctggcaggtccctgagacctctcctgtgcagcctctggattccacctttgatgatcatgccatgactacgtcgggtccggacaagcctaccggaaggggacggcgtggacggtgggtcctgtaggttattaggtagtagtagtgtacttagtataggtacctagtcggacgtacttcgtaggtaggaaacgggtccctacgttccaacccgtntaccctcgaaaggacgaaaccaaccccggacaaaccgtacctaccccttagtactcgtacgaacaaagttacgaaaacgtgtactaggagacggacgtaggacggtaaccgtaccggttaccgttaagttaaacgtttaaccgnggttacggaacggtaaaaggggtacggttaaacgg

SEQ ID NO: 428768 - DNA, 604 bp, Homo sapiens
  misc_feature: GZ8MTXP02GU8E7.19.53.E09.1.454.CMB.2.raw
  modified_base (262)..(262): a, c, t, g, unknown or other
  modified_base (294)..(294): a, c, t, g, unknown or other
  modified_base (528)..(528): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggctaattttaaaaggtgtccagtgtgaagtgcagctggtggagtcgtgggggagcttggtacagcctggcaggtccctgagactctcctgtncagcctagtggacttccactttgatgtattangccatgccacgtcggggtccggacaacggcctaccgggaaggggtaacggtccgtgggacggttcggggtcccaggtaggttagtttaggtaggtaaatcggtgacgttagttaacgtcgtcctaagtgggtacggtaccttcggttaggaggtaacggggcctaattcccgaactctcaccaagacgtaaccaacgtaccaaagtacctccctagtactgtacgaataaacgngaacctagtcgagtacggactcgacggacgtacgacggtctttaggaatttcgaggtacgagaagggtatacgacg

SEQ ID NO: 428769 - DNA, 633 bp, Homo sapiens
  misc_feature: GZ8MTXP02JBE9H.19.53.E09.1.454.CMB.2.raw
  modified_base (264)..(264): a, c, t, g, unknown or other
  modified_base (266)..(266): a, c, t, g, unknown or other
  modified_base (271)..(271): a, c, t, g, unknown or other
  modified_base (317)..(317): a, c, t, g, unknown or other
  modified_base (379)..(379): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagcttggtacagcctggcaggtccctgagactctcctgtncngcctntggattcactttgatgtatttatcgccatgctacgtggggtccganaacgcctacggaggggacggtcctggggaggtcggtctacgaggttattaggtagaatggtnactagtatacgtctagcggacgtactgtagtaggaacgggtccgtactccaaccgtctcccgtaccgagaacggaacccaaacgtacccaaaggtaaccccttcccgtagtaaccttcacggtaaactaaaacttacggaaaccgtagttccgtaagggtaaccggagtaccgaggggacggaaccgttaccggggtacctttaggtaaacttccgtacggtagtacggtaaacggggtaggtttaaaactcgg

SEQ ID NO: 428770 - DNA, 676 bp, Homo sapiens
  misc_feature: GZ8MTXP02FN1YK.19.53.E09.1.454.CMB.2.raw
  modified_base (648)..(648): a, c, t, g, unknown or other
  modified_base (669)..(669): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctaattttaaaggtgtccagtgtagaagtgcagcgtggtggagtcgtgggggagtcgttggtacagcctggcacggtccctagacgacctctccgtgtgcacgcctcgtgtacttcctactttgatgtattatcgacctatcgaccgtacgtcggggtacccggacaacggccgtaccggaaggggaacgggtccgtaggggacggtcggggtacctacggtaaggttagtttaggttaggtaaagttaggtacggtcgttaagttaagtaacggtacccttagtacggaccggtaacttcgtagggtaacggggaaacggggacccttaattacccgaaacctacgttccctaacccgaaagaaccgaacccaaaaccggacccaaaacggtaaccccttccgtagttaactcctaacgaacaaagtcgaaactggtacgtaagagacgtacgaggaacggaccgtacggtacttagacttacggngtacgaacgtaggagttaacncgactag

SEQ ID NO: 428771 - DNA, 631 bp, Homo sapiens
  misc_feature: GZ8MTXP02F285A.19.53.E09.1.454.CMB.2.raw
  modified_base (628)..(628): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggcttaattttaaaggtgtccagtgtgaagtgcagcgtggtggagtcgtgggggagcgttggtacagcctggcaggtccctgagactctcctgtgcagcctcgtggacttcctaccgtttgatgtattagtcgcctatcgctacggtcggggtcccgacaacggcctaccggaaggggaacgggccgtagggacggtcggggtactcgtaagggttatttaggtaggtaaattggtgacgttaagtaatagtaccttaagtcggacgtacttcgtaggtaggaaacgggtcctaattcccaacacgttccaccgagaaacggaaaccaaaccggaccaaacgtaacccttccctagtacctcagtaactaaatcggaaactgtcgtaggacgtagacgtaggacggtacctacggtcctttaagtaagttacgtacggtgaacggtaaggtacggttanacg

SEQ ID NO: 428772 - DNA, 658 bp, Homo sapiens
  misc_feature: GZ8MTXP02IVF1R.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagccgtggcacggtccctgacgactctcctgtcgcagcctcgtggattccgtacctttgatgtatttatgtactatgacctacggttgggtcccggacaacgccgtaccggaaggggaacggggtccgtagggtacggttcggggtactacgtagggtttaagtttaggttaggaaacttgggtcgtacgttagttaagtacgtaccgtaagtcggaccgtacttcgtagggtacgggaaacgggtccgtaactttccaaccgtactacccgtaccgaaagaaccggaaaccacccggaaaccctaaagtaacccttcccgtaagtactctagaactaaatcgaaaactcgttacgagaagacgtcgtacggacgtaccgacggtacttaggttaatcgtagtcgaacgaaggacggtaatacgg

SEQ ID NO: 428773 - DNA, 708 bp, Homo sapiens
  misc_feature: GZ8MTXP02I2IK5.19.53.E09.1.454.CMB.2.raw
  modified_base (654)..(654): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtgggggagcttggtacagcctggcaggtccctgagactctcctgtgcagcctcgtggacttcacctttgatgattatgcctatcgcacgtcgggtccggacaacgcctacccgaggggaacgggtcccgtagggacggtggggtcctaccgtaagggtttaagtttagggttaggaaagttaggtgtacgttaagtaagttacgacccttaagtcggaccggtacttcgtaggtagggaaacggggtccccgtaattcccaacctacttccgacccgaaagggaacgaaacccgaaaccgaccccaaaaggtaaccccttaccccgtaggttaactacccgtacgaacctaaaagttacgaaaccgtaggttaccgaggaaggaacggttccgaaggaaacggggaaacccgtaaccggttaccccgtttaaggttaacttttaaccggnggttaaccgggaacgtaaaacgggggtaggttaacgttaacgggactaaaccgg

SEQ ID NO: 428774 - DNA, 636 bp, Homo sapiens
  misc_feature: GZ8MTXP02I92RR.19.53.E09.1.454.CMB.2.raw
tcagtactctcgtgcacgaccggtgctcgatttagagagagtgtgttggggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtggggggagcgttggacagccgtggcacggtccctggacgactctcctgtgcagcctcgtggtacttcactttgatgatttatgacctatcgctacgtcggggtccgacaacggcctaccggaaggggaacgggtcccgtaggggtacggttccggggtctacggtaggttaagtttaggtaggaacttggtcgtactaagttatacgtactagtcggtacggtaccttgtaggtacggaacgggtccgtattccgaacctagtcctaccgaagaccgaaccaaacgaccaacgaacctcccgtagacctctaggactaaaagtcgaaactgtacgtagaggacgtacgtacggaacggtaccgaccggttccctttaggtaaacttcgtaggtacgacggaacggtagtactacgg

SEQ ID NO: 428775 - DNA, 695 bp, Homo sapiens
  misc_feature: GZ8MTXP02JFLSQ.19.53.E09.1.454.CMB.2.raw
  modified_base (460)..(460): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagcgtggtggaggtcgtgggggaggcttggtacagcctggcgacggtccctggacgcttcctccgtgtcgcacgtcctcgtggtacttcctacgtttgattgtaactttagcgcctagtcgccgtacggtcggggtcccgacgaacgtccgtaaccggaagggggaacggtccgtaggggtaggtccgggtactacggtaagtttagtttaggtaggtaattacggtgtacttaggtatacgtctagtcggacgtntcgtaggtaggaacggtccgtattccgactactccgtacgagaaacgaacccgaaacgtacccgaaacgtacccgtacccgttagtacttacgagaaactaaacgtacgaaatcggttacaaggaacggtacgtacgtacgggaaaccgggtaccgtaaccccgggttacgtttaaggttaaaccttacgggtaggtaccggtaaacggtaaaagggggtactttaagtaaccgg

SEQ ID NO: 428776 - DNA, 652 bp, Homo sapiens
  misc_feature: GZ8MTXP02I7F7K.19.53.E09.1.454.CMB.2.raw
  modified_base (628)..(628): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggcttattttaaaaggtgtccagtgtgaagtgcagctggtggagtcgtgggggagtcgttggtacaggcctggcacggtccctgacgactctcctgtgcagcctctggtacttcctacctttgatgtatttagtcgcctatcgcacggtcggggtccgacaacgccgtaccggaaggggaacgggtccgtggggtacggtcggggtactacggtaaggtttaagtttaggttaggtaaattgggtacgtacgttaaaggtagtacgtaccgttagtcgggaccgtacttcgtgggtacgggaaacgggtcccgtattcccaacctacttccgaccgaaggaaacgaaacccaaaccggaacctaaacgaacccttcccgtaagtactccgtagaacgtaaaatcgaaactgtaccgagagaacgcgtaggaacgccgtaacggttcttaggtaacttgngtacgagtaaggtacggtatacgg

SEQ ID NO: 428777 - DNA, 629 bp, Homo sapiens
  misc_feature: GZ8MTXP02FH532.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttcctttggcttaattttaaaaggtgtccagtgtagaagtgcagctggtggagtcgtgggggagtcttggtacagcctggcaggtccctgagactctcctgtgcagcctcgtggacttcctacctttgattgtaatttatcgccattcgctacgtcggggtcccgacgaaacgcctaccggaaggggaacgggccgtagggaggtcggggtcctacgaagggttattaggtaggaaattggtgtacgttaagtatacgaccttagtcggcgtacttcgtaggtaggacgggacccgtattcccgacctacgttccgtaccgagaaccgaaccaaaccgaccgaaacgaacccttaccgtagtactcgtacgaactaaatcgaacgtagtcgtagagacgtcgtaaggacggacgtacggtacctttagtaacgttacgtaggtacgacgtaagggagtaacgtacg

SEQ ID NO: 428778 - DNA, 619 bp, Homo sapiens
  misc_feature: GZ8MTXP02JWTW7.19.53.E09.1.454.CMB.2.raw
  modified_base (176)..(176): a, c, t, g, unknown or other
  modified_base (441)..(441): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctattttaaaaggtntccagtgtgaagtgcagctggtggagtcgtgggggagcttggtacagccgtggcacggtccctgacgctctcctgtgcacgcctctggacttcacctttgatgattatcgccatgcctacggtcgggtaccgcaaggcctaccggaggggaacgggtccgtagggaggtcgggtctcgaggttattagtaggtaataggtgtcttaaggtactacgtacctagtcggacggtactcgtgtaggaacgggtccgtaattccgaacnctccgtaccgaagaacgaacccgaaacggacccaaacggtaacccttaccctaggttaacttaccgagaaacctaaaagtaccgaaatacgtcgtaaggaagtacgacgtaggaacggaccgacggttcctttagtaacttaggtgtcggaacggaaggtaggtataacggcgtaacg

SEQ ID NO: 428779 - DNA, 676 bp, Homo sapiens
  misc_feature: GZ8MTXP02INYNT.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagcgttggtacagcctggcaggtccctgacgactctctgtgcagcctctggtactctactttgatgatttatcgcctatgcgacgttcggggccgactaaggcctaccggaaggggaacgggtccgtgggaggttcgggtcgtacgtaggttagttaggtagggtaataggtcgactagtatacgtctagtcgggcgtactcgtgtaggaacgggtcccgtaaatttccaaccctagttacccgaccgaaacggaaccgaacccgaaaaccgacccgtaaaacggtacccctttaccccgttagtacctaccgttaacggaaactaaacgttaaggaaacctagggttacctaggaaaacggtacggacccttaaggggaaaccggacccgtaacccgggttcctttaggtaaactttcgttaggtacgaacgtaaacgggaggtttaacacgg

SEQ ID NO: 428780 - DNA, 617 bp, Homo sapiens
  misc_feature: GZ8MTXP02GG5FY.19.53.E09.1.454.CMB.2.raw
  modified_base (264)..(264): a, c, t, g, unknown or other
  modified_base (269)..(269): a, c, t, g, unknown or other
  modified_base (606)..(606): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagcctggcaggtccctgagctctcctgtgcngcctntggattcacctttgatgattatgccatcgcacgtcggggtccgacaagcctaccggaaggggaacgggcctagggaggtcgggtctcgtaggttatttaggtaggaattcggtgacttaagtatacgacctagtgcggtacttcgtggtaggaacggggccctagtttccgacctacttccaccgagaaacgaccaaacgacccgaaagacccttccctagtaactccgttagaaccttaaagtacgaaacgtacgtctaacggaggaagtcgttaacggggacggaccgaacgggttccctttaggtaacgttacgtggtacggagtaaacggggngttaacgtacg

SEQ ID NO: 428781 - DNA, 589 bp, Homo sapiens
  misc_feature: GZ8MTXP02HNTJ4.19.53.E09.1.454.CMB.2.raw
  modified_base (262)..(262): a, c, t, g, unknown or other
  modified_base (285)..(285): a, c, t, g, unknown or other
  modified_base (305)..(305): a, c, t, g, unknown or other
  modified_base (536)..(536): a, c, t, g, unknown or other
  modified_base (573)..(573): a, c, t, g, unknown or other
  modified_base (581)..(581): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttattttaaaagtgtccagtgtgaagtgcagcgtggtggagtcgtgggggagtcttggtacagcctggcacggtccctgagactctccgtgtgcagcctntggtattcacctttgatgattangccatgcacgtgggtccganaacgctcgaggggacggcgtggagtcggtctcgtaggttagttaggttaggaaattacggtgtacgtaagttatacgtacctaagttcgacgggtaccttgtagtaggaacggggccctagttccaaactcttaccgacgagacgaaccaacgccctaaaaggtacccttccgtagtactcgacgtaaacaattacgaaccgagttacaggaagtcgagtaggacgaaccncggttactaggttaacctgttaacgagaagtaacggnggttaacncgtacacg

SEQ ID NO: 428782 - DNA, 662 bp, Homo sapiens
  misc_feature: GZ8MTXP02JN7LM.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcggtgggggagcgttggtacagccgtggcacggtccctgacgctctcctgtgcagcctgtggacttccacctttgatgtaattatcgcctagtcgctacggtcggggtccggacaaacggccgtaccggaagggggtaaacgggtcccgtaggggtaacggttcggggtaccttacggtaagggtttaagtttagggttagggtaaattggggtcgtacgttaaaggttaacgttacggaccgttaagtcgggtaccggtaacttcggttaggggtaggaaccggggtccgtaactttcccgaacctaacgttccaccgaagaacgaaccaaaccgaccgaaacgtaccctaccgtgtactctagaactaaagtcgaaactgtctaggagagcgtaggacggtaccacggtcttaggtaactacgtgtacgagaaggtcgatacgg

SEQ ID NO: 428783 - DNA, 688 bp, Homo sapiens
  misc_feature: GZ8MTXP02FJSXQ.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggctaattttaaaaggtgtccagtgtgaagtgcagctggtggagtcgtgggggagtcttggtacagcctggcacggtccctgagacctctcctgtgcagtcctcgtggtacttccgtacctttgattagtatttatcgacctagtcgtacgacggttcggggtcccggacgaacggccgtacccgggaaggggaacggggtcccgtaggggaggtcgggtctaccgtaagggtttagttaggttagggaaattaggtgtacgtagtaacgtacgtcctaagtcgtaccggtacttcgttaggtacgggtaaaacggggtcctaactttcccgaacccgtacttcccgaacccaaagggaaaccgtaaaccgaaaaccccgtaaccccgaaaacggttaaaccccctcccgttaagttaccttacgtacggaaaactaaaatacgaaaccgtagtcgtaggaagagtacgaggaacgtaccgtacgtcctttagtaacttacgaagagaacgaggagtacaggctaacg

SEQ ID NO: 428784 - DNA, 638 bp, Homo sapiens
  misc_feature: GZ8MTXP02FX6LB.19.53.E09.1.454.CMB.2.raw
  modified_base (614)..(614): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggaggcttggtacagccgtggcaggtccctgacgactctcctgtgcagcctcgtggcttctacctttgatgtatttatcgcctagtcgaccgtacggtcggggtcccggacaaccggccgtaccgggaacggggaacggggccgtaggggtacgggttccggggttactacggtaagggtttagtttaagggttaggtaaagtttaggtgtacgttaaggttactacggtacctagtcggacggtacttcgtaggtaggacgggtcgtacttccactactctaccgagacgaaccaacgacccaaagtacccttccctagtactaccgtagaactaaagtagaaactgttacgagagtacgcgaggacggacgtaacgtcttaagtcgttangtacgacgtaaggggtactgaacg

SEQ ID NO: 428785 - DNA, 715 bp, Homo sapiens
  misc_feature: GZ8MTXP02HFBTN.19.53.E09.1.454.CMB.2.raw
  modified_base (278)..(278): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggaggtcgtgggggaggtcgttggtacaggcctgggcacggtccctgagactctcctgtgcacgcctntggtacttcctacctttgatgatttatcgcctagtgcctacgtggggtcccgacgaacgtccgtccggaggggaacgggtccgtaggggtaggtccggggtctcgaggttagtttaggtggtaagtgtcgtatagtatacgtactagtggtccgtatccgtggtacgggacggtcccgtattccgaacttacgttccaccggaagaaaccgaacctaaacccgacccgtaaagtaaccccctttacccgtagttaacccttcgttaaccgaaacgttaaaacgtaacgtaaaccgtacggtacccgttaaaggaaccgggtagtaccggttaaacggggaccgggaaacccgttaccccggggttccttttaagggttaaccttacgtttaggggaccgtaacgggtaaaaggggttaaccgggtttaaagtaccgg

SEQ ID NO: 428786 - DNA, 616 bp, Homo sapiens
  misc_feature: GZ8MTXP02GRBCC.19.53.E09.1.454.CMB.2.raw
  modified_base (264)..(264): a, c, t, g, unknown or other
  modified_base (308)..(308): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttaattttaaaaggtgtccagtgtgaagtgcagctggtggagtcgtgggggagtcgttggtacagccgtggcaggtccctgagactctctgtgcagcctntggattcacctttgatgtattatgccatgcacgtggggtcccgnaacgctaccgaggggaacggcctgggagtgggtctcgagttagttagtaggaatgtgctagatgcctagtcgcggtactcgtggtaggaacgggcctagttccaccgtactccgtaccgaagaacgaacccaaacggacccaaaggtaaccccttcccgtagttaactaccgtaacgaactaaaacgttacgaaaaccgtagttacgaggtaagacgacgttacgggaaacggtaccgaccggttaccgtttagttaacgttacgtaaggtacgaacggtaaaagggtgtaaacgtaggactaaccgg

SEQ ID NO: 428787 - DNA, 658 bp, Homo sapiens
  misc_feature: GZ8MTXP02FWHDE.19.53.E09.1.454.CMB.2.raw
  modified_base (269)..(269): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagcttggtacagcctggcaggtccctgagactctcctgtgcagcctntggattcacctttgatgtatttatgccatcgactacggtcggggtcccgacaacgccctaccgggaaggggaacgggccgtaggggaggttcggggtctacggtaaggttagtttaggttaggaattagggtgtacgttaaaggtactacggtaccttaggtcggacggtacttcggtaggttagggaaacggggtcccgtaacttcccaacctaacttcccaccgaagtaacgaaccgaaaccgacccaaaagtaccctacccgtagtacctacgtacgaactaaaagtacgaaactaggtactaggagtagtaccgtagggaaacggtaccgacgggttccttaaggtaacttaacgtcgtaggacgaaagggtagttaagaaccgg

SEQ ID NO: 428788 - DNA, 680 bp, Homo sapiens
  misc_feature: GZ8MTXP02IUVLS.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggcttaattttaaaggtgtcagtgtgaagtgcagcgtgggtggagtcgtgggggagtcgttggtacaggccgtggcacggtccctggacgactctcctgtcgccacgccttcgtggtactttccctacctttggattgtaatttagtcgacctatcggacctacggttcggggtccgacgaaacgtccgtaccggaaggggaaacgggtccgtaggggacggtcggggtcctacgtaggttagtttaggtagtaattaggtgacttagtaactagtaccgttagtcggacgtacttcgttaggaggaacggggtccctaattcccaaccgtaacttccacgaacgaaaccgaaccgaaaccgtaaccctaaaacgaacccttccgtaacgtacttccgaaggaactaaaagtcgaaacctagtccgtaaggacgacggtcaaaggacggtaacgtacccggtacgtttagtaacgtttacggtcgtaggaacgtaaagggagttaacgtag

SEQ ID NO: 428789 - DNA, 699 bp, Homo sapiens
  misc_feature: GZ8MTXP02JUW2A.19.53.E09.1.454.CMB.2.raw
  modified_base (450)..(450): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttcctttggcttaattttaaaggtgtccagtgtgaagtgcagcgtggtggagtcggtgggggagcttaggtacagccgtggcgacggtcccagacgacctcctccgtggtcgcacgcctcgtggtactttcctaccgttttgattgtaattttaagcgtaactacgtcggacctacggttcggggtacccggacaaaccggtcgtaccgggaaggggaaccggccgtagggtacggtcgggtctaggtaggttaagttaggtaggaattggtgtaacgttagtaacncgtaccgtagtcggacggtactcggtaggtacggaacggccgtacttacccacgtacgttaccgaccgaacgaaccgaaccgaaaccggtaccccaaaacggtaccccttacccgttagtacctaccgtaagtaacccgtaaagttacggaaacgttgaccggtaggacggtagcggtacggaaacggtaccgtaccggttaccttagttaacgttacgtaggtacgacgggtaaggtagtaacgacgg

SEQ ID NO: 428790 - DNA, 646 bp, Homo sapiens
  misc_feature: GZ8MTXP02GFNXF.19.53.E09.1.454.CMB.2.raw
  modified_base (267)..(267): a, c, t, g, unknown or other
  modified_base (275)..(275): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctgggtggagtcgtgggggagtcgttggtacagccgtggcacggtccctgagactctcctgngcagcctntggtacttcctacctttgatgtaatttatcgccatcgacgtacgtcggggtccgacaacggcctaccggaaggggaacgggtccgtaggggtacggtcggggtcctacggtaagggttagtttaggttaggaacttagggtcgacgttaaggttataacgtccttaagtcggacggtacttcgtaggtacgggaacgggtccctaacttccaactactcctacgaacgaagaaccaaccgaccaaaacgtaccctacccgtagtaactcgtagaactaaattacggaaactagtactaggacggagtacgacgggaacgtaccgacggttacctttagtaattacgtgtacgaagaaaggtcgtaagtacg

SEQ ID NO: 428791 - DNA, 805 bp, Homo sapiens
  misc_feature: GZ8MTXP02GS779.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttaattttaaaggtgtccagtgtgaagtgcagcgtggtggagtcggtgggggagtcgttggtacagccgtggctacggtccctgacgtactcctcctgtcgcacgtcctcgtggtacttcctaccttttgattgtatttatcgacctagtcgcctacggtcggggtccccgactaacggcccgtaccgggaaggggaacgggtcccgtaggggtacggttcggggtccttacggtaagggtttaagtttaagggttagggtaaaagttaggttggtacgtttaaggttaagttaccggtaccgtttaaggtcggtacccgggtacgttcggtagggttacggggaaaccggggtacccgtaactttacccgaaccctacgttccccgtacccgaaaggaaccgaaacccgaaaacccggacccgtaaaaccggttaaccccttccccgttagttaaaccgttaccgttacggaaaacctaaaacggtacggtaaaaccgttaaggttaccgtaagggaacggtaacggtacggttaacggggaaacgggtaacccggtacccggtttacccgtttaaggtttaacgttaccggttaaggttacgaacgggtaaaggggtaacgttaagtacggtacgtaacgg

SEQ ID NO: 428792 - DNA, 615 bp, Homo sapiens
  misc_feature: GZ8MTXP02HAQD8.19.53.E09.1.454.CMB.2.raw
  modified_base (523)..(523): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggacttaattttaaaaggtgtccagttgtgaagtgcagcgtggtggagtcggtgggggagtcgttggtacagccgtggctacggtccctgacgactctcctgtcgcacgcctcgtgtacttcgtactttgatgtattagcgcctatcgactacggtcgggtccgacgaacgccgtaccggaggggacggtccgtggggtaggtggtctacgtaggttattggtagattgtgtctagtactacgcctgtcgacgtatcgtgtaggacggccgtatcccactactccgacaagacgaaccgaacgacccaaacgtacccttaccgtagtactacgtacgaactaaacgtacgaacgtagtacgnggtaacgcggtacgttaggaccggtaacgtccgggttacttagttacgttagaacggtagaacgggtagggtagtacgtaacggccgttagg

SEQ ID NO: 428793 - DNA, 704 bp, Homo sapiens
  misc_feature: GZ8MTXP02IS8VA.19.53.E09.1.454.CMB.2.raw
  modified_base (188)..(188): a, c, t, g, unknown or other
  modified_base (258)..(258): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaggtntccagtgtgaagtgcagcgtggtggagtcggtgggggagtcgttggtacagccgtggcacggtccctganactctcgtgtgcagcctcgtggtacttcctactttgatgtatttagtcgcctagtcgccgtacggttcggggtacccgacgtaacggtcccgtaccgggaggggtaaaccgggtccggtagggtaggtcgggttacctacgttagggtttagtttaggtaggttaaagttgggtacgtacgttaagtagttacggtacctaggtcgaccgggttattccggtggtacgggaccggtaccgtacgttaccactacgtccaccgagaaacgaaacccgaaccgacccgaaagtaaccccttcctaacgtaacttaccgtaaaactaacgtaacgtaacgtagttcgaacgtaagtacgcgttacggaaacggaccggttacccggtacttttaagtacgtttaaccgtaaggttacgaaacggtaaggtaacggtagttaacggaccg

SEQ ID NO: 428794 - DNA, 629 bp, Homo sapiens
  misc_feature: GZ8MTXP02GV0US.19.53.E09.1.454.CMB.2.raw
  modified_base (293)..(293): a, c, t, g, unknown or other
  modified_base (446)..(446): a, c, t, g, unknown or other
  modified_base (509)..(509): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctaattttaaaaggtgtccagtgtgaagtgcagctggtggagtcgtgggggagtcgttggtacagccgtggcacggtccctggacgtactctcctgtcgcagcctcgtaggacttcacctttgatgtattangcctagcgcgtacggtcggcagacgtcgacgggagggaccggtcggtagggtaggtcggtacgtacggtagttagttaggtagtagtagtatcgtagtactctaccgtgtcggacgtcttagtggaacggaccgtacttactaacccgtaacnccttacgaacgaggaaaccaaccgtaaccgtaccaaaaccgttccctacgttactaccgtaanaacgtaagtaacgtacaacgtagtacgacgacgtcgtaacggacgtacgtaaccgtcgtttacgttacgttacgtaggtaacggtacggaaacggtaaggtactacgtacgacgtaacgg

SEQ ID NO: 428795 - DNA, 605 bp, Homo sapiens
  misc_feature: GZ8MTXP02FRPXY.19.53.E09.1.454.CMB.2.raw
  modified_base (226)..(226): a, c, t, g, unknown or other
  modified_base (283)..(283): a, c, t, g, unknown or other
  modified_base (308)..(308): a, c, t, g, unknown or other
  modified_base (506)..(506): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggctaattttaaaaggtgtccagtgtgaagtgcagctggtggagtcgtgggggagtcgttggtacngccgtggcaggtcctgagctctctgtgcagcctctggacttctactttgatgattangcctatgctacggtcgggtcccganaacggcctaccgggaggggaacgggtcctggggaggtcgggtctaccggtaagggtttagttaggttaggaaattaggtcgataggtaatacggaccttagtcggccggtacttcgtaggtacggaaaccgggtctacttacccgactacttaccaccgaagaacgaccgaacgtaccaaacgtacctcctagtaacnctagaactaaatcggaactagtctaggaacgtcacgtagacgggtacacggtacctttgtaacttggaagtacgaactaaggggatagtacggactcgg

SEQ ID NO: 428796 - DNA, 663 bp, Homo sapiens
  misc_feature: GZ8MTXP02JJQP2.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttctttggcttaattttaaaaggtgtccagtgtgaagtgcagctggtggagtcgtgggggagcgttggtacagcctggccacggtccctgacgtctctccgtgtcgcacgcctcgtggtactttcctaccgttttgatgtaatttagtcgcctagtcgacctacggttcggggtccggacaacggtcctacgggaaggggaacggtccgtggggtacgtccggggtcctaggtaggttagttaggtaggaattgggtacgtacgttaagtatacgtaccttagtcgggaaccggtcttggtggtaacgggaacgggtacccttattcccgaaccttagttcccgaccgaagaaaccggaaccaaaccgaaccctaaacgtacccttaccctagttaactcgtaacgaactaaaagtcggaaacctgtacgtaggacgtacgcgtaggacggtaccacggttcttagtaacttacgcggtacgagtaaggtacggtatacg

SEQ ID NO: 428797 - DNA, 585 bp, Homo sapiens
  misc_feature: GZ8MTXP02J0J4L.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttggtacagcctggcaggtccctgagactctcctgtgcagcctctggattcacctttgatgattatgccatgcacgtgggtccgacaagcctacgaggggaacggccgtgggaggtcgggtctccgaggttattaggttaggaattaggtgtctaagtatacgcctagtcgcggactcgtggtaggaaacggggccgtaattccgacctatccgtacccgaagacggaaccaaaccggacccaaacgaacctccccttagtaacttcctagaacctaaagtacggaaactagtacctaggaagacgtacgaggaacggtacgacggtccgtttagtaacttacgtgtacgacgaaggtagtatacgacacg

SEQ ID NO: 428798 - DNA, 672 bp, Homo sapiens
  misc_feature: GZ8MTXP02FXOLA.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggcttattttaaaaggtgtccagtgtgaagtgcagcgtggtggagtcgtgggggagtcgttggtacagccgtggcacggtccctgacgactctccgtgtgcacgcctcgtggacttctacctttgatgtatttagtcgcctagtcgctaccggtcgggtacccgaacgaacgtccgtacggtaacggggaaacgggtccggtaggggtacggtccggggttaccttaccggtaagggtttaagtttaagggttaggtaaagttgggtacggtacgttaaaggttaacgtacgtccgttaagtcggtaccggtacttccgtagggtacggaacggggtaccctattacccactatcctacagaacgaaccaaacggaccctaagtaccctccgtatacctcgtacgataaacgtacgaaactagttcaggagacgtacgaggacgtaccgtacggttacttaggtaattacggtagtacggtacgtaaagggtagtacgtaacg

SEQ ID NO: 428799 - DNA, 730 bp, Homo sapiens
  misc_feature: GZ8MTXP02IJE9D.19.53.E09.1.454.CMB.2.raw
  modified_base (275)..(275): a, c, t, g, unknown or other
  modified_base (670)..(670): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtagagtgcagctggtggagtcgtgggggagtcttggtacagccgtggcacggtccctgagacctctcctgtgcagcctntggtattcctacctttgatgtaatttagtcgacctagtcgaccgtacggttcggggtaccgacgaacgtccgtaccgggaaggggtaacgggtccgtaggggtacggtccggggtactacggtaaggtttagttaggttaggtaaattgggtcgtacgttaaaggttacgtacgtccttagtcgggaccgtacgtcggttaggacgggtaacggtacccgttattacccaaccgttacgtacccgtaacgacgaaacggaaaccccgtaaaccgaacccgtaaaccgtaacccttccgttaagttacccgtcgtagaactaaaacgtacgtaaacgaggttcctaaggacggtacggtacgtaacgggaaaccggtaccgtaaaccccgggtttntttaacgttaacgtttacggtacggtaacggtaaacggtaacgggttaacgtaacgtacg

SEQ ID NO: 428800 - DNA, 666 bp, Homo sapiens
  misc_feature: GZ8MTXP02GRDQQ.19.53.E09.1.454.CMB.2.raw
  modified_base (301)..(301): a, c, t, g, unknown or other
  modified_base (587)..(587): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttccttttggcttaattttaaaaggtgtccagtgtgaagtgcagcgtggtggagtcgtgggggagtcgttggacagcctggcaggtccctgacgctctctgtgcagcctgtggtactttcacctttgatgtattatcncctatcgctacgtcggggtccgacaaacggccgtaccggaaggggaacggggccgtagggacggtcggggtactcggtaaggtttaagtttaggttaggtaaacgttaggttcgtacgttaaaggttactacgtaccgttagtcggtaccggtaacttcggtaggttacggaaacggggtcccgtaaacttccaacccgtattcccaccgaagaaaccgaaacgaaaccgtacccgaaaagacccttacccgttagtaactctagaactaaaatcggaaatacgtntaggaacgagtacctaagggacgtaccgtacgtcctttaggaacttacgtgtacgacgtaaaaggtacggtactaacgg

SEQ ID NO: 428801 - DNA, 674 bp, Homo sapiens
  misc_feature: GZ8MTXP02GKANQ.19.53.E09.1.454.CMB.2.raw
  modified_base (293)..(293): a, c, t, g, unknown or other
  modified_base (658)..(658): a, c, t, g, unknown or other
tcagtactctcgtgcacgaccggtgctcgatttagagagagtgtgttggggtttggggaggcttggtacagcctggcaggtccctgagactctcctgtgcagcctctggattcacctttgatgattatgccatgcactgggtccggcaagctccgagggaaggcctggagtgggtctcaggtattagttggaatagtgctagtatagcctatgcggactctgtgaacgggccattcaccatctcagagacaacgcaaagacctcctgtatctagacaaatgaacagtcagagngcgtgaacggacacggtcctttgtaacttactggtagacgaaagggtagttaactacggcctaaggtccttaacgtacgggttaaaccgaccgttaacgggtccggggggaaccctaacgggggtaacccccttggggtacccctaaccccggttcctcccgttaccacccggtccctaccccgaaccgtaaacgggccccctaagtcccgggttccccttcccccggtcgggcccgtccccgtcgacccgttaccgacggaacgtcccaaccccgtcgacgacgaccaacgcggtcccggcccgttagggccttcgacccgttggacaacggtaccttacctacccgaagtacgacgtaccggngacggtcggacgtcgg

SEQ ID NO: 428802 - DNA, 621 bp, Homo sapiens
  misc_feature: GZ8MTXP02F5JXS.19.53.E09.1.454.CMB.2.raw
  modified_base (275)..(275): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaaggtgtccagtgtgaagtgcagcgtggtggagtcgtgggggagtcttggtacagcctggcaggtccctgacgactctcctgtgcagtcctntggcttcacctttgatgattatgcctatcgctacgtggggtcccgacaacgtccgtaccggaaggggaacgggtccgtaggggaggttcggggtacctacggtaaggttagtttaggttaggaattaggtgtacttaggtaatacgtacctagtcgggacgtactcgtggtaacggaacgggtccgtaacttcccgaactactcctaccgaagaacgaaccaaaccgtaccaaagtaaccctcccgtagtaactctaaggactaaaatgaaacgtagtcgtaagtacgagtcaaggacggactaccggtcttagaacttcgaggtacgagtaacggagtacgtacg

SEQ ID NO: 428803 - DNA, 658 bp, Homo sapiens
  misc_feature: GZ8MTXP02GD71G.19.53.E09.1.454.CMB.2.raw
  modified_base (291)..(291): a, c, t, g, unknown or other
  modified_base (293)..(293): a, c, t, g, unknown or other
  modified_base (577)..(577): a, c, t, g, unknown or other
  modified_base (648)..(648): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttaattttaaaaggtgtccagtgtgaagtgcagctgggtggaggtcgtgggggaggcgttggtacaggccgtgggccaggtccctgagactctcctgtcgcagcctctggacttcactttgatgattancnccatgctacgtcggggtccgacgaacggtccgtacccgggaaggggaaccggggtccgtaggggtaggtcggggtctaccggtaggttagtttaaggttagggtaattaggtcgacgttaagtagtacgtcctaagtcggacggtacttgtcggtaaggaacgggaccgtacttaccgaaccctacgttaccgtacccgaagaacgaaccgaaaaccgtacccaaaagtaaccctccgtatacgtaccagtaaacaaagttcgaaacgtgtaccgtgaggtacncggtaggacggaacgtaccggtaccgttaggtaacttacggtggtaacgtaacggaaggggagtttaaacncgtacgtacg

SEQ ID NO: 428804 - DNA, 662 bp, Homo sapiens
  misc_feature: GZ8MTXP02F0MXT.19.53.E09.1.454.CMB.2.raw
  modified_base (323)..(323): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggcttaattttaaaaggtgtccagtgtgaagtgcagctgggtggagtcgtgggggagtcttggtacagcctggcacggtccctgagactctctgtgcagcctgtggactttcctacctttgatgtatttatcgccatcgcacgtggggtccganaacgctacggaggggacggcgtggaggtcgggtctacggtaggttagttaggttacggaattgggtcgtacgttaaaggttaagtacgtaccgttaagttcgggtaccggtaactttccggtagggtaacggggtaacggggtacccgtactttacccgaacctacgttacccaccgaagaaacgaaaccaaaccgaacccgtaaacgtaaacccttcccttaagtacctcgtacgaaactaaagtacggaaacctagttacgaggacgtaggtacgagggaacggaccgtacggtcctttagtaacgttcgtaggtacgaggtaaaggagtactacgg

SEQ ID NO: 428805 - DNA, 729 bp, Homo sapiens
  misc_feature: GZ8MTXP02GM3KX.19.53.E09.1.454.CMB.2.raw
  modified_base (266)..(266): a, c, t, g, unknown or other
  modified_base (274)..(274): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaagttttaaaaggtgtccagtgtgaagtgcagctgggtggagtcgtgggggagtcttggtacagcctggcaggtccctgacgactctctgncactcctntggtattcctactttgatgtattatcgcctagtcgacctacggtcggggtcccggactaacggtccgtaccgggaaagggggtaaccggggtccggttaggggtacggttccggggtacctacggttaaggggtttaagtttagggttagggaaagttagggtcgtacgttaaggttactaacggtccttagtcggaccgtattcggtggtaacgggacggtcccgtattacccaacgtacttccacgaagaaccgaaaccaaaccgacgtaaacgtaacctcccgtagtactcgtacgaaacgtaaatacggaaactacggttaccgtaggaaacggtacggttacggaaacgggtaaccggtaacccggtacccggttaccgtttttaggtaacgttttaccggtcgggtaaaggtaccggtaaaaggggttaacggttagtaaaacccgggg

SEQ ID NO: 428806 - DNA, 653 bp, Homo sapiens
  misc_feature: GZ8MTXP02HYOIL.19.53.E09.1.454.CMB.2.raw
  modified_base (235)..(235): a, c, t, g, unknown or other
  modified_base (297)..(297): a, c, t, g, unknown or other
  modified_base (398)..(398): a, c, t, g, unknown or other
  modified_base (579)..(579): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggctattttaaaaggtgtccagtgtgaagtgcagcgtggtggagtcgtgggggagcgttggtacngcgtggcacggtccctgagctctctgtgcagcctctggtacttcctacctttgatgtattancgccagtcgctacggtcggggtccgacgaagccgtaccggaaggggacggtccgtgggacgtcgggtactagtaggttagttaggttacggaattacggtntaacgttagtaacgtacgtcctaagtcggaccgtacttcgtagggttacggacgggtaccgttacgtacctaacccgtacttcccgaaccgaggtaaacgaaccgtaaaccgaaccctaaacgtacccttacccggtatacgttcacggaaaactagtaacgaacgtgactggtaaacggngtacgacgggaacgtaccgtacgttacgttacgtaacgttacgtacggtacgaacggtacggtaacgtacgtcg

SEQ ID NO: 428807 - DNA, 722 bp, Homo sapiens
  misc_feature: GZ8MTXP02FMQYV.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaggtgtccagtgtgaagtgcagcgtggtggagtcggtgggggagtcgttggtacagccgtggcacggtccctgacgactctccgtgtgcagcctcgtaggtattcctaccgtttagattagtatttagtcgacctatcgccgtacggttccggggtacccggaccaacggtcccgtacccgggaaggggaaccggggtccgtaggggaggtcggggtacttaccccggtaagggttagtttaggtttaggggtaaagttaggtcggtacgttagtaacgttacggtaccgttagtacgggtccggtacgttaccgttaggggtaaggaacggggtacccgtaattacccaccgtacgtcctaccgaacgacgaaaccgaaaccgtaccaaacgtaaccctacccgtagtactactagaaccaaagtacgaaactaccgttagaggaagtacggacgtagggaaaccgggtacgtaccggtaccgtttaacgtaacccgtttacgtaagttacggaaacgtaacgggtacgtaagtacgactaaaccggg

SEQ ID NO: 428808 - DNA, 573 bp, Homo sapiens
  misc_feature: GZ8MTXP02JUBRQ.19.53.E09.1.454.CMB.2.raw
  modified_base (258)..(258): a, c, t, g, unknown or other
  modified_base (401)..(401): a, c, t, g, unknown or other
  modified_base (459)..(459): a, c, t, g, unknown or other
  modified_base (517)..(517): a, c, t, g, unknown or other
tcagtactctcgtgcacgaccggtgctcgatttagagagagtgtgttgggtttggggagctctgggagaggagcccccagcccctgagattcccaggtgtttccattcagtgatcagcactgaacacagaggactcaccatggagttgagactgagctggattttccttttggctattttaaaaggtgtccagtgtgaagtgcagctggtgagtcgtgggggagcttggtacagcctaggcaggtccctgagctctcngtgcagccctatggatttccacgtttgactgattagtcgccatgcacgttggggtcccggacaaggtcccgtaccggaaggggaacggccgttaggggacgtggggttcctagtagggttatttaggtaggaattaggtccgngtaggtatcggctagtgacggtctcgtgaggacggcgtatccgactatcgaccgaganacgaaccggctaagaccctcctatactccgtagaccaagtgaacctgcctagaacggngtcgacgacgacgtacgtacgtacgtaacgtacgtacgtagagaggtaggtagtag

SEQ ID NO: 428809 - DNA, 711 bp, Homo sapiens
  misc_feature: GZ8MTXP02JEH4S.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtgaagtgcagcgtggtggagtcgtgggggagtcgttggtacacgcctggcacggtccctgacgtactcctcgtgtcgcgtacgtcctgtcgtacttacttacgttagtagtagttattacgtcactagtcgaccgtacggtcggggtacccgaacgacgtcccgtaaccggggaacggggtaccggtacggtggggtagggtcgggtaccgtaacggttaaggtttaagttaggttaaggtaagttacggtacgtacggttaagttaaacgtaccgtacgttagtacgggtaccggtacttacggggtagggtaaaccggggaaccgggtcttaactaaccccaacgtccttaaccgaccgaagaaacgaaacccgaaaccgaacccgtaaaactcccctttcgagttacctaccgaagaacctaagtaacgaactcgtgagaacggtcgacgacgggaacgttacccgacgttcgttaaaagttccgtagaagtacgaaggtaagtctaacgagtcctaaacgg

SEQ ID NO: 428810 - DNA, 700 bp, Homo sapiens
  misc_feature: GZ8MTXP02GP9KA.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttaattttaaaaggtgtccagtgtgaagtgcagcgtggtggagtcgtggggggagtcgttggtacagccgtggcaggtcccctgacgactctcctgtgcacgtcctcgtggtacttcctaccgtttgatgtattatcgacctatcggcctacggttcggggtaccccgacgtaacggtcccgtaaccggggaagggggtaaccggggtcccgtagggggtacgggttcgggtccgtacggtaagggttagtttaaggttaggggtaacttggtcgtacgttaaggttagtaccggtaccgttagtcgggtacggtaccttaggttggtaacgggtaaccggggtaccgtaattcccgaaccctaccttccgaccgaacggaaacgaaccgaaaccggtacccaaaacggtacccttacccgtagtaacctctaacgaacctaaagtacgaaacgtgtacgtagacgtaacggcgaaggacgaacgtcggttacttacgttattacgtggtacgtaaggaaggagtagtacgcgtaacg

SEQ ID NO: 428811 - DNA, 804 bp, Homo sapiens
  misc_feature: GZ8MTXP02GJQX2.19.53.E09.1.454.CMB.2.raw
  modified_base (307)..(307): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcacatggagttgagactgagctggtattttcctttggcttaagttttaaaaggtgtccagtgtgaagtgcagcgtggtggagtcgtgggggagtcgttggtacaggccgtgggcacgggttccctggacgtacctctcctggtcgccaggtcctcgtgactttccgactttgaattcgatttancgcctagtcgaccgtacgttcggggaccccgagtaaccggtccgtacccggggaaagggggtaaccgggtccgttagggggacgggttacggggttccttaacggttaaggggtttaaagtttaggggttaggtaaaagttggttcccgtagttaaaggttataaccgggtacccttaagtcgggaccgggttaacctggttagtaagggggacccggtactactttacccaaaccctgttacccacgaacggaaccaacccgaaaaaccggtttccaaaaggtaaccccgtttccgtaagttaaccgtttacctaaccgaaaataaaaccggttaggaaaacccttcgggacttacggaaacgaagggttacccggtaaaggggaacccggttaaaacccgaggggttttcccctttaaaaggtagtttaacccggttaaggaacgggggtttaaaacgtaaagggggttaacgtacggtaaccgttacggtaacg

SEQ ID NO: 428812 - DNA, 595 bp, Homo sapiens
  misc_feature: GZ8MTXP02FINRP.19.53.E09.1.454.CMB.2.raw
  modified_base (268)..(268): a, c, t, g, unknown or other
  modified_base (354)..(354): a, c, t, g, unknown or other
  modified_base (360)..(360): a, c, t, g, unknown or other
tcagtactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccattcaccatctccagagacaacgccaaagaacctcccngtatctgacaaatgaaacagtctgagagctggaggacacgggtcctttagtacttactgtgacaaagggtaggtatagcagctacnggtacnctacgtggggccaaggggaccctgggtccaccgtctcctcacgcctaccaccgaacggcccacgtccggtccttcccccgtcggcccgtcccctcgccgtacccacgggaccgaccacccgtaccgaacgacgacacgacggccggcccggtcgggcctcggccgtggtaccgaaacgggtacctaacccgttacccgaacgacgacggtaccgtaggacggccgggcgtacggg

SEQ ID NO: 428813 - DNA, 564 bp, Homo sapiens
  misc_feature: GZ8MTXP02IKP4B.19.53.E09.1.454.CMB.2.raw
  modified_base (258)..(258): a, c, t, g, unknown or other
  modified_base (300)..(300): a, c, t, g, unknown or other
  modified_base (347)..(347): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggcttatttaaaaggtgtccagtgtgaagtgcagctggtggagtcgtgggggagcttggtacagcctggcaggtccctgagactctcctgtgcagtcctntggtattcacctttgatgattatcgccatgcacgtggtccgnaagctcgaggggagcgtggagtggtctcgaggtattagtgaattgtncgtatagtacgtcctagtgacgtactctggacggaaggcgtattaccaccgaattccaccaagagacaaacgtacccaaagaacccttcccgtaatacgtaccgtcgaactaaaatacggaactaagtcctagggagtagaccgttaggaacgtaccgacggttaccttaggtattaacgtggtacgacgtaaacggtaggtacgttacgagaaacg

SEQ ID NO: 428814 - DNA, 639 bp, Homo sapiens
  misc_feature: GZ8MTXP02H1T07.19.53.E09.1.454.CMB.2.raw
  modified_base (176)..(176): a, c, t, g, unknown or other
  modified_base (296)..(296): a, c, t, g, unknown or other
  modified_base (315)..(315): a, c, t, g, unknown or other
  modified_base (383)..(383): a, c, t, g, unknown or other
  modified_base (638)..(638): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggacttattttaaaggngtccagtgtgaagtgcagctggtggagtcggtgggggagtcgttaggtacagtccgtggcgaggtccctggagtactctcctgtcgacacgccctgtggacttcacgtttgatgtattangccatgcacgtgggtccgnaacgccgtcggaggggtacggctaggggagtcggggtctacgtaggtaatttaggtaggtaaattggntcgttaagttataccgtccgtatcgggactacgtcgtgaggtaacgggcctaattccgaacactctaacaacgagaaccaaccgtccaaaacgtaccttcccgtaagtacttccgaaagaacctaaaagcggtaaaacctacgttacgaggaacgtacggtacggtacgggaaccgtaacccgtacggttccgtttaagttaccttaggtaacggtaacggtaacggtaaacggtacggttacgaacggtaccgng

SEQ ID NO: 428815 - DNA, 770 bp, Homo sapiens
  misc_feature: GZ8MTXP02JZZYK.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggtacttaattttaaaaggtgtccagtgtagaagtgtagcgtggtggaggtcgtggggggaggtcgttgggtacacggccgtagggccgtacggtccccgtaggagtaccttcctccgtgtcgcacgtccctcgtcggtactttctacctttagatagtattatcgacctagtcgcctacggtcgggtccgacgaacgtcgtaccggaaggggaacggggtccgtagggtacggtcggggtacctacggtaagggtttagttagggttaggtaaaagttcggtaggttaacgttagtaacgttacggtccttaagtcggacggttaccgttcggtaggttacgggaaaccgggcccgttaacttacccgaaacctacttaccacccgaaaggaaccgaaaacccgtaaacccgaaccgtaaaaccgaaccccgttacccgttacgttaacctacgttaacgaaactaaacgtaacggtaaaacctaggtacgtaaggacgggaacggtccgtaaaggggaacggaaaccgtaccggttaccgtttaagttacgtttacggtaggtaaggtaaacgggtaacgggtaagtagtacggaactacggtaccg

SEQ ID NO: 428816 - DNA, 620 bp, Homo sapiens
  misc_feature: GZ8MTXP02F259Z.19.53.E09.1.454.CMB.2.raw
  modified_base (227)..(227): a, c, t, g, unknown or other
  modified_base (550)..(550): a, c, t, g, unknown or other
tcagtactctcgtgcacgaccggtgctcgatttagagagagtgtgttggctctgggagaggagccccagccctgagattcccaggtgcttccattcagtgatcagcactgaacacagaggactcaccatggagttgagactgagctggtattttcctttggcttaattttaaaaggtgtccagtgtgaagtgcagctgggtggagtcgtgggggagtcgttggtacngccgtggcacggtccctgacgtctctcctgtcgcacgcctgtgtacttctacctttgactgtattagtgacctagtcgaccgtacggttcggggcccggacaacggccgtaccggagggggaaccggtccggtaggggaggttcggtcctacgtaaggttatttaggttaggaattggtcgtactaaggtagtacgtcctagtcggcgtacttgtggtaggaacgggctagttacccacctagtacctaccgagacaaaccgaaccgaccaaacgaaccttccgtagtactacgacgaactaagtaccaatacgctagaacgngtacgtagacggacgtaccggtacttgttaacgtaacgttacggagaacggtagtaggacgtacgtacgg

SEQ ID NO: 428817 - DNA, 737 bp, Homo sapiens
  misc_feature: GZ8MTXP02FHT95.19.53.E09.1.454.CMB.2.raw
  modified_base (235)..(235): a, c, t, g, unknown or other
  modified_base (252)..(252): a, c, t, g, unknown or other
  modified_base (259)..(259): a, c, t, g, unknown or other
  modified_base (265)..(265): a, c, t, g, unknown or other
  modified_base (272)..(272): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttcctttggcttaattttaaaaggtgtccagtgtgaagtgcagctggtggagtcgtgggggagtcttggacngccgtggcacggtcccngagcctncctgtncagcctntggtattcctacctttgatgtatttactcgcctagtccgctacggtcggggtcccgtaacaacgtccgaccgggaaaggggaaccggggtccgtaggggtaggtccgggttacctaggaagggtttagtttaggttaggtaaagttgtcgtacttaaggttagtacgtccttagtcggtacggtacttcggttaggtacggtaacggggcccgttacttacccgtaaccgtaacgttccgaccgaacggaaaccgaaacccgaaacccggtaaccctaaaaccggtaaaccccgttaccccgttagtaaaccgttcgtaacgtaaacgtaaaacgttcgaaaaccctagggttaccgaggtaaacggtacggtaacggttacgggaaacggtaacccgtaccgggttcctttaacggtaagttaccggtaggtacggaacggtaagggtaaggttacaaacgggg

SEQ ID NO: 428818 - DNA, 516 bp, Homo sapiens
  misc_feature: GZ8MTXP02ISNLX.19.53.E09.1.454.CMB.2.raw
  modified_base (352)..(352): a, c, t, g, unknown or other
  modified_base (370)..(370): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagcctggcaggtccctgagactctctgtgcagctctggattcactttgatgattatgccatgcactgggtccgcagctccgagggaggcctggagtggtctcaggtattagtagatgtnctagtatagctagtgcgntgtgtagaggcgattccacatctcagacgaacaacgaccaagtacctcctgtactcgtagacaaaatgaaacagttcacgagagctaggacgtaccgacggtccttaggtaacttaccgtaggtgacgtaaaggacggtagtaacg

SEQ ID NO: 428819 - DNA, 677 bp, Homo sapiens
  misc_feature: GZ8MTXP02FQTQK.19.53.E09.1.454.CMB.2.raw
  modified_base (250)..(250): a, c, t, g, unknown or other
  modified_base (276)..(276): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggcttaattttaaaaggtgtccagtgtgaagtgcagctggtggagtcgtgggggagcgttggtacagcctggcaggtcccngagacctctcctgtgcagcctctggnttctacctttgactgtattatcgaccatgcctacgtcgggtccggacaagccgtaccggaggggaacgggccgtgggacggtcgggtcctacgagggttatttaggtaggtaattggtgtacgttagttactacgtaccttagtcggtacgtacgttccgtaggtacggaacggggtacccgtacgtaccaacctacttccgaccgaacgaacgaaccgaaaccgaaccaaacgtaacccttacccgtagtaactcgtacgaactaaaacgtacgaaacgtacgttactacggtaacgagtacgtacgggtaacggaaccgtacccggggttccttttaaaggttaacgtttaccgtaggttacggaaccggtaaacgggtaaacggttaacgtaaacggg

SEQ ID NO: 428820 - DNA, 642 bp, Homo sapiens
  misc_feature: GZ8MTXP02GVY14.19.53.E09.1.454.CMB.2.raw
  modified_base (302)..(302): a, c, t, g, unknown or other
  modified_base (304)..(304): a, c, t, g, unknown or other
  modified_base (396)..(396): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaagttttaaaaggtgtccagtgtgaagtgcagcgtggtggagtcgtgggggagtcgttggtacagccgtggcacggtccctagagctctcgtgtcgcagcctcgtggcttcactttgatgtatttancnctatcgctacggtcggggtaccgacaacgctaccggaggggaacggccgtgggaggtcgggtactcgtaggttagttaggtaggtaatggtntagttagtagtacgtcgtagtcgacggtactcgtcgtaggaacggcgtattaccactaactccacacgaaacgaacctaacgaaccgtaaacgacccttaccctagtactacgtacgaactaaaagaacgtaaacgtacgtacgtaggacgtaaggcgtaggtaaaccggtaccgtacccggttaccgttacgttaacgtttacgtacggttacggtaagtaaacgggtaacggtttaagaaccgg

SEQ ID NO: 428821 - DNA, 628 bp, Homo sapiens
  misc_feature: GZ8MTXP02JQPSS.19.53.E09.1.454.CMB.2.raw
  modified_base (265)..(265): a, c, t, g, unknown or other
  modified_base (284)..(284): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagtcgttggtacagccgtggcacggtccctgacgtctctcctgtgcagcctcnggattcactttgatgattntgccatgctacgtgggtccgcaacggcctcggaggggaacgggccgtaggggtaggtcggtcgtacgtagggttatttaggtaggtagttaggtagtcgtagtagtacgtcctagtcgacggtactcgtgtaggaaacggtcgtacttacccgaccatccctacgacgacgaaccaacgaccaaacgaaccttcccgtagtaccttacgtacgaactaaacgtacgaaacgtcgtacgtaggaacggtaacggtccgtaaggggaccggtaaacccgtacgggtttaccttacggttaaccttagttccggagtaacggtaagggtagtagtacgacgtaacgg

SEQ ID NO: 428822 - DNA, 722 bp, Homo sapiens
  misc_feature: GZ8MTXP02FJX7D.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtcagtgtgaagtgcagctggtggagtcgtgggggagtcgttggtacagcctggcaggtccctgacgactctcctgtcgcagccctctggtacttccaccttttgattgtaattatcgacctatcgcgtacggtcggggtcccggacaaggccgtacccggaagggggaacgggccgttggggaggttcggggtctacggtaaggttattagggttaggaaagttggtagtactaagtatacgtacctaagtcgggaccgggtacttcgtagggtaaggtaaacggggtccctaagtttacccaaccctagttaccctacccgaaagggaaaccgaacccgaaaacccggacccaaaacgtaaccccgttccccgttagttaaccttaccgtacgaaacctaaaagttcggaaaacgttaggttacgtaaggaacggtaacgcggtaacgggaacggaaccgtacggggtttaccctttaaggtaacctttacgggtaaggtacggtaaacgtaaaagggggttataaaggtacggactaacgg

SEQ ID NO: 428823 - DNA, 572 bp, Homo sapiens
  misc_feature: GZ8MTXP02GD723.19.53.E09.1.454.CMB.2.raw
  modified_base (261)..(261): a, c, t, g, unknown or other
  modified_base (275)..(275): a, c, t, g, unknown or other
  modified_base (501)..(501): a, c, t, g, unknown or other
tcagtactctcgtgcacgaccggtgctcgatttagagagagtgtgttgggtttcggggagctctgggagaggagccccagccctggagattcccaggtgtttccattcagtgatcagcactgaacacagaggactcaaccatggagttgagactgagctggtatttttccttttggcttaattttaaaaggtgtaccagtgtagaagtgcagctggtggagtcgtgggggagcttggacagcctgcaggtccctgagactntcctgtgcagcctngattcactttgatgatatgcatgcactggtcggacaagcaccgaaggaacgggaccgtacggtaggtggtcgtacgtaggtaattagttaggtaagtagtggtactaaggtaagttaaagtactagtacgtacgtactacgtagtaggacggacgtactacacacacacaagaacaacaaacgaacaaacaactacctactactactacaacaaacacaacagtanacgagacgacgagaacgaacgaacgtacgttagtaagttacgtacgtacgaagaaaggtaacgtaagtaag

SEQ ID NO: 428824 - DNA, 645 bp, Homo sapiens
  misc_feature: GZ8MTXP02FG6DF.19.53.E09.1.454.CMB.2.raw
  modified_base (182)..(182): a, c, t, g, unknown or other
  modified_base (281)..(281): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctatttaaaaggtgtccagtntgaagtgcagctgtggagtcgtgggggagcttggtacagcctggcaggtccctgagactctcctgtgcagcctctggattcacctttgactgactttangccatcgcctacggttcggggtacccgacgtaacgccgtaccgggaaggggaacgggtccgtaggggacggttcggggtacctaccggtaggtttagttacggttaggtaagtagttgtactagtactacgtccttagtcggacgtacttcgtaggtacggaacgggacctattacccgaaccacttaccgtaccgaaagaaccgtaaccgaaacccgtaccgaaacgtacccttccgtagtaacctctaacgaactaaaagtcgaaactgtacgagagacgtcgaggaacggaccgtaccggttacgttagtaaccttaacgtggtacggaaacgtaagggtacgtaaacgtaccgcgtaacg

SEQ ID NO: 428825 - DNA, 689 bp, Homo sapiens
  misc_feature: GZ8MTXP02GN9MV.19.53.E09.1.454.CMB.2.raw
  modified_base (612)..(612): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttattttaaaaggtgtccagtgtgaagtgcagcgtggtggagtcgtgggggagtcgttggtacagccgtggcacggtccctgagactctctgtgcagtcctcgtggattctaccgtttgatgtattagtcgacctagtcgcgtacggtcggggtacccggacaacggtccgtacccgggaagggggaaccggtccggtaggggtacggtggggttaccgtacggtaagggtttacgtttaaggttaggtaaattaggttacgtcgttaaggtacgtacgtaccgttaagtcggtaccggtaccgttgtggggtaaaggacggggtccctattacccgaccgtactttcccgaaccgaaggaccgaaacctaaaccggaccctaaaaggtacccccttccgtataaccttccgaacgtaataaacgtagaaacttcgtaagtggaaacgngacgtagggaaccgtacgtaccggttaccttaggttactacggttggacgtaacggaacgggtatagacgactaacg

SEQ ID NO: 428826 - DNA, 692 bp, Homo sapiens
  misc_feature: GZ8MTXP02F2I85.19.53.E09.1.454.CMB.2.raw
  modified_base (272)..(272): a, c, t, g, unknown or other
  modified_base (297)..(297): a, c, t, g, unknown or other
  modified_base (303)..(303): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcacatggagttgagactgagctggtatttttccgttttggacttaagttttaaaaggtgtccagtgtagaagtgcagcgtggtggagtcggtgggggagtcgttagggtacaggccgtggccgaggtccctgacgtcctctcctgtacncgtcctcgtgtatcctactttgatntattancgacctatcgactacggtcgggtaccgacaacggccgtaccggaaggggaacgggtccgtaggggacgttggggtactacggtaaggtttagtttaggtagtaaattggttagtacttaggttagtacgtaccgttaagtcggtacgaccttgtagggtacggaacgggtactactacctaacgactccgtaccgaagaacgaaaccaacccgaaccgaaaccgtaccctaccctagtacttaccgaagaaactaaagacgaaagtcgttacgagtacgagtacggtaacggacggtaaacccgttacggttaccgttaagttaaccgtagttaacggaagtaaaccgggtaaagggttacggttaatacggaaccgtaaggtaacccg

SEQ ID NO: 428827 - DNA, 709 bp, Homo sapiens
  misc_feature: GZ8MTXP02G967E.19.53.E09.1.454.CMB.2.raw
  modified_base (291)..(291): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttaattttaaaaggtgtccagtgtgaagtgcagcgtggtggagtcgtgggggagtcgttggtacagccgtggcaggtccctgagactctctgtgcagcctctggtattcacctttgacttagatttacncgacctagtcgacgtacggtcgggtacccggacgaacggccgtaaccgggaaggggtaaccgggtaccggtaggggtacgggttacgggtaccgttaacggtaaaggtttaacgtttaagggtaacggtaaagttaggtacgtacttaagtaagtaacggtcttaaggtcggtacggttacgtcgtagggtacggaaccggtcgtaacttcccgaacctactaccctacgaacgacgtaaccgaaaccgaccgtaaaaccgtaccttaccgtagtactacgtacgaaactaaacgtaacgtaacgtaacgtacgtagtaacggtacggtacggtacggaacggtaccgtaccggttacgttacgttacgttacgtaacgtacgtaacggtaacggtaaggtaacgtacgtacgtaacg

SEQ ID NO: 428828 - DNA, 640 bp, Homo sapiens
  misc_feature: GZ8MTXP02G5XFE.19.53.E09.1.454.CMB.2.raw
  modified_base (216)..(216): a, c, t, g, unknown or other
  modified_base (518)..(518): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgngggggagcttggtacagcctggcaggtccctgagactctccgtgtgcagcctctggatttccaccttttgaattgaactttatcgacctagttcgctaacgtcggggtcccgacaaacgtccaccgagggggaaacggcctgggacgtcgggtctacgtaggtatttaggtcgaaagttcgtcgtacgtaggtaatacggaccttagtcgggacgtacttcgtcgtacggaagggtcccgtaacttccaaccagtacctccgaaagaacgaacaaaccggaccaaacgtaacctcccgtaanacgtactacggacaaacgtacgaacacgttcgacggagacgtacgtagaaccgggaaactccggggtacttttacggaactttaccggtgtaccgggaagtaacgggtacggttaataccgg

SEQ ID NO: 428829 - DNA, 727 bp, Homo sapiens
  misc_feature: GZ8MTXP02IIW87.19.53.E09.1.454.CMB.2.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttaattttaaaggtgtccagtgtgaagtgcagcgtgggtggagtcggtgggggaggtcttgggtacagcccgtggctacggtccctggagacctcctcctgtacgcagtcctcgtggtactttcctaaccttttgattcgtatttagtcgcctagtcgcctaacggtcggggtacccggacaacggtccgtaccggaaggggaacgggtccgtaggggtaggttccggggtactacggtaaggtttaagtttagggttagtaagttcggtgtacgttaaagttactacgtccgttaagtcgggaccgttacgtcggttggtacgggaaacgggtccccgtacttaccaacctacttcccgaccgaacgaaacgaacccgaaaccgaccctaaaacgtaccccttacccgtagtacctactacgtaaccaaaattcgaaaacgtcgtacgtaaggaggtacgcggttaacggaacgggtaccgtacggggttacctttagtaacgtttaccggtacggttacggaaacggtaacgggtaacggttagtaacccgg

SEQ ID NO: 428830 - DNA, 635 bp, Homo sapiens
  misc_feature: GZ8MTXP02JCT1B.19.53.E09.1.454.CMB.2.raw
  modified_base (247)..(247): a, c, t, g, unknown or other
  modified_base (339)..(339): a, c, t, g, unknown or other
  modified_base (538)..(538): a, c, t, g, unknown or other
tcagtactctcgtgcacgaccggtgctcgatttagagagagtgtgttgggtttggggaggcttggtacagcctggcaggtccctgagactctcctgtgcagcctctggattcacctttgatgattatgccatgcacgtgggtccggcaagctccgagggaagggcctggagtgggtctcgaggttattagttggaatagtgctagtatagcctatgcggactctgtgaagggcctattccaccatcnccagagacaacgccaaagaacctcctatactctgacaaagtagaacagtctagagagcgtagacggactcgggtcctttgtacttacgttgnggtacgaaaggggtaggtaatcggactacgtactacgtacgggtacgaccgttacgggtacgggggaccaaacgggggtaacccctgggtcccgtacccgtccctccgtcccgtaacgcccctacccaacccggaccgggtccccacggttcccgttcccgttccccgtgccccgtcctcgaccctcgaacgccgaccncccgtacgagacgacgacgacgccggccgtcgggctcgggaccgtcggacgtaacgacccttcacccgaagcgtactcgaggcgtaccggcgtacgg

SEQ ID NO: 428831 - DNA, 605 bp, Homo sapiens
  misc_feature: GZ8MTXP02JMROF.19.53.E09.1.454.CMB.2.raw
  modified_base (273)..(273): a, c, t, g, unknown or other
  modified_base (278)..(278): a, c, t, g, unknown or other
  modified_base (281)..(281): a, c, t, g, unknown or other
  modified_base (289)..(289): a, c, t, g, unknown or other
  modified_base (297)..(297): a, c, t, g, unknown or other
  modified_base (421)..(421): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggcttattttaaaaggtgtccagtgtagaagtgcagcgtggtggagtcggtgggggaggtcttgggtatagccgtggcacggtccctgacgactcctctgtgcngcctntgnttcacttnatgtatancgacatcgctcggtcgggtccgagaacgccgtaccggaaggggaacggtccgtaggtaggtcgggtactggtagttagttagttagaattggtacgtagtaagtatacgtactgtcggaccgtnttaccggtgtacgggacgggtaccgttactacccgtaccaacttccaacgaagaacgaaaccgaaccgaacccgtaaacgtaccctaccgtagtactcgtaagaccaagtacgaactgtcgtaagacgtagacgtggaacgacgtacggtccttaggtctagcgtaggacgaaggtacgatacg

SEQ ID NO: 428832 - DNA, 636 bp, Homo sapiens
  misc_feature: GZ8MTXP02FEQQS.19.53.E09.1.454.CMB.2.raw
  modified_base (244)..(244): a, c, t, g, unknown or other
  modified_base (291)..(291): a, c, t, g, unknown or other
  modified_base (327)..(327): a, c, t, g, unknown or other
  modified_base (370)..(370): a, c, t, g, unknown or other
  modified_base (496)..(496): a, c, t, g, unknown or other
tcagtactctcgtgcacgaccggtgctcgatttagagagagtgtgttgggtctgggggaggcttggtacagcctggcaggtccctgagactctcctgtgcagcctctggattcaccttttgatgattatgccatgcactgggtccggcaagctccagggaagggcctggagtgggtctcaggttattagttggaatagtgctagtatagcctatgcggactctgtgaagggccattcaccatcnccagagacaacgcaaagaactccctgtatctgacaaatgaacagtcngagagctgacggcacggtccttagtaatttacgtgngtacgaaaggacggtatagcagtctacgtgggtacgactacgngggggtacccaaggggaaccctgggtacacccgttctccctcgacgccctcccaacccaaacggggtccccaagttcccggtcccttcccccgtcggcccgccccttcggcctacccgaggggacnccctaacccgtccggaagacgccaacgacggtcccgggcccttgggggcctcggccccgttagggtacccgaaaacgggaaccctttacccgtaaccccgaaacggtaacgtacggtaccttaggacggcggggtaaccg

SEQ ID NO: 428833 - DNA, 694 bp, Homo sapiens
  misc_feature: GZ8MTXP02FJCI6.19.53.E09.1.454.CMB.2.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtgggggagcttgggtacagcctggcaggtccctgagactctcctgtgcagcctctggattcacctttgatgattatgccatcgctacgtcggggtccggcaacggccgtacccgaaggggaacggggcccgtggggaggttcggggtctaccgaggttataggttggtaataggtgtcgtacgtaatagtccgtatcggacggtacttcgtggttacggaaacgggtccgtaacttaccgacccctagtacctacccgaacgaacggaaccaaaaccgacccgaaagtaaaccctcccgttacgtaacttcgttacggaaacctaaaacgttacgaaaaccgtacggttaccgttagggaaaaggtacggttaccgtaggggtaaacccgggaaccggttaacccggtacccgttttacgggttaactttaaaccggtggttaccgaaacggtaaagggggacggtttaaagtaaccggaccgtaaacgg

SEQ ID NO: 428834 - DNA, 640 bp, Homo sapiens
  misc_feature: GZ8MTXP02IEDW4.19.53.E09.1.454.CMB.2.raw
  modified_base (276)..(276): a, c, t, g, unknown or other
  modified_base (414)..(414): a, c, t, g, unknown or other
  modified_base (434)..(434): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggcttattttaaaaggtgtcagtgtgaagtgcagctggtggagtcgtgggggagcgttggtacaggcctgggcacggtccctagagacctctcgtgtcgcagccctnggtacttcctactttgattgtatttatgcctatcgctaggtcgggtcgtaggcaaaggtccgtaccgggaaggggacggggccgtaggaccggttggggtacctaggtaggttagtttaggttagtacgttaggttancgttagtaattcgacttagngtcgtacgtgtaggtacgggaagggtacccatttacccaacccgtaattcccgaacgacgaacgaccgaaacgaccaaaacggtacctcccgtagtactacacgtaactaatacggtaacaaacgttcgaagagacgtaccgtaggaacgtaccgtacgtaccgttaagttaatacgttcggacgtacggtaaagggtagtaaacg

SEQ ID NO: 428835 - DNA, 567 bp, Homo sapiens
  misc_feature: GZ8MTXP02JQ9VB.19.53.E09.1.454.CMB.2.raw
  modified_base (301)..(301): a, c, t, g, unknown or other
  modified_base (346)..(346): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctattttaaaggtgtccagtgtgaagtgcagctggtggagtcgtgggggagcttggtacagcctggcaggtcctgagactctctgtgcagcctctggattcacctttgatgattatgccatgccgacgtgggtcccgganaacgtcctccgagggaacgggcctgggagtggggtctccgaagtnttacgtggtaatagtgtcgtagtatagcctagtcggcgtaactcgtgtaggaacgggcccgtattccgaacctagtcctacccaagacgaacctaaaccggaccccaaaggtaaccctcccgtacgtataccgtagaccaaattacggaaccaggttacagtagagctacggaaggcaccgggttactagtactagtcgtagacgtagaggtactgactag

SEQ ID NO: 428836 - DNA, 596 bp, Homo sapiens
  misc_feature: GZ8MTXP02HCTGV.19.53.E09.1.454.CMB.2.raw
  modified_base (258)..(258): a, c, t, g, unknown or other
  modified_base (268)..(268): a, c, t, g, unknown or other
  modified_base (399)..(399): a, c, t, g, unknown or other
  modified_base (484)..(484): a, c, t, g, unknown or other
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttcctttggcttattttaaaaggtgtccagtgtgaagtgcagctggtggagtcgtgggggagcttggtacagcctggcaggtccctgagactctcngtgcagcctntggattccactttgatgtattatgcctatgctacgtgggtaccgcaagcctaccggaaggggaacggcctggggacgtcggggtactcgtaaggttagttaggtaggaaatggtgattagtatacgctagngacgactcgtgacggaaggcctaattccgacctatccgaccagtaaccgactaaaccacgtaaacgaacccttccgtacgttacncttagaacaaactacgaaacgtgtacctaggaacgtaggctaagggcggaaacgtacccggttcgttagttaacgttacgtaggttaccaggtaacggggtacttaaggacg

SEQ ID NO: 428837 - DNA, 606 bp, Homo sapiens
  misc_feature: GZ8MTXP02F3IJ3.19.53.E09.1.454.CMB.2.raw
  modified_base (259)..(259): a, c, t, g, unknown or other
  modified_base (285)..(285): a, c, t, g, unknown or other
  modified_base (291)..(291): a, c, t, g, unknown or other
  modified_base (309)..(309): a, c, t, g, unknown or other
  modified_base (384)..(384): a, c, t, g, unknown or other
  modified_base (548)..(548): a, c, t, g, unknown or other
  modified_base (572)..(572): a, c, t, g, unknown or other
tcagtactctcgtgcacgaccggtgctcgatttagagagagtgtgttggctctgggagaggagccccagccctgagattcccaggtgtttccattcagtgatcagcactgaacacagagactcaccatggagttgagactgagctggtatttttcctttggcttaattttaaaaggtgtccagtgtgaagtgcagctggtggagtcggtgggggagtcttaggtacagccgtggcaggtccctgacgactctctgtgcngctcgtgattcactttgatcgattangcctancgacacgtgggtcccganaacgccgtaccggaggggacgggtcctaggggagtcggggtctccggtaagggttatttagggtaggaattaggngtcgtagtactacggtcctaaggtcgacgtactcgttagtaggaacgggacctattcccaactacgtccaccgaagacgaaccaaaccgccaaacgtaaccttcctagtactcagactaaagtcgaaatgtacgagaacggtagacgtaggaaccggtaaccgnggttacccttttagacgtttacgnggtaacgtaaacggaaggtagtaactacgactag

SEQ ID NO: 428838 - DNA, 531 bp, Homo sapiens
  misc_feature: GZ8MTXP02GAQFB.19.53.E09.1.454.CMB.2.raw
  modified_base (280)..(280): a, c, t, g, unknown or other
  modified_base (297)..(297): a, c, t, g, unknown or other
  modified_base (497)..(497): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttgggtacagcctggcaggtccctgagctctcctgtgcagcctctggattcacctttgatgattangcatgcacgtgggccgnaagctcgaggggacggctggagtggtctcgaggtattaggtagaatgtgctaagtatagcctagcgcggtactgtgtaggagggcctagttccacatctacgagacgacaaacgtccaaagtaccctccgtgtactcagacaaatgaaactgtactggaatacggctaggaacggactaccgggtcttaggtatttacgnggtacgtacgaaagggtgaagtacgacgtaacgg

SEQ ID NO: 428839 - DNA, 636 bp, Homo sapiens
  misc_feature: GZ8MTXP02FM4XH.19.53.E09.1.454.CMB.2.raw
  modified_base (179)..(179): a, c, t, g, unknown or other
  modified_base (255)..(255): a, c, t, g, unknown or other
  modified_base (258)..(258): a, c, t, g, unknown or other
  modified_base (567)..(567): a, c, t, g, unknown or other
  modified_base (627)..(627): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttcctttggcttaattttaaaaggtntccagtgtgaagtgcagcgtggtggagtcgtgggggagcgttggtacagcctggcaggtcccagagactctcctgngcngcctgtgacttcacctttgatgattatgccagtcgctacgtggggtcccgagtaacgccgtacccggaaggggtaacgggccgtaggggacggttggggtactacccggtaagggtttattaaggttaggaaagttaggtgtacgtaaaggtactaacggtacctagttacggccgggtacttcgtaggttaggaaacggggtccctattcccaacctatacccgtaccgaacgacgaacccaaaaccgtccgaaagtaaccctcctagtaactcgtacgaacaaatgaaacctagtacgtaggaaagngtacgtagaacggtacaacggtccttagtaagtttcgaaggtacgacgaagggttagtanacgctaacg

SEQ ID NO: 428840 - DNA, 695 bp, Homo sapiens
  misc_feature: GZ8MTXP02GRG8A.19.53.E09.1.454.CMB.2.raw
  modified_base (138)..(138): a, c, t, g, unknown or other
  modified_base (240)..(240): a, c, t, g, unknown or other
  modified_base (264)..(264): a, c, t, g, unknown or other
tcagtactctcgtgcacgaccggtgctcgatttagagagagtgtgttggctctgggagaggagccccagccctgagattcccaggtgtttccattcagtgatcagcactgaacacagaggactcaccatggagttganactgagctggtattttcctttggctattttaaaaggtgtccagtgtgaagtgcagctggtggagtcgtgggggagcgttggtacagccgtggcgaggtcccngagactctccgtgtgcacgtcctnggtactcctacctttgacttgtattatgaccatcggacacgtgggccggacagcctacccgggaggggaaacgggtccgtaggggaggttcgggtcctacggtaggttaatttaggttaggaaagttaggttgtacgttaaggtactacggacctagttcgaccgggtaccgtagtcggtacgggaacggggtcccggtaaatttcccaaccccacgttaccctacccgtaaagacgggaaaccctaaaccggacccaaaaacgtaaccccgttaccccgtattaaccggttccaacgactaaaaccgtagaaacgtaccggttagaggtagtacggtacggtacgaaccggtaccggtacgttaccgttagttaaccgttaacgtgggtaacgtaacggtaaagggtacggtacgaaacggtacgtaacg

SEQ ID NO: 428841 - DNA, 524 bp, Homo sapiens
  misc_feature: GZ8MTXP01E16U4.10.75.G09.1.454.CMB.2.raw
  modified_base (357)..(357): a, c, t, g, unknown or other
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctgggaccagtctgccctgactcagcctgcctccgtgtctgggtctcctggacagtcgatcaccatctcctgcactggaaccagcagtgacgttggtgttataactatgtctcctggtaccaacaacacccaggcaaacgccccaaatcatgatttttgatgtcagtaatcggccctcaggggtttctaatcgcttctctcggctcaagtctggcaacncggcctccctgaccatctctgggctcaggctgaggacgaggctgattatactgcagctcatatacaaccagcagcacttctagtacttcggaacggagggaccaagcgtcgaaccgttccgttaggttccaacgccccaagggcctcgccccctcggttcctaaccg

SEQ ID NO: 428842 - DNA, 564 bp, Homo sapiens
  misc_feature: GZ8MTXP01A685E.10.75.G09.1.454.CMB.2.raw
  modified_base (301)..(301): a, c, t, g, unknown or other
  modified_base (421)..(421): a, c, t, g, unknown or other
tcagcatagtagtgcacgaccggtgctcgatttagtatagacatcagggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgactatttggttactttaaattttgtctcttggtaccaacagagcccagacaaacgcccccaaaattatcatttcngctgtcagtaatcggccctgagggtttctagtcgcttctctggcctcaagtctggcaaacacggcctccctgaccatctctggggctccgaggctggaggacgaggctgtattattatgnagctcatataacaacaacaaagtctttagactattcgggacggaagggaaccaaacgtcgaacccgttccttcgtaccaacgttaccccgaagggccctccgtcccccgttcggtccaccttcctccgtttcccctaaccccc

SEQ ID NO: 428843 - DNA, 860 bp, Homo sapiens
  misc_feature: GZ8MTXP01EO6YW.10.75.G09.1.454.CMB.2.raw
tcagcatagtagtgcacgaccggtgctcgatttagtatagacatcgaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaaagcgaaagtgactatttggtttactttaaattttgtctcttggtaccaacagagcccaagaacaaaacgacccccaaaaattactactaatttctgtcttgtactaagttaaactccgggtaccccttacgtagggggttttcctaaggttccgtcctttcgttcctagggtccccttaccgtaaagttctacgggacctaaaaacccgacccgggtcccttcccctagaacccctaacgttccctacgttcggggcccttacccgaagggtcctagggaacgggaaccgtaaggggtccttagggtaattttaaacgtttaagtttcggactaaagtccttaaccgtaaatttaaacttaaaaccgaaaaaccctaaacccgtaaaaaacggttccgtttttaacggtaaagtttaacggttttacccgggggaccggggtaaaaccgggggtaaacccctaaaaaaccggtttccggttaaaccccgggtttaccccttttaccggggaacccttaaaccggttacccccggaaaacggggttccccgttaaccccgggtacccccccgtttcccggggttacccttaaaccccttccccgggtttcccgtttttaaccccccccgttaaccccccccg

SEQ ID NO: 428844 - DNA, 502 bp, Homo sapiens
  misc_feature: GZ8MTXP01DLVG2.10.75.G09.1.454.CMB.2.raw
  modified_base (310)..(310): a, c, t, g, unknown or other
  modified_base (349)..(349): a, c, t, g, unknown or other
  modified_base (413)..(413): a, c, t, g, unknown or other
  modified_base (432)..(432): a, c, t, g, unknown or other
tcagcatagtagtgcacgaccggtgctcgatttagtatagacatcgagggggggtctcaggaggcagcgctctcgggacgtctccaccatggcctgggctctgctattcctcaccctcctcactcagggcacaggttcctgggaccagtctgccctgactcagcctgcctccgtgtctgggtctcctggacagtcgatcaccatctcctgcactggaaccagcagtgacgttggtgttataactatgtctctggtaccaacaacaccaggcaaagccccaaatcatgattttgatgtcagtaatcgcctnagggtttcaatcgcttctctcggctcaagtctggcaacncggcctccctgaccatctctgggctcaggctgaggacgaggctgattatactgcagctcaatanacaaccagcaagcacttcngtacttcgaacggaggaccaagctgaccttccttggttcaagcccaaggcctcgcccctcggttctaacc

SEQ ID NO: 428845 - DNA, 619 bp, Homo sapiens
  misc_feature: GZ8MTXP01ARYRN.10.75.G09.1.454.CMB.2.raw
  modified_base (265)..(265): a, c, t, g, unknown or other
  modified_base (370)..(370): a, c, t, g, unknown or other
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgactatttggttactttaaatttgtctcttggtaccaanagagcccagacaaacgacccccaaaattatctatttctgctgtcagtaactccggccctgtagggggtttctagtcgtcttctctggccctcagtctggcaaacnccggcctccctgaccatctcgtgggcctccgaggctaggacggacgaggctaggtatttattagttgctagtcctacaataactaacaaacaacctaaagtctttagaattacgttccggggacggtaacgggaaccctaaacgtcggttacccgttccgttcggaccaacgggccccgaagggttcccgtaacccggtccccccgttcgggtaccctaccgttcccgttcccggttcccccgtccccc

SEQ ID NO: 428846 - DNA, 569 bp, Homo sapiens
  misc_feature: GZ8MTXP01BZHY3.10.75.G09.1.454.CMB.2.raw
tcagcatagtagtgcacgaccggtgctcgatttagtatagacatcagggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaaagcgaaaagtgactatttggttactttaaattttgtctcttggtaccaacagagcccagacaaacgacccccaaaattatcatttctgctgtcagtaatcggccctcgtagggggtttctagtcgcttctctggccctccaagtctggcaaacacgcctcctgaccatctctgggctccaggctgaggacgaggctgattattatgcagctacaattaactaacaaacaccaaagtctttagaattacgttcgggacggaacgggaacccaaaacgtcgttaaccggtccttcgtaccagaccccgaagggccctcgcccccgtggtccacgttcctccgtttccccgcccc

SEQ ID NO: 428847 - DNA, 606 bp, Homo sapiens
  misc_feature: GZ8MTXP01ESSWL.10.75.G09.1.454.CMB.2.raw
  modified_base (270)..(270): a, c, t, g, unknown or other
tcagcatagtagtgcacgaccggtgctcgatttagtatagacatcagggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatcctcctgacaagtggaagacgaaagtgactagtttgttactttaatttgtctcttggtacaacanacgccaagacaaacgaccccaaaattatctattactgctgtacataatccgcctgtacgggtttctagtcgtcttctcgtcggccctacgaagtcgtcggaccaaaaccgacggtccctccctacgaccctatcctcgtcgggccttacgacggtctaggagggaccgagggtactgtaatttagttatgacgatctacaataactaacaaacaacctaagtctttagattgtacggacggacggaacctaacgtcgttaccgtacgttcgtacgaccgaccgacgttccgtaacccgtccccgtaacgttccacgttctcccgtttcccaacccc

SEQ ID NO: 428848 - DNA, 605 bp, Homo sapiens
  misc_feature: GZ8MTXP01DR5EX.10.75.G09.1.454.CMB.2.raw
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgactatttggttacttttaaattttgtcttcttggtaccaacagagcccaagaacaaaacgacccccaaaaattatctatttctgctgtacagtaactcggccctgtaggggtttctagtcgtcttctctcggccctccaagtctcggcaaaaccaccggccctccctcgacccatcctcgtcgggcctccgaggctggacggacgagggctagtaatttattattgctaagccttagaattaaactaaacaaaaccaaccaaagtctttagaacttacgttcgggacggtacgggaacctaaacgtcgttaacccgttcttcgtacgacgacccgacggcctccgccccgtgtccacttcctccgttcccctaacccc

SEQ ID NO: 428849 - DNA, 582 bp, Homo sapiens
  misc_feature: GZ8MTXP01DLGH7.10.75.G09.1.454.CMB.2.raw
  modified_base (285)..(285): a, c, t, g, unknown or other
tcagcatagtagtgcacgaccggtgctcgatttagtatagacatcagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggctattataaccttgtctcctggtatcaacaacgcccagacaaagcccccanactcttgatttatgaagtcagtaagcggccctcagggggtttctagtcgcttcctctgcctcaagtctggcaacacggcctccctgacaatctctgggctcaggctgacgacgaggctgaatattactgcagctcatatgtagatggtgtcccttcgtttcgtaaagggtttttcgggacgggttaggggacccgttagggaccgtcggttaaccccgtttcccgttaaaaggttcccaacgggcccccgtaaaggggtccccttaccgggtcccccccgttcccggggtttccccc

SEQ ID NO: 428850 - DNA, 605 bp, Homo sapiens
  misc_feature: GZ8MTXP01EQVNA.10.75.G09.1.454.CMB.2.raw
  modified_base (455)..(455): a, c, t, g, unknown or other
  modified_base (467)..(467): a, c, t, g, unknown or other
  modified_base (469)..(470): a, c, t, g, unknown or other
  modified_base (472)..(472): a, c, t, g, unknown or other
  modified_base (477)..(477): a, c, t, g, unknown or other
tcagcatagtagtgcacgaccggtgctcgatttagtatagacatcagggggggggtctcaggaggcagcgctctcgggacgtctccaccatggcctgggctctgctattcctcaccctcctcactcagggcaaaggttcctgggcccagtctgccctgtctcagcctgcctccgtgtctgggtctcctggacagtcgatcacatctcctgacaagtggaagacgaaagtgactagtttggtttacttttaaattttgtcttcgttaggtaaccaacagacgacccaagaacaaacgacccctaaaattatactatttctgctgtacagtaactccgcctcgtaggggtttctagtcgtcttctcgtcggcctaccaagtcgtaggaccaaaccgaacccggccctccctagaaccctatcgtcgtcggggctaccgaggctaggaggacgaggtntagtatttattntnnanactanaactaataacaaacaactaatatagtagtagtacggtacggaacggaacgaacgtaacgtacgttcgtcgttacgacgaccgacgccgttccgtcccgtccgtcgtcctccttcctcccttccctccc

SEQ ID NO: 428851 - DNA, 516 bp, Homo sapiens
  misc_feature: GZ8MTXP01AE2KD.10.75.G09.1.454.CMB.2.raw
  modified_base (295)..(295): a, c, t, g, unknown or other
  modified_base (355)..(355): a, c, t, g, unknown or other
  modified_base (413)..(413): a, c, t, g, unknown or other
  modified_base (440)..(440): a, c, t, g, unknown or other
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctcgtgtctgggtctcctggacagtcgatcaccatctcctgcactggaaccagcagtgacgttggtgttatactatgtctctggtacaacaacacccaggacaaagcccccaaactcatgatttttnatgtcagtaatcggcctcgaggggtttctaatcgcttctctggctcaagtctggacaacncggcctccctgaccatctctcgggctcgaggctgagacgaggctgattagtactgacngctcatataaccaacagcagctacttngtatcggcggaacgggcaaagcgtacgaccgttcgttcggcaacgccaagggcctacgccccgtaacgttctaacc

SEQ ID NO: 428852 - DNA, 630 bp, Homo sapiens
  misc_feature: GZ8MTXP01AVPCT.10.75.G09.1.454.CMB.2.raw
  modified_base (187)..(187): a, c, t, g, unknown or other
  modified_base (326)..(326): a, c, t, g, unknown or other
  modified_base (401)..(401): a, c, t, g, unknown or other
  modified_base (416)..(416): a, c, t, g, unknown or other
  modified_base (505)..(505): a, c, t, g, unknown or other
tcagcatagtagtgcacgaccggtgctcgatttagtatagacatcgaggggggggtctcaggaggcagcgctctcgggactctccaccatggcctgggctctgctattcctcacccctcctcactcagggcacaggttcctgggcccagtctgccctgtctcagcctgcctccgtgtctgggtctcnggacagtcgatcaccatctcctgacaatggaagcgaaagtgaactagtttggtttacttttaaattttgtcttcgttacggtaaccaaacagaacgccccaagaaccaaaaccgaccccctaaaattactctaatttcngtctgtacagttacgtccggtccctgtagggggtttctagtcgtcttctcgtggccctacagtctcggacaaacnccggcctcctgaccntctgtcgggcttccgaaggcctagggacggagtacggctaggtattattattgactagtctactaaatacaacaaacgtactaacgttnttagagtcggtacgggacggtaccggaactaacgtcggttaccgtcgttacgtaccgaccgttacccgacggttcccgtcccgtccccgtccgtcctcccgttccttaacccgttcccctaaccc

SEQ ID NO: 428853 - DNA, 608 bp, Homo sapiens
  misc_feature: GZ8MTXP01AQWVP.10.75.G09.1.454.CMB.2.raw
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaaagcgaaagtgactattggttactttaaattttgtctcttggtaccaacagagccccagaacaaacgacccccaaaaattactctatttctgctgtcagtaactcggccctcgtagggtttctagtcgtcttctctcggtcctcaagtcgtggaccaaaccacccgggccctccctgaccctatcctcgtcggggccctccgaggcctgggacgggacggaggacctgtaacttagtttaattgcagtcctacgactaataaccaaacaacctaaagtcttagagttacgttccgggacgggaacggaaccaaacgtcgacccgttccttcgtacgacgcccgaggcctccgccccgtcggtcctaccttccgttccgttcccctaacccc

SEQ ID NO: 428854 - DNA, 693 bp, Homo sapiens
  misc_feature: GZ8MTXP01BH5B6.10.75.G09.1.454.CMB.2.raw
  modified_base (203)..(203): a, c, t, g, unknown or other
  modified_base (292)..(292): a, c, t, g, unknown or other
  modified_base (299)..(299): a, c, t, g, unknown or other
  modified_base (325)..(325): a, c, t, g, unknown or other
tcagcatagtagtgcacgaccggtgctcgatttagtatagacatcaggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccntctcctgcactggacccacagttacattgaataatgaatatgtctctgtacaacagtacccaggacaacgcccccaaatgatgatttangatgtanagtaatccgaccctcgaggggtttcngtatcgtcttcttcgcccctcaagtcgtggaccaaaccgacccggtccctccctagacccacttccgtcgtcgggtcctccagtacgtggagggacgaggtactgtaattattactgcagtcctacgactaacgtaacgaacggtccggacgtacgggttcggggtttacgggggttcggggttcccggggggacccggggggtaccctaaccggaacccggttaccggaaccccgggtttacccggttaacgggtacccgtaaccggaccccggaacggggttccccgtccccgggtcccccccgttaaccgggttcccgtaccccgtttccccgtttccccggtttaaccccccgtaacccccccg

SEQ ID NO: 428855 - DNA, 767 bp, Homo sapiens
  misc_feature: GZ8MTXP01AVQVM.10.75.G09.1.454.CMB.2.raw
  modified_base (308)..(308): a, c, t, g, unknown or other
tcagcatagtagtgcacgaccggtgctcgatttagtatagacatcagggggggggtctcaggaggcagcgctctcgggacgtctccaccatggcctgggctctgctattcctcaccctcctcactcagggcacaggttcctgggcccagtctgccctgtctcagcctgcctcgtgtctgggtctcctggacagtcgatcaccatctcctgacaagtggaagcgaaagtgactatttggttactttaaattttgtctcttggtaccaacagacgcccagaacaaacgacccctaaaattatctatttcngtctgtctagtaacgtccggcccttcgtacgggggtttctaggttccgtctttcgtcgtcggtacccttccaagttcgtcggaccaaaaccgaccgggtcccttccctacgaccctacgttcccttccggtcggggtccctacccgtacgggtacgtacggggaacgggacggtaacggggtacctttaacggtaacttttaagtttaacgttcgttaccgagttacccttaacgtaaacttaaaccttaaaaccgaaaaaccctaaaccgtaaaacgttcctttacgtaaagttacggttacccgggggaacggtaaacgggggttaaaccccaaacggtttccggaccccggtttacccgttacccggtaacgaacccggttaccccgaaacggttccccgtcccggtcccccgttaacggtccctaccgttcccgtccgtttccccccgtaacccc

SEQ ID NO: 428856 - DNA, 704 bp, Homo sapiens
  misc_feature: GZ8MTXP01AU0YG.10.75.G09.1.454.CMB.2.raw
tcagcatagtagtgcacgaccggtgctcgatttagtatagacatcagggggggggtctcaggaggcagcgctctcgggacgtctccaccatggcctgggctctgctattcctcaccctcctcactcagggcacaggttcctgggcccagtctgccctgtctcagcctgcctcgtgtctgggtctctggacagtcgatcaccatctcctgacaagtggaagacgaaagtgactagtttggtttacttttaaattttgtcttcgttacggtaaccaacgagacgacccaagaaccaaacgaccccctaaaattactactatttctgtctgtactaagtaactccggcccttcggtaggggttttctacggttcgtctttcgtcgtcggtcccctaccgtagtcgtcggaccaaaaccacccgggtccctcccgtacgaccctactccgttcggtacgggtccttacccgaggtcggtgggaacgggtacggaggtacgttaggtatttaacttagttcgactagtacctacgtaattaaccgtaacccgacccggtaggggccctaacgttccgtacggttacgtacgttacggttccgggggacgggtaacgggtaccgttcggtccgttacggtccccgtaccgttaccgttcgaccggtcccgacgtccgtcccgtccccgttacggtccttccgtttccccg

SEQ ID NO: 428857 - DNA, 525 bp, Homo sapiens
  misc_feature: GZ8MTXP02GXAR6.10.75.G09.1.454.CMB.2.raw
  modified_base (295)..(295): a, c, t, g, unknown or other
tcagcatagtagtgcacgaccggtgctcgatttagtatagacatcaggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaatttgtctcttggtaccaacagagcccagacaaagcccccaaaattatcatttcngctgtcagtaatcggcctcgaggggtttctagtcgcttctctggcctccaagtctggcaacacggcctccctgaccatctctgggctccagctgaggacgagctgattattatgcagctcatatacaaacacaaagctttagatagttacggacggtagggaccctaaaacgtcgaccgttccttcgtcacgcccaaggcctgccccctggtccactctcgttcccaccc

SEQ ID NO: 428858 - DNA, 526 bp, Homo sapiens
  misc_feature: GZ8MTXP02H02BH.10.75.G09.1.454.CMB.2.raw
  modified_base (336)..(336): a, c, t, g, unknown or other
tcagcatagtagtgcacgaccggtgctcgatttagtatagacatcaggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggtttactttaaattttgtcttcttggtaccaacagagcccagacaaagcccccaaaattatcatttctgctgtcagtaatcgcctcagggtttctagtcgcttcnctgctccaagtctggcaacacgcctcctgaccatctctggctccagctgagacgagctgattatatgcagctcatatacaaacaccaaagtcttagatattcggacggaacgggtacaaaactcgaaccgttccttcgtaccacgacccaaggctccgccccctcggtcaacctctctttaccccacccc

SEQ ID NO: 428859 - DNA, 539 bp, Homo sapiens
  misc_feature: GZ8MTXP02IXTMA.10.75.G09.1.454.CMB.2.raw
tcagcatagtagtgcacgaccggtgctcgatttagtatagacatcagggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgactattggttactttaaattttgtctcttggtaccaacagagcccagacaaagcccccaaaattatcatttctgctgtcagtaatcggccctcaggggtttctagtcgctttctctggcctccaagtctggcaacacggcctccctgacccatctctgggctccgagctgaggacgaggctgattattatgcagctacatataccaaacaaccaaagctttagatagttcggacggagggaccaaaacgtcgaccgtcttcgactacgacccaaggcctcgccccctaggtccactcctcgttacccctaccc

SEQ ID NO: 428860 - DNA, 501 bp, Homo sapiens
  misc_feature: GZ8MTXP02FG7NZ.10.75.G09.1.454.CMB.2.raw
  modified_base (355)..(355): a, c, t, g, unknown or other
tcagcatagtagtgcacgaccggtgctcgatttagtatagacatcagggggggtctcaggaggcagcgctctcgggacgtctccaccatggcctgggctctgctattcctcaccctcctcactcagggcacaggttcctgggaccagtctgccctgactcagcctgcctccgtgtctgggtctcctggacagtcgatcaccatctcctgcactggaaccagcagtgacgttggtgttataactatgtctctggtaccaacaacacccaggcaaagcccccaaactcatgattttgatgtcagtaatcggccctgaggggtttctaatcgcttctctggctccaagtctggcaacncggcctccctgaccatctctgggctccaggctgaggacgaggctgattatactgcagctcatatacaaccagcagctacttctgtactcgacggaggaccaagctcgaccgtcaggtcaacgccaaggctacgcccctcggctacc

SEQ ID NO: 428861 - DNA, 552 bp, Homo sapiens
  misc_feature: GZ8MTXP02FI2W4.10.75.G09.1.454.CMB.2.raw
  modified_base (346)..(346): a, c, t, g, unknown or other
  modified_base (360)..(360): a, c, t, g, unknown or other
  modified_base (370)..(370): a, c, t, g, unknown or other
tcagcatagtagtgcacgaccggtgctcgatttagtatagacatcagggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaatttgtctcttggtaccaacagagcccagacaaagcccccaaaattatcatttctgctgtcagtaatcggcctcaggggttctagtcgctctctggcctcagtcnggcacacgcctccngaccatctcngggctcaggctgaggacgagctgattattattgcagctcatatacaaaacaccaaagtcttgatagtcggacggtaggaccctaaaacgtcgacccgtcgttacggacctacgacccgaaggtccctaaccgtccccccgtcgggtaccctaccttccctaccggttaccccctaacccccg

SEQ ID NO: 428862 - DNA, 523 bp, Homo sapiens
  misc_feature: GZ8MTXP02FK324.10.75.G09.1.454.CMB.2.raw
  modified_base (419)..(419): a, c, t, g, unknown or other
tcagcatagtagtgcacgaccggtgctcgatttagtatagacatcagggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaatttgtctcttggtaccaacagagcccagacaaagcccccaaaattatcatttctgctgtcagtaatcggccctcgaggggtttctagtcgcttctctggcctccaagtctggcacacggcctcctgaccatctctgggctccgaggctgaggacgagctgattattattgcagctanatataacaaacacaaagtctttagatagttcggacggaggaccaaactcgacctctcgtcacgcccaaggctcgccccgtcggtccacgtctcgtccctacccc

SEQ ID NO: 428863 - DNA, 550 bp, Homo sapiens
  misc_feature: GZ8MTXP02GW9BF.10.75.G09.1.454.CMB.2.raw
  modified_base (445)..(445): a, c, t, g, unknown or other
  modified_base (469)..(469): a, c, t, g, unknown or other
  modified_base (473)..(473): a, c, t, g, unknown or other
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgactatttggttacttttaaattttgtctcttaggtaaccaacagagacccaagaacaaaacgacccccaaaaaattatactaatttctagctgtacaagtaactcggccctcgaggggtttctagtcgcttctctgcctaccaagtctggacaacacgcctccagacctatctctcggctccagctgaaggacgagctgtattaatatgcagcctaanaataacaaacaaaacaacaaagtnttanatagtcggacggaacgaacaaactcgactctcgacacgaccgagcctcgccccgtcgacactcctccgtaccctacc

SEQ ID NO: 428864 - DNA, 567 bp, Homo sapiens
  misc_feature: GZ8MTXP02IM12Q.10.75.G09.1.454.CMB.2.raw
  modified_base (293)..(293): a, c, t, g, unknown or other
  modified_base (301)..(301): a, c, t, g, unknown or other
  modified_base (392)..(392): a, c, t, g, unknown or other
  modified_base (465)..(465): a, c, t, g, unknown or other
tcagcatagtagtgcacgaccggtgctcgatttagtatagacatcagggggggtctcaggaggcagcgctctcgggacgtctccaccatggcctgggctctgctattccctcacccctcctcactcaggcacaggttcctgggcccagtctgccctgtctcagcctgcctcgtgtctggtctcctggacagtcgatcaccatctcctgcaatggaaagcgaaagtgactatttggtttctttaaattttgctcttggtaccaacagagcccaagacaaacgcccccaaaattntcatttcngctgtcagtatcggcctctaaggggtttctagtcgcttacgtctcggcctccaagtctaggccaaaccgccggtccctccccgataacccntccgtcgtcgggaacctccgaggtcgtagggaacggccggtaggattggtaattatattggcctagctactancacaaacacaagtattagtagtagtacggacggaacggaaccgaacgtacgtaccgtccgactcgaccacgcccaacgcctcgccctccgtcctcctcctcc

SEQ ID NO: 428865 - DNA, 567 bp, Homo sapiens
  misc_feature: GZ8MTXP02GVWD6.10.75.G09.1.454.CMB.2.raw
  modified_base (262)..(262): a, c, t, g, unknown or other
  modified_base (315)..(315): a, c, t, g, unknown or other
  modified_base (357)..(357): a, c, t, g, unknown or other
tcagcatagtagtgcacgaccggtgctcgatttagtatagacatcagggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgactattggttctttaaatttgtctcttggtaccaanagagcccagacaaacgccccaaaattatcatttctgctgtcagtatcggcctntaggggtttctagtcgcttctctggcctccagtctggcaacncggcctcctgaccatctcgtgggcctccgagctgaggacgaggctgattagtattgcagctacatactaacaaaccgaaccaaaagtcctttagattacgttcgggacggtaagggaaccctaaaacgtcggtaacccttccgtttcggaccacgacccctaaggccctcggccccccgtaggtccacctcctccgttcccctaaccccc

SEQ ID NO: 428866 - DNA, 615 bp, Homo sapiens
  misc_feature: GZ8MTXP02GF0W9.10.75.G09.1.454.CMB.2.raw
  modified_base (306)..(306): a, c, t, g, unknown or other
  modified_base (371)..(371): a, c, t, g, unknown or other
  modified_base (379)..(379): a, c, t, g, unknown or other
tcagcatagtagtgcacgaccggtgctcgatttagtatagacatcgagggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaagtggaagcgaaagtgactagtttggttactttaaattttgtctcttggtaccaacagacgccaagacaaacgcccccaaaattatacatttcngctgtcagtaatcggccctcgaggggtttctagtcgcttctcgtggcctccaagtctggcaaccncgcctccngaccatctcgtgggcctccgaggctggaggacggagctgtattattattgcagctcgatactacacccgaggggccaacgtctcggtagtattacgttcggggcgggaacgggtacccgtgggtaccgttaccggacccggttacccgtaacgggttacccgaccgggaaccccgtaaacgggtcccgttaccccgggaccccccgtttccgggttaacccgtaccttttcccccg

SEQ ID NO: 428867 - DNA, 597 bp, Homo sapiens
  misc_feature: GZ8MTXP02H6YCA.10.75.G09.1.454.CMB.2.raw
  modified_base (268)..(268): a, c, t, g, unknown or other
  modified_base (273)..(273): a, c, t, g, unknown or other
  modified_base (375)..(375): a, c, t, g, unknown or other
  modified_base (387)..(387): a, c, t, g, unknown or other
  modified_base (390)..(390): a, c, t, g, unknown or other
tcagcatagtagtgcacgaccggtgctcgatttagtatagacatcagggggggtctcaggaggcagcgctctcgggacgtctccaccatggcctgggctctgctattcctcaccatcctcactcagggcacaggttcctgggcccagtctgccctgtctcagcctgcctccgtgtctggtctcctggacagtcgatcaccatctcctgcaatggaagacgaaagtgactagtttggttacttttaaatttgtctcgttaggtaccaanagacncccaagaacaaacgaccccaaaattactactatttctgtctgtacagtaactccggtccctcgtaggggtttcagtcgtcttctctcgctccagtctgcacncgcctctcgacntcncgtggcctcgagctgacggacgagctgtacttattagtcgctagtctacgtaataactaacaaacacctaaagtctttagacttacgtacgggacggtaacggaacctaacgtcggtaacccgttccgttaccgtacgaccgtacccgaacggtccgtacccggtacccccgttcggtacctaccgttccgttacccgttacccccc

SEQ ID NO: 428868 - DNA, 656 bp, Homo sapiens
  misc_feature: GZ8MTXP02HZAH3.10.75.G09.1.454.CMB.2.raw
  modified_base (401)..(401): a, c, t, g, unknown or other
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcatcaccatctcctgcaatggaagacgaaagtgactatttggtttacttttaaatttgtcttcttggtaaccaacagacgcccaagaacaaacgacccccaaaaattactactatttctagtcttgtacagtaaatccggtaccctcgtaggggtttctagtcgtcttctctggccctaccaagtctgacaaccgacggccctcccngtaccctatcctcgtcgggcctaccgaggtctaggacggacggagtcgtagtatttattagttgacagtcctatactaaactaacaaaacctaaccaaagttcctttaagacttacgttacgggacgggtaaacgggaaacctaaacgtacggtacccgttaccttacggtaccgtaaccgacccgtaaacggtccctaaccccggtcccccgtacggtaccctaccgttacccgttcccttaccccctaacccc

SEQ ID NO: 428869 - DNA, 538 bp, Homo sapiens
  misc_feature: GZ8MTXP02F5KYM.10.75.G09.1.454.CMB.2.raw
  modified_base (265)..(265): a, c, t, g, unknown or other
  modified_base (374)..(374): a, c, t, g, unknown or other
  modified_base (433)..(433): a, c, t, g, unknown or other
  modified_base (437)..(437): a, c, t, g, unknown or other
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacatttggttactttaaattttgtctcttggtaccaanagagcccagacaaacgacccccaaaattatcatttctgctgtcagtactcggccctgtaggggtttctagtcgtcttctctggccctcagtctggacaacgcgcctccngaccatcctgtcgggctccgaggctagaggacgaggtctgtatttattatgacagcctnatanaacaaacacaaagtcttagatacgtcgacggacggaactaactcgaccgtcttacgcacgccgagcctcgccccgtcgtaccactccgtacctccctaccc

SEQ ID NO: 428870 - DNA, 840 bp, Homo sapiens
  misc_feature: GZ8MTXP02JS9OP.10.75.G09.1.454.CMB.2.raw
tcagcatagtagtgcacgaccggtgctcgatttagtatagacatcagggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgactattggttactttaaattttgtcttcttggtaccaacagacgcccagaacaaacgacccccaaaattactactaatttctagtccttagtactaagtaaacgtccgggtccccttacggtaggggttttcctaggttccgtcgtttcctccgttcgggtccccttacccgtaaaggttcgttacggaccaaccgtaccgggtccccttccccgtacggaccctacgtccgttcggtcggggtcccttacccgacggggtcttacggggacgggtaccggaggtaccgtaggttaatttaaagtttcgtttaggactaaacggtccttaacctaattaaaccgtaaaaccgtaaaaaccctaaacccgtaaaaacgggtttacctttttaaggggaaactttaacgggtttacccgggggaacgggggttaaaaccggggaaaaccccgttaaaaaccggttccggggtaaaccccggtttccggtttaacccgggttacccgtaaaccggaacccccggtaaacggtaccccggttaaccccggcccccccggtttacggggtacccctaacccgtttcccgtttaccccggtttaacccccttaaaccccg

SEQ ID NO: 428871 - DNA, 673 bp, Homo sapiens
  misc_feature: GZ8MTXP02GR88D.10.75.G09.1.454.CMB.2.raw
  modified_base (323)..(323): a, c, t, g, unknown or other
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatcctcctgacaagtggaagcgaaagtgactagtttggtttacttttaaattttgtcttcgttaggtaccaacagacgacccaagaaccaaaacgaccccctaaaaattactactatttcngtctagtacaagtaacgtccggtccttacgtacggggtttctagttcgtcttcgtcgtcgccctacgaagtcgtacggacaaccgaccggtccctcccgtcgacctactccgtcgtcgggtcctccgaggccgtaggacggacgaagtctagtaattagttatcgacagtctataactaactaaaccaaaacctaacgaaaacgttcgttaagtacgtacggttacgggaacggtaacggaaaaccctaaacgttaccggtacccgttaccgttaccgacgaccgacccgaacggtccctaacccggtcccccgtagtacccacgttcccgttcccgtccccctaccccg

SEQ ID NO: 428872 - DNA, 629 bp, Homo sapiens
  misc_feature: GZ8MTXP02FTURP.10.75.G09.1.454.CMB.2.raw
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctctgcaatggaagcgaaagtgactatttggtttactttaaattttgtctcttaggtaccaaactagacgcccaagaccaaaacgacccccaaaattactctaatttctagctgtacagtaactccggccctcgtaggggtttctaggttcgtcttctctggcctacgaagtctaggacaaccgaccggccctccgtcgtacccactccgtcgtcgggcctaccaggctggagaccggaggtctagtatttaagttattcgacagtctactaactaataaccaaaactaaccgaaagttcttagattaacgttcgggaacggtacgggaacctaaaacgtcggaacccgttccgttacgtacgaccgacccgaacggtcctaaccgtcccccgtcggtacctaccgtcctccgttccccgtcccc

SEQ ID NO: 428873 - DNA, 313 bp, Homo sapiens
  misc_feature: GZ8MTXP02FVSC8.22.34.D01.1.454.CMB.2.raw
  modified_base (311)..(313): a, c, t, g, unknown or other
tcagacatacgcgtcacgaccggtgctcgatttagatcgtctgtgttgggtttgggggaagaggaagactgacggtcctgccacaggtggtgctgaggaagagatggaggtggacgtgtcagcacccagctggggcctgtccctggggccagggaaccctggtcaccgtctcctcagcctccaccaagggcccatcggtcttcccctggcgccctgctccaggagcacctccgagagcacagcggccctgggctgcctggtcaaggactacttccacgcgtatgtctgagcgggctggcaaggcgcatagnnn

SEQ ID NO: 428874 - DNA, 314 bp, Homo sapiens
  misc_feature: GZ8MTXP02IBGTN.22.34.D01.1.454.CMB.2.raw
  modified_base (311)..(314): a, c, t, g, unknown or other
tcagacatacgcgtcacgaccggtgctcgatttagatcgtctgtgttgggtttgggggaagaggaagactgacggtcctgccacaggtggtgctgaggaagagatggaggtggacgtgtcagcacccagctggggcctgtccctggggccagggaaccctggtcaccgtctcctcagcctccaccaagggcccatcggtcttcccctggcgccctgctccaggagcacctccgagagcacagcggccctgggctgcctggtcaaggactacttccacgcgtatgtctgagcgggctggcaaggcgcatagnnnn

SEQ ID NO: 428875 - DNA, 604 bp, Homo sapiens
  misc_feature: GZ8MTXP01CR24C.13.3.A03.1.454.CMB.2.raw
  modified_base (220)..(220): a, c, t, g, unknown or other
  modified_base (325)..(325): a, c, t, g, unknown or other
  modified_base (438)..(438): a, c, t, g, unknown or other
tcagtcacgtactacacgaccggtgctcgatttagagagcgtcacagggggggtcacaagaggcagcgctctcgggacgtctccaccatggcctgggctctgctgctcctcactctcctcactcaggacacagggtcctgggcccagtctgccctgactcagcctgcctccatgtctggtctcctggacagtcgatcaccatctcctgcactggaaatgnagtgatggttgggacttatgaccttgtctctggaccgacaacaccaggacaaacgcccccaaatcattagtttacgggtacaagtacgcgcctcgagggtcttcngatcgcttctcctggtctccgtaagtcgtacgggaccaacgacccggtcccttccctagaccaacttctcgtacgacctccgacggccgaggacgagtctagttattttacgngttgtacattagtgacgtaggaaggtgtagtattagttgttacgttaggtaaggtacgggtaaccgtaaggtcccgaccggtttccgttcggtaccacggttaccccgaacgggcccctaaccccgtactcggtcctacttcccgttccgttcccccgtaaccccg

SEQ ID NO: 428876 - DNA, 578 bp, Homo sapiens
  misc_feature: GZ8MTXP01DH1EM.13.3.A03.1.454.CMB.2.raw
  modified_base (437)..(437): a, c, t, g, unknown or other
tcagtcacgtactacacgaccggtgctcgatttagagagcgtcacgagggggggtcacaagaggcagcgctctcgggacgtctccaccatggcctgggctctgctgctcctcactctcctcactcaggacacagggtcctgggcccagtctgccctgactcagcctgcctccatgtctggtctcctggacagtcgatcaccatctccgtgcactggaaatgcagtgatgttgggacttatgtaccttgtctcctggtaccgacaacaccaggcaaacgccccaaatcattagtttacgggtacaagtaacgccggccctcgagggtctttctgactcgcttctcctggctcaagtctaggacaacgaccggtccctccctagacaacttctcgtacgacctccgagggcccgaaggacgaggtcttgtactttttcngttgttacattagtgacgaggaaggtgtagtattagtgttcgttagggaagtcgggaactaaggtcttacgtccgttggtaccacgacccgaacggacccctaaaccctctcgtcctaccttcctccgttcccctaacccg

SEQ ID NO: 428877 - DNA, 575 bp, Homo sapiens
  misc_feature: GZ8MTXP01EWNVY.13.3.A03.1.454.CMB.2.raw
  modified_base (319)..(319): a, c, t, g, unknown or other
  modified_base (412)..(412): a, c, t, g, unknown or other
tcagtcacgtactacacgaccggtgctcgatttagagagcgtcacagggggggtcacaagaggcagcgctctcgggacgtctccaccatggcctgggctctgctgctcctcactctcctcactcaggacacagggtcctgggcccagtctgccctgactcagcctgcctcatgtctggtctcctggacagtcgatcaccatctcctgcactggaaatgcagtgatgttggacttatgaccttgtctcctggtaccgacaacacccaggcaaacgcccccaaatcattattacgggtcaataagcgcctcagggctttcngatcgcttctcctggctccaagtctaggcaacgacggcctccctgactaatctctcgactccgaggccgaggacgaggcttagtattttacgngttgttcattagtgtacgaaggtaaggagtgtatttagtgttcgtttagggaagttcggggaaccctaaagggttccaacccggttccgttggtaccacggaccccgaacggaccccaaaccccgtctaacggtcctaccttccgtccgtttccccgtccccg

SEQ ID NO: 428878 - DNA, 653 bp, Homo sapiens
  misc_feature: GZ8MTXP01ECATI.13.3.A03.1.454.CMB.2.raw
  modified_base (225)..(225): a, c, t, g, unknown or other
  modified_base (569)..(569): a, c, t, g, unknown or other
  modified_base (608)..(608): a, c, t, g, unknown or other
tcagtcacgtactacacgaccggtgctcgatttagagagcgtcacgaggggggggtcacaagaggcagcgctctcgggacgtctccaccatggcctgggctctgctgctcctcactctcctcactcaggacacagggtcctgggcccagtctgccctgactcagcctttgcctccatgtctgggtctcctggacagtcgatcaccatctcctgcataggaaatgnagtgattgtgggacttatgaccttgtctctggtaccgacaacaccaggaccaaacgcccccaaatcaattacgtttacgggacaataacgcgccctgagggtcttctagactcgcttctctggctcgaagtctaggacaacgcgtccctaccgtacgacaatcgtactcggacctcccgaagggccgaaggacggtaaggtcttagttaactttttaccgtgtttacgttactaagttaggtagacggtaagggtaaaggtagttggtaatttagttaggttcgtttaaggggtaacggtacggggaacctaaaggtccgttaacccgggttctttgggaaccnccggttaaccccgaacgggttacccccaaaaccccgttntaaccggttacctaccgttaccttcccggttaacccctaaccccg

SEQ ID NO: 428879 - DNA, 559 bp, Homo sapiens
  misc_feature: GZ8MTXP01BQ29T.13.3.A03.1.454.CMB.2.raw
  modified_base (299)..(299): a, c, t, g, unknown or other
  modified_base (324)..(324): a, c, t, g, unknown or other
  modified_base (412)..(412): a, c, t, g, unknown or other
  modified_base (416)..(416): a, c, t, g, unknown or other
  modified_base (445)..(445): a, c, t, g, unknown or other
tcagtcacgtactacacgaccggtgctcgatttagagagcgtcacgaggggggggtcacaagaggcagcgctctcgggacgtctccaccatggcctgggctctgctgctcctcactctcctcactcaggacacagggtcctgggcccagtctgccctgactcagcctgcctcatgtctggtctcctggacagtcgatcacatctcctgcactggaaatgcagtgattgttagggacttatgtaccttgtctctaggaccgacaacaccagacaaacgccccaaatcattagttacgganaagtaacgcgcctgaggtctttcgngatcgcttctctggctcaagtcaggacaacgcgtcctccagactatctctgactccgaggccgaggcgaggtctagttacttttacgngttnttactataaggtggacgtaagggaaggtntaggtattatggttagttgggaagtcggaacgtaaggtcaccggtccttggtaccgacgttccgaaacggcccaacccctagtctccgtacttccgtaaccgttccctaacccg

SEQ ID NO: 428880 - DNA, 646 bp, Homo sapiens
  misc_feature: GZ8MTXP01CX6YY.13.3.A03.1.454.CMB.2.raw
  modified_base (217)..(217): a, c, t, g, unknown or other
tcagtcacgtactacacgaccggtgctcgatttagagagcgtcacgagggggggtcacaagaggcagcgctctcgggacgtctccaccatggcctgggctctgctgctcctcactctcctcactcaggacacagggtcctgggcccagtctgccctgactcagcctgcctcatgtctggtctcctggacagtcgatcaccatctcctgcatgaaatncagtgatgtggacttatgtaccttgtctcctgtaccgacaacaccaggacaaacgcccccaaatcaattacgttacgggtcaaatacgcgcctgagggtctttcgtgactcgtcttctcctggtctccaacgttctacgggacaacgccggcctcccctagactaactcgtctcggactccgaggcgaggacgagtctagtattttacgtgttgtactagtagtgacgaagggaagtagtgatttacgtgtgtttagggaagttcggggaacctaaaggggttcccttaaccgggtttccgttacgggttaaccgtcccgggttaaacccccgttaaacgggaccccccctaaaacccccggtaaccgtttccggtaaaccccgttaccgtttccccttaacccggggttttccccccgttaacccccg

SEQ ID NO: 428881 - DNA, 621 bp, Homo sapiens
  misc_feature: GZ8MTXP01AJZC9.13.3.A03.1.454.CMB.2.raw
  modified_base (319)..(319): a, c, t, g, unknown or other
  modified_base (576)..(576): a, c, t, g, unknown or other
tcagtcacgtactacacgaccggtgctcgatttagagagcgtcacgagggggggtcacaagaggcagcgctctcgggacgtctccaccatggcctgggctctgctgctcctcactctcctcactcaggacacagggtcctgggcccagtctgccctgactcagcctgcctccatgtctggtctctggacagtcgatcacatctctgcactagaaatgcagtgattgtggacttatgtacttgtctcctggtaccgacaacaccaggacaaacgccccaaatcattagttacgggacaatacgcgcctgagggtctttcngactcgtcttctccgtcggctaccgaagtctacggaccaacgccggtccctcctagactactctcgtcggactccgaggccgaggacgtaggcttagttacttttacgtgtttagtctagtagtgacgtaagggaaggtagtgtaagtttagttggttacgtttagggaaacggttcgggtaaccgtaaagggttccttaccggttccgtttcggaccgtaaccggaccccgttaaacgggaccccttaaaccccgngttccggtaccgttacccttccgttccggttccccccgttccccg

SEQ ID NO: 428882 - DNA, 641 bp, Homo sapiens
  misc_feature: GZ8MTXP01BSR7J.13.3.A03.1.454.CMB.2.raw
  modified_base (199)..(199): a, c, t, g, unknown or other
  modified_base (215)..(215): a, c, t, g, unknown or other
tcagtcacgtactacacgaccggtgctcgatttagagagcgtcacgaggggggggtcacaagaggcagcgctctcgggacgtctccaccatggcctgggctctgctgctcctcactctcctcactcaggacacagggtcctgggcccagtctgccctgactcagcctgcctcatgtctggtctctggacagtcatcacntctctgcatgaaatgnagtgatgtggacttatgtacttgtctctacgtaccgacaacaccgaggacaaacgaccccaaatctaattacgttacgggacaagtacgccgtaccctcgaggttctttcgtgtactccgtcttcgtccgtcggtactaccgtaagtcgtaacgggacctaacgtacctcgtccccttaccctagtaactaacttccctacgtacgggtacctccggaaggcccggtagggaacggtacggtctttaggttacttttagtcgtttgttacagttagtgacgaagggtaagtgttgtaagttacgttgttacgttaggacggtacgggaacgtaggttccgtaccggttcgttacggtccaccggttacccggaaccgtaaccccgtaaccctcgttcgtaccttcttccgttaacccgttcccccg

SEQ ID NO: 428883 - DNA, 585 bp, Homo sapiens
  misc_feature: GZ8MTXP02HN1E6.13.3.A03.1.454.CMB.2.raw
  modified_base (323)..(323): a, c, t, g, unknown or other
tcagtcacgtactacacgaccggtgctcgatttagagagcgtcacagggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatgcagtgatgttgggattatgacttgtctcctggtaccgacaacacccaggcaaacgccccaaactcattactttacgggtacaataagcgcctcagggctttcngatcgcttctcctgctcaagtctggcacaccggcctcccgtgacaactctctcgacctccgaggccaggacgagctgtattttactgttgtactatactgtcgaggtaaggtagtgtattagtgttacgtttaggaagttacggggaaccctaaagggtccgtaaccgtccgttacggtaccgtacggaaccccgtaacgggaccccaaaccccgtacctcggtaccctaacgttcctaccggttttaccccctaacccccg

SEQ ID NO: 428884 - DNA, 813 bp, Homo sapiens
  misc_feature: GZ8MTXP02I9ZX3.13.3.A03.1.454.CMB.2.raw
tcagtcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctcatgtctggtctcctggacagtcgatcacatctcctgcactggaaatgcagtgatggttggacttatgactattgtctcctggtaccgacaaccaccgaggaccaaaccgaccccaaatcaatttacgtttacgggacaataacggccggccctacgagggtctttcgtgtactcgtcttcccgtcgtcggtacctaccgtaagttccgtcggacccgaaaccgacccgggtcccttacccccgttaggaacccttaaacttcccgttccgttacgggtaaacccttcccgggaacggggaccccgggaaaggggacccggtacggggttaccctttaggggtttaaaactttttttacccgtggtttttacggttaccttaaagtttaagtcgggtaaccgtaaagggggtaaaacggttaggttacggtttaagtttaacggtttagggtttaccggtttttaagggggaaaacgggtttacggggtaaaacccggttaacgggtttacccgtaaaccccgggtttccgtttaacggggaccccgtaaaaccgggtcccccgtaaaaccgggaaccccctaaaccccgtacgttaccggttacccttaacccgtttcccgtttacccggggtttccccccc

SEQ ID NO: 428885 - DNA, 710 bp, Homo sapiens
  misc_feature: GZ8MTXP02H1FF1.13.3.A03.1.454.CMB.2.raw
tcagtcacgtactacacgaccggtgctcgatttagagagcgtcacagggggggtcacaagaggcagcgctctcgggacgtctccaccatggcctgggctctgctgctcctcactctcctcactcaggacacagggtcctgggcccagtctgccctgactcagcctgcctccatgtctggtcctcctggacagtcgatcaccatctcctgcactggaaatgcagtgattggttgggacttatgtaccttgtctccgtggtaccgacaacacccaggacaaacgacccccaaatcattagtttacgggacaaagtaacgcgccctcgacggtctttctgactcgcttctccgtcgtcctaccgaagttcgtacggaccaccgtaccggtccccttaccccgtagtaacctaacgtccttaccgttccgggacctccccggaaggggtccccgggaaggggaacccggtacgggtacccgttaggttttaacgttttttaaccgtgtttacggtttactaaacgtttagttacggacgtaaagggtaaggggtagttagtagtttaagttcgtacgtttagggaaggtacgggaaccgtaacgggtccgtaaccggttcgttacgggaccacggaccccgtaaacgggcccccaaaaccccgttccgtacggtaccctacctttaccggtttccgtttacccccgtaaccccg

SEQ ID NO: 428886 - DNA, 545 bp, Homo sapiens
  misc_feature: GZ8MTXP02F0PGP.13.3.A03.1.454.CMB.2.raw
  modified_base (368)..(368): a, c, t, g, unknown or other
  modified_base (406)..(406): a, c, t, g, unknown or other
tcagtcacgtactacacgaccggtgctcgatttagagagcgtcacagggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatgcagtgatgttgggacttatgaccttgtctctggtaccgacaacacccaggacaaacgcccccaaactctattagtttacgggtacaataagcgccctcgagggtctttctgactcgcttctctggctcaagtctggcacgcgcctccngacaatctctgactcagccgagcgagctgtattttacngttgtctatatgacgagggaaggtagtagtattagtgttcgtttagggaagtgggaactaacggtcctaccgttcgttggtcacgtacccgaacggacccaaacccgctacgtacaccttactcgttacccctaccccg

SEQ ID NO: 428887 - DNA, 596 bp, Homo sapiens
  misc_feature: GZ8MTXP02FJSLM.13.3.A03.1.454.CMB.2.raw
  modified_base (424)..(424): a, c, t, g, unknown or other
tcagtcacgtactacacgaccggtgctcgatttagagagcgtcacagggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatgcagtgatgttgggacttatgaccttgtctcctggtaccgacaacacccaggacaaacgcccccaaatcattagttacgggcaataagcggccctcgagggtctttctgatcgcttctcctggcctcaagtctggcacgaccggcctccctagactaatctctcggactcccgaggccgaggaccgaggcttagtatttttacgngtttgttacatatgacgaagggaaggtagtgtatttagtgttcgttaggaaggtcgggaacctaaagggtcctaaccggttccgtttacgggtaccacggtaccccgaaggtacccccaaaccccgtacgttaccgtacctaccttccgttacccgttacccccttaccccg

SEQ ID NO: 428888 - DNA, 517 bp, Homo sapiens
  misc_feature: GZ8MTXP02GTUUO.13.3.A03.1.454.CMB.2.raw
  modified_base (322)..(322): a, c, t, g, unknown or other
  modified_base (405)..(405): a, c, t, g, unknown or other
tcagtcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatgcagtgatgttggacttatgaccttgtctcctggtaccgacaacacccaggcaaacgcccccaaatcattatttacgggcaataagcgcctcagggctttcngatcgcttctcctggctcaagtctggcacacggcctccctgacaatctctgactccgagccgaggacgagctgtatttttacngttgttcattatgcaggaaggtatgattagtgttctttaggagtgggaccaaggtcacgtcctggtcacgcccaaggcccaacccgactcgtacacctctcgttcccctccc

SEQ ID NO: 428889 - DNA, 509 bp, Homo sapiens
  misc_feature: GZ8MTXP02JEX2W.13.3.A03.1.454.CMB.2.raw
  modified_base (408)..(408): a, c, t, g, unknown or other
tcagtcacgtactacacgaccggtgctcgatttagagagcgtcacagggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatgcagtgatgttgggacttatgaccttgtctcctggtaccgacaacacccaggcaaagcccccaaaatcattatttacggggcaataagcggcctcagggctttctgatcgcttctcctggctccaagtctggcacacggcctccctgacaatctctgactcaggccgaggacgaggctgtatttttacngttgttcatatgcaggaaggagtgattatgtcttggaagtgggaccaaggtcacgtctggtcacgcccaaggccaaccgactcgtcactctcgttccaccc

SEQ ID NO: 428890 - DNA, 598 bp, Homo sapiens
  misc_feature: GZ8MTXP02FOA86.13.3.A03.1.454.CMB.2.raw
  modified_base (325)..(325): a, c, t, g, unknown or other
  modified_base (335)..(335): a, c, t, g, unknown or other
tcagtcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatgcagtgatggttggacttatgacttgtctctgtaccgacaacaccagacaaacgccccaaatcattattacgggtacaaagtaacgcggcctcgagggtctttcngatcgcttcncctgctcaagtctgcacgacgcctcctagactaactctctagacctccgacggccgaggacgaggcttagtatttttctagttgttactatagtagacgtagggtaaggtagtagtaatttagttgttacggtttagggaaaggttcggggaaaccgtaaacgggtccgtaaccggttccgttcggttaccgtaccgaccccgaaacggcccctaaaaccccgtacttcgtacctacttaccgttccgttaccccttaccccg

SEQ ID NO: 428891 - DNA, 700 bp, Homo sapiens
  misc_feature: GZ8MTXP02HGNPO.13.3.A03.1.454.CMB.2.raw
  modified_base (223)..(223): a, c, t, g, unknown or other
  modified_base (313)..(313): a, c, t, g, unknown or other
tcagtcacgtactacacgaccggtgctcgatttagagagcgtcacgaggggggggtcacaagaggcagcgctctcgggacgtctccaccatggcctgggctctgctgctcctcactctcctcactcagggcacgagggtcctgggcccagtctgccctgactcagcctgcctcgtgtctggctctcctggacagtcatcatcgtctcctgcacgtaggaaccngcactgagttggttggtagttaataactatcgtctccgtaggtatacaaacaaccaccgaggaccaaaccgaccccaaatcatctattanagtaagtctatttacgccggtcctagaaggttatttacgtaactcccgtactttctcgtcggtacctaccgaagtccgtcggaacctaaaccgcccggtacccttcccggactaaccctatttcccgaccggttcggggcccttaccgacggtactacgggaaacgtaccggaggtacctagtaaactttacttaacgtcggacacgtacctaataacttaactaaacccaaactacaaccaaaacacgtaaacggtacggttaccgggttaacggaaacggtaccggggaaaaccctaaaacggttccctaacccggttaacgttaacgggaccctaacccggaaccccggaaaccggaccccccaaaacccgttcgttaaccccg

SEQ ID NO: 428892 - DNA, 700 bp, Homo sapiens
  misc_feature: GZ8MTXP02IQR8U.13.3.A03.1.454.CMB.2.raw
tcagtcacgtactacacgaccggtgctcgatttagagagcgtcacgaggggggggtcacaagaggcagcgctctcgggacgtctccaccatggcctgggctctgctgctcctcactctcctcactcaggacacagggtcctgggcccagtctgccctgactcagcctgcctccatgtcgtggtctcctggacagtcgatcaccatctcctgcactaggaaatgcagtgattggttagggtacttagtcgtaccttgtcctcgtacggtaaccgacaacaccgagaccaaaccgccccaaactctaagttagttacgggtacaaagtaacgccgtacctcgtagggtcctttcgagtactccgtactttccgtccgtcggaccttaccgaagttcgtacggaccaccgtacgcccctacctacgaacctactcctcgtacggtaccctaccgacgggaccggacggaacgtacggtacttagtttaacgtttttagtcgttagttactaaagttatacggtaagtaagggtaaggtagtagttagttagttaggtttacgttaaggacggtacggtaaacgtaacggtaccttaccggttacgttacgggaccttaacggaccccgtaaaccggtaacccctaaaccccgtagttacccggttaccgtaaccctttccgttacccgttacccccttacccg

SEQ ID NO: 428893 - DNA, 532 bp, Homo sapiens
  misc_feature: GZ8MTXP02HQXZ0.13.3.A03.1.454.CMB.2.raw
  modified_base (217)..(217): a, c, t, g, unknown or other
  modified_base (221)..(221): a, c, t, g, unknown or other
  modified_base (286)..(286): a, c, t, g, unknown or other
  modified_base (298)..(298): a, c, t, g, unknown or other
  modified_base (308)..(308): a, c, t, g, unknown or other
  modified_base (318)..(318): a, c, t, g, unknown or other
  modified_base (328)..(328): a, c, t, g, unknown or other
  modified_base (335)..(335): a, c, t, g, unknown or other
  modified_base (344)..(344): a, c, t, g, unknown or other
  modified_base (355)..(355): a, c, t, g, unknown or other
tcagtcacgtactacacgaccggtgctcgatttagagagcgtcacgagggggggtcacaagaggcagcgctctcgggacgtctccaccatggcctgggctctgctgctcctcactctcctcactcaggacacagggtcctggacccagtctgccctgactcagcctgcctccatgtctggtctcctggacagtcatcacatctctgcatggaaatgnagtnatgttggattatgacttgtctctgtacgacaacaccagcaaagccccaaatcattattacggganaataagcgcctnagggctttcngtatctctcnctgctcagtncgacacncgtctccanactatctcganactcgacgacgacgagagtgtagttatttagttgttgttatatatagtagtaggaggtagtagtagttagtagttagttagtagtacggtacgtaacgtacgtaccgtaccgtcgtacgtacgaccgaaccgaccgaacccgtacgtacgtactacttacctaccttaccctacccg

SEQ ID NO: 428894 - DNA, 661 bp, Homo sapiens
  misc_feature: GZ8MTXP02FZ8W1.13.3.A03.1.454.CMB.2.raw
  modified_base (252)..(252): a, c, t, g, unknown or other
  modified_base (317)..(317): a, c, t, g, unknown or other
  modified_base (434)..(434): a, c, t, g, unknown or other
tcagtcacgtactacacgaccggtgctcgatttagagagcgtcacgagggggggggtcacaagaggcagcgctctcgggacgtctccaccatggcctgggctctgctgctcctcactctcctcactcaggacacagggtcctgggcccagtctgcctgactcagcctgcctccatgtcgtggtctcctggacagtcgatcaccatctcctgcactggaaatgcagtgatggttagggacttatcgtaccttntctccgtaggtacccgacaaccacccaggaccaaaaccgacccccctaaatactaataagtttanagtaactttacaacgttaacgtccgtaccctagtaggttcttaactactaaacgtcgtcccttacaacgtggaccctacgtaagtcgtggaccaaacggacccgtccctccgtaacncctactcgtcgtcggcctacgacggacgaacggacggacggacgtacgtagttaatttaaccgtcggtccggtacggttcctaccggtaggaacttacgttacctactttaacccgtttgtacgttcggtacgtagtcggtaacgaaccgtacgtccctaccggtacgtacgaccgaaccgaacccgtaacccgaaccctacccgtcgtaccgtacctaccgttccc

SEQ ID NO: 428895 - DNA, 553 bp, Homo sapiens
  misc_feature: GZ8MTXP02FHAG9.13.3.A03.1.454.CMB.2.raw
  modified_base (323)..(323): a, c, t, g, unknown or other
  modified_base (390)..(390): a, c, t, g, unknown or other
  modified_base (411)..(411): a, c, t, g, unknown or other
  modified_base (435)..(435): a, c, t, g, unknown or other
  modified_base (513)..(513): a, c, t, g, unknown or other
tcagtcacgtactacacgaccggtgctcgatttagagagcgtcacagggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgataaccatctcctgcactggaaatagcagtgatgttgggacttatgaccttgtctcctggtaccgacacacccaggcaaacgcccccaaatcattattacggggtcaataagcgcctcagggctttcngatcgcttctctcgctccaagtctggcaacgcgcctcctgacatctctgactcgagccgagcgagcngtattttactgttgttacatntgcgaaggaggtagtgatttacgngttcgttaggaagtgggtaaccaaacggtccgaccgtcgtttcggaccgacggaccccgaaaggcccctaaaaccccncgtcgtacctaccgttcccttccgtcccccgccccttacg

SEQ ID NO: 428896 - DNA, 712 bp, Homo sapiens
  misc_feature: GZ8MTXP02IW4WF.13.3.A03.1.454.CMB.2.raw
tcagtcacgtactacacgaccggtgctcgatttagagagcgtcacagggggggggtcacaagaggcagcgctctcgggacgtctccaccatggcctgggctctgctgctcctcactctcctcactcaggacacagggtcctgggcccagtctgccctgactcagcctgcctcatgtctgggtctccgtggacagtcgatcaccatctcctgcacgtgaaatgcagtgattggtaggtacttatcgtaccttgtctccgtcggtaaccacaaccaccaggaccaaacgaccccaaactctattagtttacgggacaagtaacgcggtcctacgacgggttctttcagtactcgtcttcgtccgtcggtacctacgaacgttcgtacggaccaacgtccggtcccttacccgtagtaacctaacgttccgttcgtacgggtacctaccggtaccgggaccggaacgggaacggtaaggtcccgtttagttttaaaacgtttttacgtcgtttacgtttactaagttagttggacgtaaggggtaagtacggttgtaatttgtaggtttacgttagggtaaacgggtcggtaaacccgtaggggttacctaccggttccgttacggaccttaccgggaaccctaaccggaaccccaaccgtaccggttcttaacccggtacctttaccggtttcccgttaaccccctttaccccg

SEQ ID NO: 428897 - DNA, 614 bp, Homo sapiens
  misc_feature: GZ8MTXP02HWQM8.13.3.A03.1.454.CMB.2.raw
  modified_base (224)..(224): a, c, t, g, unknown or other
  modified_base (453)..(453): a, c, t, g, unknown or other
  modified_base (470)..(470): a, c, t, g, unknown or other
  modified_base (483)..(483): a, c, t, g, unknown or other
  modified_base (487)..(487): a, c, t, g, unknown or other
tcagtcacgtactacacgaccggtgctcgatttagagagcgtcacagggggggggtcacaagaggcagcgctctcgggacgtctccaccatggcctgggctctgctgctcctcactctccctcactcaggacacagggtcctgggcccagtctgccctgactcagcctgcctccatgtctgggtctcctggacagtcgatcaccatctctgacactaggaaacngcagtgattcgtgggacttagtagacttgtctcctacggtaccaacacccacccaggacaaccgccccagacgtcactctaacgtttaggcggggactaacgtagggccggtaccggtcgtagggtatttaccgacgttacgtccctccgttcctcggtcctacgttaagtctcggaccaacgtaccgccctacctagacaactcgtctggtcctcgagcgtagacggngacgctgtctagttacngtctagctaacgntcgngtacgtcgttcgttacgttgtcgttacggtccggtacgggtacggtaactacggtccgtaccggtccgttaaggtccgaaccggtccgtaaccggtccgtaccccggtccccgttacggtacctccg

SEQ ID NO: 428898 - DNA, 603 bp, Homo sapiens
  misc_feature: GZ8MTXP01AVOG9.19.71.G05.1.454.CMB.2.raw
  modified_base (237)..(237): a, c, t, g, unknown or other
  modified_base (249)..(249): a, c, t, g, unknown or other
  modified_base (318)..(318): a, c, t, g, unknown or other
  modified_base (360)..(360): a, c, t, g, unknown or other
tcagtactctcgtgcacgaccggtgctcgatttagtgtcgtcgcaagagagaggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgaactgcaagtccagccacaatcttttanacagttaccaanaatagaaaactacttagcttaggaccagacagagaccaggacacgcctcctaggctgctctatttacgnggcatccgtaccgggatcccgggtcccctgacgatcagtgcnggcgggtctgggacagtacttcactctcaccatcacgacacgccgtcgcgacggcgtagaagtagtaggggtggtacgtagtttagtttagttagttactaaactaaattaatttaatttaattaacgtttacgttaacggttacggttaccggtaccggttaaaccgggtaaccggtaaacgggttaggttagttacgtaacgtaacgtaacggtaacgtacggttacggtcgttcgtaacg

SEQ ID NO: 428899 - DNA, 493 bp, Homo sapiens
  misc_feature: GZ8MTXP01DBPTA.19.71.G05.1.454.CMB.2.raw
  modified_base (233)..(233): a, c, t, g, unknown or other
  modified_base (423)..(423): a, c, t, g, unknown or other
  modified_base (471)..(471): a, c, t, g, unknown or other
tcagtactctcgtgcacgaccggtgctcgatttagtgtcgtcgcaagagagaggggaggtacaacaggcaggcagggcagcaagatggtgttgcagacccaggtctttatttctctgttgctctggatctctggtgcccacggggacatcgtgatgacccagtctccagactccctggctgtgtctctggcgagcgggccaccatcaactgcaagtccagccacaatctttanacagttccaaacaatgaaaactacttagctggtaccagcagagaccaggacagcctctaggctgctcatttactgggcatctaccggatccggggtcctgaccgattcagtggcagcgggtctgggacagattcactctcacatcagcagcctgcaggctgaagatgtggggctagtttatattgtcaanatattattatacttcgtgaacgttcgccaaagggacctaaggtgattnttcaagacgaatgtgctgcaac

SEQ ID NO: 428900 - DNA, 639 bp, Homo sapiens
  misc_feature: GZ8MTXP01CA4CU.19.71.G05.1.454.CMB.2.raw
  modified_base (238)..(238): a, c, t, g, unknown or other
  modified_base (250)..(250): a, c, t, g, unknown or other
  modified_base (322)..(322): a, c, t, g, unknown or other
  modified_base (393)..(393): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgaactgcaagtccagccacaatcttttanacagttaccaanaatagaaaactacttagcttaggaccagcagacgaccaggacacgccctccgtaggctgctactatttacgngggctacttaccgtaacccggggacgttccccgggggtcccccctacggaccgtattccgaggtcgggcgngggccgggtcgtggggacagtactttcactctcaccatcagcacgcctcgcgacgcgtagaagagtaggggtggtacgttagtttaagtttagttagttacgtaaactaaattaatttaatttaacttaacgttacggttaacggttacggttaccgggtaccggttaacgggtaaaccggtaacgggttaggttagttacgtaacgtaacgtaacgtaacgtacggttacggtcgttcgtaaccg

SEQ ID NO: 428901 - DNA, 499 bp, Homo sapiens
  misc_feature: GZ8MTXP01BS363.19.71.G05.1.454.CMB.2.raw
  modified_base (319)..(319): a, c, t, g, unknown or other
  modified_base (337)..(337): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcactgggtcaggcagtccccatcgagaggtctagagtggctgggaagcatatttcatgtccaanacgtggaactacaaattntgacaaccatctgttgagagtcgactgacatcaacgtagacacatacgaagaaccagtactcctgcagctgacctctgtcgacctcccgaggacgacgggtgtatattctgtggagacggccccagtacgacattcgccacctcgtctcgttggtgcgtaag

SEQ ID NO: 428902 - DNA, 598 bp, Homo sapiens
  misc_feature: GZ8MTXP01ELGBF.19.71.G05.1.454.CMB.2.raw
  modified_base (224)..(224): a, c, t, g, unknown or other
  modified_base (231)..(231): a, c, t, g, unknown or other
  modified_base (239)..(239): a, c, t, g, unknown or other
  modified_base (243)..(243): a, c, t, g, unknown or other
  modified_base (251)..(251): a, c, t, g, unknown or other
  modified_base (259)..(259): a, c, t, g, unknown or other
  modified_base (274)..(274): a, c, t, g, unknown or other
  modified_base (283)..(284): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgccacggggacatcgtgatgacccagtctccagactcctggctgtgtctctgggcgagcgggctacgactacgactgactaagtcagcanatcttanacatacanatanaactatanctgtacancagacgacagacacnctctacgcnnctctattacgtggcactacgtaccggacgtcggtccgtccgacgtactacgtacgtcgacgacggcggtcgtcggacgacgtacttactactctacacactacacgcacgacgtcgacgacgacgtacgaacgtagtgtcgggtacgtagtttagttagttacgtactaactaaacttaatttaattaacttacgttacgttacggtaacggttacggttacggtaaacgggttaacggtaaacgggtaaggttaacgttacgttacgtaacgtaacgtaacgtacggtacggttacgtaacgttaacgtaacg

SEQ ID NO: 428903 - DNA, 595 bp, Homo sapiens
  misc_feature: GZ8MTXP01D8KXP.19.71.G05.1.454.CMB.2.raw
  modified_base (221)..(221): a, c, t, g, unknown or other
  modified_base (231)..(231): a, c, t, g, unknown or other
  modified_base (237)..(237): a, c, t, g, unknown or other
  modified_base (241)..(241): a, c, t, g, unknown or other
  modified_base (246)..(246): a, c, t, g, unknown or other
  modified_base (249)..(249): a, c, t, g, unknown or other
  modified_base (255)..(255): a, c, t, g, unknown or other
  modified_base (260)..(260): a, c, t, g, unknown or other
  modified_base (268)..(268): a, c, t, g, unknown or other
  modified_base (288)..(288): a, c, t, g, unknown or other
tcagtactctcgtgcacgaccggtgctcgatttagtgtcgtcgcaagagagagggggtacaacaggcaggcagggcagcaagatggtgttgcagacccaggtcttcatttctctgttgctctggatctctggtgcccacggggacatcgtgatgacccagtctccagactccctggctgtgtctctgggcagcgggccacgatcgactgcaagtccagcanaatctttaanatcaanatanaactntantgacancaganacagacanctcagctgctctatttacgnggcatccgtaccggagtcccggggtcctcgaccgtattcgagtcggacgaggtcgggtctcgggactagtactttcacttctacacctatacacgacacgaccgtcgcgacggacgtagaagtagtaggtcggggtacgttagtttaagtttagttagtactaaactaaattaatttaatttaattacgtttacgttacggtaacggttacggttaccggtaacgggttaaccggtaaacggtaaggttaacgttacgttacgtaacgtaacgtaacgtaggtacggttacgtcgttaacgtaaccg

SEQ ID NO: 428904 - DNA, 519 bp, Homo sapiens
  misc_feature: GZ8MTXP01BQ5SR.19.71.G05.1.454.CMB.2.raw
  modified_base (232)..(232): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgcccacggggacatcgtgatgacccagtctccagactccctggctgtgtctctggcgagcgggccaccatcaactgcaagtccagccacaatctttanacagttccaaacaatagaaaactactagctggtacagcagagaccaggacagcctcctaggctgctcatttactgggcatctacccgggaatcccggggtcctcgaccgatcgagtggcagcgggtctgggacagtattcactctcaccatcagcagcctgcaggctagaagatgtggggctagtttatatgtacaataattattattatacttcgtgtaacgttcggacaaagggccgtaaagggtggattagttacaagaccgtaatggtggactcggctaaccg

SEQ ID NO: 428905 - DNA, 582 bp, Homo sapiens
  misc_feature: GZ8MTXP01D40MN.19.71.G05.1.454.CMB.2.raw
  modified_base (242)..(242): a, c, t, g, unknown or other
  modified_base (251)..(251): a, c, t, g, unknown or other
  modified_base (255)..(255): a, c, t, g, unknown or other
  modified_base (264)..(264): a, c, t, g, unknown or other
  modified_base (349)..(349): a, c, t, g, unknown or other
tcagtactctcgtgcacgaccggtgctcgatttagtgtcgtcgcaagagagagggggtgaggtacaacaggcaggcaggggcagcaagatggtgttgcagacccaggtcttcatttctctgttgctctggatctctggtgcccacggggacatcgtgatgacccagtctccagactccctggctgtgtctctggggcgagcgggccacgatacgaactgacaagtccagccacaatctttanacatacaanatanaaactatanctgacagcagacacagacacgcctcagctgctactatttacgcggacacgtaccgtaccggacgtcccccgggtcctagaccgtnttacgaagtcggcgacgcgggtcgtcggacgagtacttactactctacacactacacgacgacgctcgacgacgacgtagaagaggtagtagtacgtagtttattagttagtactaaactaattaattattaacttacgttaacgttacggttacggttacggttaccgtaaacggtaacggttaacggttacggttagtaatacgtaacgacgtacgttacgtcgttcgtcg

SEQ ID NO: 428906 - DNA, 606 bp, Homo sapiens
  misc_feature: GZ8MTXP01BN9RX.19.71.G05.1.454.CMB.2.raw
  modified_base (231)..(231): a, c, t, g, unknown or other
  modified_base (240)..(240): a, c, t, g, unknown or other
  modified_base (249)..(249): a, c, t, g, unknown or other
  modified_base (253)..(253): a, c, t, g, unknown or other
  modified_base (259)..(259): a, c, t, g, unknown or other
  modified_base (275)..(275): a, c, t, g, unknown or other
  modified_base (305)..(305): a, c, t, g, unknown or other
  modified_base (364)..(364): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccacgatacaactgacaagtccagccanaatctttanacatacaanatanaaactntagctagacagcaganacagacagcctcgagctgctctatttacgnggctagtccgtaacccgggacgtcccggggtcccctaggaccgtattcgaggtcggcgngggcgggtcgtagggactagtactttcactctacacatcagcacgcctgcgaggctaggaagtgtggggtaggtacttaagtttattattacgtaactaaacttaaatttatttaactttaacgttacgtttcgggtaacgggttaaccggttaccgggaaccggttaaagggtaaccgtaaggggttacgttaattaacgtaacgaaggtaacgtaacgtggttacggtaacgttcgaacc

SEQ ID NO: 428907 - DNA, 518 bp, Homo sapiens
  misc_feature: GZ8MTXP01CC8J4.19.71.G05.1.454.CMB.2.raw
  modified_base (365)..(365): a, c, t, g, unknown or other
  modified_base (508)..(508): a, c, t, g, unknown or other
  modified_base (513)..(518): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcctagttttattattgtactaaaactaattnttatttatactttcgtggtacgttcggaccaaggggtaccaagggttggatatcgaagacgaactggtgctgcacatctgtcttcatccttcccgctatctgacacgagaagtcttgacggcgggctggggacagggccgaanagtgnnnnnn

SEQ ID NO: 428908 - DNA, 525 bp, Homo sapiens
  misc_feature: GZ8MTXP01CIVDC.19.71.G05.1.454.CMB.2.raw
  modified_base (352)..(352): a, c, t, g, unknown or other
  modified_base (374)..(374): a, c, t, g, unknown or other
  modified_base (489)..(489): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatcctccggggacagagtcgctagcgacagtgttgcttggcacgtgggtcaggcagtccccatcgagaggtctagagtggctggggaaggacagtatttcaattgtcccaaanacggttggaaatacaaatttanagcaccatctgttgagagtcgactgacaatacaacgtagacgacatacgaagaacctagtcctaccctgctagctcgaccctctcgttcgaccgttcccggaaggcgacgggttnttataatacgtgtggaacgacggtccccaagtaacg

SEQ ID NO: 428909 - DNA, 512 bp, Homo sapiens
  misc_feature: GZ8MTXP01ESCWN.19.71.G05.1.454.CMB.2.raw
  modified_base (364)..(364): a, c, t, g, unknown or other
  modified_base (475)..(475): a, c, t, g, unknown or other
  modified_base (483)..(483): a, c, t, g, unknown or other
  modified_base (497)..(497): a, c, t, g, unknown or other
  modified_base (505)..(505): a, c, t, g, unknown or other
  modified_base (507)..(512): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccgggggtccctgaccgattcagtggcagcgggtctgggacagatttcactctcaccatcagcagcctgcaggctgaagatgtggcctaggttttatattgtacaaaactaatntttattatactttcgtggtacgttcggaccaaaggggacctaagggtgataatcaagacgaactgtggctgacaccagtctgtcttcatccttcccgctattctgacacgngaagtacnggagcgggctgcgngacgcgangnnnnnn

SEQ ID NO: 428910 - DNA, 514 bp, Homo sapiens
  misc_feature: GZ8MTXP01EHFXP.19.71.G05.1.454.CMB.2.raw
  modified_base (237)..(237): a, c, t, g, unknown or other
  modified_base (353)..(353): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctctaggctgctcatttactggcatctaccgggatccggggtcccctgacgattcagtggcnggcgggtctgggacagtatttcactctcaccatcagcagcctgcaggctgaagatgggtggctagtttatattgtacaataaattattattatacttcgtggtaacgttcggaccttaaagggaccaaggttggattatcagaacgaatgttgcttgaacc

SEQ ID NO: 428911 - DNA, 540 bp, Homo sapiens
  misc_feature: GZ8MTXP01C4CN9.19.71.G05.1.454.CMB.2.raw
  modified_base (501)..(501): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatccgtccggggacagagtcgctagcgacagtgttgcttggcacgtggtcaggccacgtccccatcgagaggtctagagtggcgtgggaaggactatatttcaattcgtccaaacgacgtaggaaactacaaattatgacactatctgttagagagtcgactagaacaatacaaacgtagacaacagtacgaaacgaacctacgttcctccctagctacgctcgacctcgtgttcgaccgttccggaaggcgttacgggttnttaataattacgtggtaggacgacggtccccaagtaacg

SEQ ID NO: 428912 - DNA, 512 bp, Homo sapiens
  misc_feature: GZ8MTXP01CHC03.19.71.G05.1.454.CMB.2.raw
  modified_base (238)..(238): a, c, t, g, unknown or other
  modified_base (313)..(313): a, c, t, g, unknown or other
  modified_base (359)..(359): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacngggcatctacccggggatccggggtcccctgaccgattcagtggcngcgggtctggggacagatttcactctcacatcagcagcctgcaggctagaagatgggtggactagtttatattgtacaataatattattatacttgtgtacgttcggcaagggtaccaaggttggattatcagaacgactggttaggcttgcc

SEQ ID NO: 428913 - DNA, 618 bp, Homo sapiens
  misc_feature: GZ8MTXP01AKN5I.19.71.G05.1.454.CMB.2.raw
  modified_base (240)..(240): a, c, t, g, unknown or other
  modified_base (249)..(249): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctcgtggggcgagcgggcacgatacgactgactaagtccagcacaatctttanacatacaanatagaaactctagctagacagcagagacagacacgtcctacgtagctcgctactagtttacgcggactacgtccgtaccggtacgtcccccgggtacctagaccgtatcgaacggtcggcgacgggtcgggtcgtagggactagtacttcactctacactactacgacgacgacgcgtcgacgacgacgtagtaagtaggtaggtaggtacgttagtttagttagttacgttactaaactaacttaattaacttaacgttacgttaacggttacggttacggtaccggttaccggtaaacgggtaacggttaacggttacggttacgtaacgtacgtaacgtaacggtacggttacggtcggttcgtcg

SEQ ID NO: 428914 - DNA, 622 bp, Homo sapiens
  misc_feature: GZ8MTXP01AINXQ.19.71.G05.1.454.CMB.2.raw
  modified_base (227)..(227): a, c, t, g, unknown or other
  modified_base (236)..(236): a, c, t, g, unknown or other
  modified_base (245)..(245): a, c, t, g, unknown or other
  modified_base (249)..(249): a, c, t, g, unknown or other
  modified_base (255)..(255): a, c, t, g, unknown or other
  modified_base (258)..(258): a, c, t, g, unknown or other
  modified_base (306)..(306): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgacaagtccagccanaatctttanacatacaanatanaaactntanctgacagcagacgacaggacacgtcctcgtagctgctactatttacgngggactacgtaccggtaacccgggaacgttccccggggtacctacggaaccgtattacgaggtcggacgacgggtcgggtcggtcgggacgtagtacttactactacctacctacctactacgacgacgacgaccgtcgacgacgacgtagaagtagtagtagggtacgttagtttattagttacgtactaactaattaattaattattacgttacggtcggtaacggttacggttacggtaaacgggaacggtaaacggtaaggttagttacgttacgtaacgacgtaacgtaggtacggttacgtcgcgtaacg

SEQ ID NO: 428915 - DNA, 594 bp, Homo sapiens
  misc_feature: GZ8MTXP01EJ89P.19.71.G05.1.454.CMB.2.raw
  modified_base (240)..(240): a, c, t, g, unknown or other
  modified_base (249)..(249): a, c, t, g, unknown or other
  modified_base (253)..(253): a, c, t, g, unknown or other
  modified_base (262)..(262): a, c, t, g, unknown or other
  modified_base (362)..(362): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatctttaanacatacaanatanaaactatanctagacagacagacacagacagcctcagctgctactattacgtcggacactaccgtaccggtacgtccggtccccgtacgacgtactcgtacgtacgcgnggcgggtcgtaggacgtagtacttctactctacacactacacgacgacgacgtcgacgacggacgtagtaagtagtagggtagtagttagtttagttagttagtactaactaaattaattaattaattacgttacgtaacggtacggttacggtacggttaaacggtaacggtaaggttaggttagttacgtaacgtacgtaacgtacgtacggttacggtcgttcgtaacg

SEQ ID NO: 428916 - DNA, 589 bp, Homo sapiens
  misc_feature: GZ8MTXP01CTEKT.19.71.G05.1.454.CMB.2.raw
  modified_base (233)..(233): a, c, t, g, unknown or other
  modified_base (241)..(241): a, c, t, g, unknown or other
  modified_base (245)..(245): a, c, t, g, unknown or other
  modified_base (250)..(250): a, c, t, g, unknown or other
  modified_base (253)..(253): a, c, t, g, unknown or other
  modified_base (259)..(259): a, c, t, g, unknown or other
  modified_base (265)..(265): a, c, t, g, unknown or other
  modified_base (272)..(273): a, c, t, g, unknown or other
  modified_base (283)..(283): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgactaagccagcacatctttanacatcaanatanaaatntanctgacngcaganacagacnnctcacgctcnctctattacgtcgcactacgtaccggtacgtccggtccccgtacgacgtacgtcgtagtacgcgcggcgggtcgtacgggacgagtacttactactactaccacactacacgacgacgcgtcgacgacgacgtacgaagtagtggggtacgtacgttagtttaagttagttacgtactaaacttaaattaattaatttacttacgtttacggttaacggttacggttacggtaccggaacggtaacgtaacggttaggttacgttagtaacgtacgtaacgtacgtacgttacgtcgttcgtaacg

SEQ ID NO: 428917 - DNA, 512 bp, Homo sapiens
  misc_feature: GZ8MTXP01DQLB1.19.71.G05.1.454.CMB.2.raw
  modified_base (496)..(496): a, c, t, g, unknown or other
  modified_base (498)..(498): a, c, t, g, unknown or other
  modified_base (500)..(500): a, c, t, g, unknown or other
  modified_base (504)..(512): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccggggaatccgggggtccctgaccgattcagtggcagcgggtctgggacagatttcactctcaccatcacgcagcctgcaggccctgaagatgtgcctagtttattattgtacaaaactaattaatttattattaacttcgtaggtacgttcgggacctaagggacaaggtggatatcaagacgtaactgtggctgacaccagtctgtcttcactccttccctcatctgacacgagaagtacttgagcggcgngngngcgnnnnnnnnn

SEQ ID NO: 428918 - DNA, 646 bp, Homo sapiens
  misc_feature: GZ8MTXP01EYFCD.19.71.G05.1.454.CMB.2.raw
  modified_base (239)..(239): a, c, t, g, unknown or other
  modified_base (250)..(250): a, c, t, g, unknown or other
  modified_base (317)..(317): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgaactgcaagtccagccacaatcttttaanacattaccaanaatagaaactactagcttaggaccagacagacgaccaggacacgcctcgagctgctactatttacgnggacacgtccgtaacccgggtacgtcccggggtccccctacggaccgtagttcgaggtcggacgaacgggtccgggtcgtaggggactagttactttaccgacctcctaccaacctatcacgacgacgaccgtcgacgacggacgtagaagtagtagggtggtacgttagtttagttagttagtacgtaaactaaattaatttaatttaacttacgttacggttaacggttacggttaccggtaccggttaaacgggtaaacggtaaacggttaggttagttacgtaacgtaacgtaacgtaacgtacggttacggtcgttcgtaaccg

SEQ ID NO: 428919 - DNA, 523 bp, Homo sapiens
  misc_feature: GZ8MTXP01C0RMX.19.71.G05.1.454.CMB.2.raw
  modified_base (237)..(237): a, c, t, g, unknown or other
  modified_base (311)..(311): a, c, t, g, unknown or other
  modified_base (349)..(349): a, c, t, g, unknown or other
  modified_base (376)..(376): a, c, t, g, unknown or other
  modified_base (417)..(417): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcaactgcaagtccagccacaatctttanacagttccaaacaatagaaaactacttagcttggaccagcagagaccaggacagcctctagctgctcatttacnggcatcctacccgggatcccggggtccccctggaccgnttccagtggcaaggcgggtctgggacngtactttcactctcaccatcagcagcctgcaggctgaaagntggtggactagtttatattgtactaataattattattatacttgtgtacgttcggaccaaagggaccaaggttaggattagtcagaacgaactgttggtcttgaac

SEQ ID NO: 428920 - DNA, 722 bp, Homo sapiens
  misc_feature: GZ8MTXP01C50A8.19.71.G05.1.454.CMB.2.raw
  modified_base (238)..(238): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgacaagtccagccacaatctttanacagttaccaacaatgaaaactacttagctggtaccagcagagaccaggacagcctctaggctgctcatttactggctatccgtacccggggatcccgggggtccccctggaccgtattccgaggtcggacgaaggccggggttcctagggggaacctagggtaacttttccaccttcctaccaacccctaattccaacggcccaaacgtccccgtggacccgaaggggaccttaggaaaacgtagttggggtaggggtacctttaaaggtttttaatttaactttaggttaaccctaaaactaaatttaaacttttaaacttttaaattacccgttttacgggttaacggggttaacccggttttaccgggggaacccgttaaaacgggggtaaccctaagggggtttacgggttaaacttaagttaaccgaaagggtaaaccggtaaaccgttgggttacgggtaaccgttcggtaaccccg

SEQ ID NO: 428921 - DNA, 590 bp, Homo sapiens
  misc_feature: GZ8MTXP01DU8HT.19.71.G05.1.454.CMB.2.raw
  modified_base (95)..(95): a, c, t, g, unknown or other
  modified_base (191)..(191): a, c, t, g, unknown or other
  modified_base (208)..(208): a, c, t, g, unknown or other
  modified_base (230)..(230): a, c, t, g, unknown or other
  modified_base (236)..(236): a, c, t, g, unknown or other
  modified_base (246)..(246): a, c, t, g, unknown or other
  modified_base (261)..(261): a, c, t, g, unknown or other
tcagtactctcgtgcacgaccggtgctcgatttagtgtcgtcgcaagagagaggggggtgaggtacaacaggcaggcaggggcagcaagatggtnttgcagacccaggtcttcatttctctgttgctctggatctctggtgcccaggggacatcgtgatgacccagtctccagactccctggctgtgtctntgggcagcgggctacgntcgactgactaagcagcacatnttatanatacacatanaatatatctgtacanacagagacagacacgctctacgctcgtctactactttacgtacggtactactacgtaccggtacgtccccgggtccgtacgtacgtactcgtacgtcgcgacggtcgggtcgtcggacgagtattactactctacacactacacgacacgctcgcgacgacgtagagaggtgtgtacgttagtttatttattacgttactaaactaattaatttaatttacttacgttaacgttacggttacggttaccggttaccggtaaacgggtaacggttaacggttaggttaagttaagtacgtaacgtaacgtacgttacggtcggttcgtcg

SEQ ID NO: 428922 - DNA, 534 bp, Homo sapiens
  misc_feature: GZ8MTXP01DDA6F.19.71.G05.1.454.CMB.2.raw
  modified_base (241)..(241): a, c, t, g, unknown or other
  modified_base (252)..(252): a, c, t, g, unknown or other
  modified_base (418)..(418): a, c, t, g, unknown or other
  modified_base (427)..(427): a, c, t, g, unknown or other
  modified_base (510)..(510): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagactccctggctgtgtctctgggcgagcggggccacgatacgaactgacaagtccagccacaattctttanacagttccaanaatagaaaactacttagcttggtaccagcagagaccaggacagcctctaggctgctcatttactgggcatctacccgggatccggggtcccctggaccgtattcagtgctgcgggtctggggacagtatttcactctacacatcagcagcctgcaggctgaaagtntgggtcgtnttagtttatatgtacaataattattattactacgttcgtaagtacgttcggacgaaaggtacgtaaggttagttattacgaanagaacgacgtgttgtcgcgtaacg

SEQ ID NO: 428923 - DNA, 517 bp, Homo sapiens
  misc_feature: GZ8MTXP01DXR0G.19.71.G05.1.454.CMB.2.raw
  modified_base (224)..(224): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctntcgctcacctgtgccatctccgggggacagagtcgctagcgacagtgttgcttggcacgtgggtcaggcagtccccatcgagaggtctagagtggctgggaaggacatatttcaattgtccaaacacgtaggaaatacaaattatgacaccatctgttgagagtcgatgacaatcaaacgtagacacatacgaaagaaccagttctccctgctagctcgacctctgttcgaccttccgaaggtacacgggttgttaactaattacgtggtaggacgacggtccccaagtaacg

SEQ ID NO: 428924 - DNA, 642 bp, Homo sapiens
  misc_feature: GZ8MTXP01ERJB8.19.71.G05.1.454.CMB.2.raw
  modified_base (233)..(233): a, c, t, g, unknown or other
  modified_base (241)..(241): a, c, t, g, unknown or other
  modified_base (249)..(249): a, c, t, g, unknown or other
  modified_base (259)..(259): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcctacgactacgactgactaagtccagccanatctttanacatacanatacaaactntagctagacagacagacgacgagacacgtcctcgtacgtctcgtctactacttacgtcggtactacgtaccgtaccggtacggtccggtccccgtacgtacgtacgtcgtacgtcggcgcggtcgggtcggtacgggacgtacgtacttactactactacctactactacgacgacgacgtaccgtcgacgacgacgtacgaagtagtacggggtacggtacgttagtttagtttagttacgtaactaaacttaaacttaactttaactttaacgttacgttacggttaacggtacggttacggtaacggaacgggtaacggtaaggttacggttacgttacgtaacgtacgtaacgtacgtacggttacgtcgttcgtaacg

SEQ ID NO: 428925 - DNA, 495 bp, Homo sapiens
  misc_feature: GZ8MTXP01BD88J.19.71.G05.1.454.CMB.2.raw
  modified_base (257)..(257): a, c, t, g, unknown or other
  modified_base (318)..(318): a, c, t, g, unknown or other
  modified_base (467)..(467): a, c, t, g, unknown or other
tcagtactctcgtgcacgaccggtgctcgatttagtgtcgtcgcaagagagagggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacngggtcaggcagtccccatcgagaggtctagagtggctgggaagcatatttcatgtaccaanacgtggaaactacaaattatgcaaccatctgtgagagtcgactgacaatacaacgtagacacatacgaagaaccagttctccctgcagctgacctctgtgacctcccgaggacgacggtgtatatactgtggaagacgcccatacgacnttcgccacctcgtctcttggtgcgtaag

SEQ ID NO: 428926 - DNA, 499 bp, Homo sapiens
  misc_feature: GZ8MTXP01DHC4L.19.71.G05.1.454.CMB.2.raw
  modified_base (359)..(359): a, c, t, g, unknown or other
  modified_base (456)..(456): a, c, t, g, unknown or other
  modified_base (459)..(459): a, c, t, g, unknown or other
  modified_base (494)..(499): a, c, t, g, unknown or other
tcagtactctcgtgcacgaccggtgctcgatttagtgtcgtcgcaagagagaggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggccagtttattattgtcaaaacaattnttatttatacttcgtggacgttcggccaagggaccaaggtggatatcaagacgaactgtgctgacaccatctgtcttcatccttccgctatctgacncgngaagtacttggagcggggctgggcagggcgcatgnnnnnn

SEQ ID NO: 428927 - DNA, 605 bp, Homo sapiens
  misc_feature: GZ8MTXP01DF603.19.71.G05.1.454.CMB.2.raw
  modified_base (237)..(237): a, c, t, g, unknown or other
  modified_base (246)..(246): a, c, t, g, unknown or other
  modified_base (250)..(250): a, c, t, g, unknown or other
  modified_base (259)..(259): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctggcgaggcggcgaccaagtcgaactgacaagtccagcacaatctttaanacatacaanatanaaactctanctagacagcagagacagacacgtcctacgtagctcgactactatttacgcggactacgtaccgtaacccgggtacgtcccggggtacctacggacctagttcgacgtcggacgagggtcgggtacgtacgggactagttacttacactcctacctactactacacgacgacgacgtcgacgacgacgtagtaagtagtaggtagggtacgttaagtttattagttacgtactaactaattaattaattattacgttacgtacggtaacggtacggttacggtaacggaacggtaaggtagttagttacttacgtaagaacgtaacgtagtgttacgtcgcgtaacg

SEQ ID NO: 428928 - DNA, 581 bp, Homo sapiens
  misc_feature: GZ8MTXP01ELGA1.19.71.G05.1.454.CMB.2.raw
  modified_base (529)..(529): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagagtcgctagcgacagtgttgcttggcacgtggtcaggcacgtccccagtcgagaggtctagagtggcgtagggaaggactattatttcaattcgtccaaacgtacgtaggaaactaacgaaattatgacaacctatcgtgttagagtacgtcgactagaactaatacaaacgtagaacgaactaagtacgaaacgacctacgttccctaccctagcacggtctacgacccttcgtcgttacgacccgttacccggaggaccgttacggggttnttaagttaagttacgtggttacgggaacggacccgggtaaccccaagtaacg

SEQ ID NO: 428929 - DNA, 606 bp, Homo sapiens
  misc_feature: GZ8MTXP01ATY44.19.71.G05.1.454.CMB.2.raw
  modified_base (244)..(244): a, c, t, g, unknown or other
  modified_base (326)..(326): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccacgatacgaactgacaagtccagccacaattcttttaanactagtaccaacaatacgaaactacttagcttaggaccagacagacgaccgaggacacgcctcgtaggctgctctattacgnggacacgtccgtaacccgggacgtcccggggtcccctacggacgtatcgaggtcgcgcggtcgggtcgtagggactagtacttcactctacacacgtacacgcacgcctcgcgacgacgtagagtagtaggggtggtacgttagtttagtttagttacgtactaactaattaattattattacgttcgttaacggtacggttacggtaccggaacggtaacggtaaggttaggttagttacgtaacgacgtaacgacgtacgttacggtcgttcgtaacg

SEQ ID NO: 428930 - DNA, 604 bp, Homo sapiens
  misc_feature: GZ8MTXP01EYDAF.19.71.G05.1.454.CMB.2.raw
  modified_base (238)..(238): a, c, t, g, unknown or other
  modified_base (248)..(248): a, c, t, g, unknown or other
  modified_base (252)..(252): a, c, t, g, unknown or other
  modified_base (296)..(296): a, c, t, g, unknown or other
  modified_base (308)..(308): a, c, t, g, unknown or other
  modified_base (410)..(410): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactcgacaagtcagccacaatctttaanacataccaanatanaaactatagtctagacagcagacgacagacacgcctcgtagctnctactatttcgnggactacgtaccgtacccggtacgtcccgggtcctcgaccgtatcgagtcggacgtagggtcgggtcgtacgggactagttacttacactactaccacctanacacgacgacgtccgtcgacgacgacgtagaagtagtagtagggtacgttagtttattagttacgtaactaaactaattaattaattaacttacgttacgttacggtaacggttacggttacggtaacggttaacgtaaggtaggttagttacgttacgtaacgtacgtaacgtagtacgttcgtcgcgtaacg

SEQ ID NO: 428931 - DNA, 505 bp, Homo sapiens
  misc_feature: GZ8MTXP01EZKGG.19.71.G05.1.454.CMB.2.raw
  modified_base (238)..(238): a, c, t, g, unknown or other
  modified_base (351)..(351): a, c, t, g, unknown or other
  modified_base (495)..(495): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatgaaaactacttagcttggtaccagcagagaccaggacagcctctaggctgctcatttactggcatctaccggatccgggtcccctgacgatcagtgcngcgggtctgggacagattcactctcaccatcagcagcctgcaggctgaagatggtggctagtttatattgtcaataattattattatacttcgtggtacgttcggccaaagggaccaaagggttggattatcagaacgaactgnggcttgaacc

SEQ ID NO: 428932 - DNA, 511 bp, Homo sapiens
  misc_feature: GZ8MTXP01BSVE5.19.71.G05.1.454.CMB.2.raw
  modified_base (238)..(238): a, c, t, g, unknown or other
  modified_base (355)..(355): a, c, t, g, unknown or other
  modified_base (484)..(484): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagagaccaggacagcctcctaggctgctcatttactggcatctacccgggatccggggtcccctgacgatcagtgcngcggtctgggacagatttcactctcaccatcagcagcctgcaggctgaagatgggtggctagtttattattgtacaataattattattatacttcgtggtacgttcggaccaaagggaccaagggttgnttatcagaacgaatgttggcttgaacc

SEQ ID NO: 428933 - DNA, 637 bp, Homo sapiens
  misc_feature: GZ8MTXP01DYA78.19.71.G05.1.454.CMB.2.raw
  modified_base (231)..(231): a, c, t, g, unknown or other
  modified_base (241)..(241): a, c, t, g, unknown or other
  modified_base (250)..(250): a, c, t, g, unknown or other
  modified_base (254)..(254): a, c, t, g, unknown or other
  modified_base (300)..(300): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagactccctggctgtgtctcgtgggcgagcgggccacgatacgaactgacaagtccagccanaatctttaanacatacaanatanaaactatagctagacagacagacgacagacacgtcctacgagctcnctactattacgtcggactactaccgtaccggtacggtccggtccccgtacgtacgtacgtacgtacgtacgacgcggtcgggtacggtacggacgtacgtacttactactactactaccactacacgacgacgacgtacgacgacgacgtagtaagtagtagggtacggtacgttaagtttaagtttagttacgttaactaaacttaaactttaatttaatttaacgttacgttacggttaacggttacggttacggtaaccggttaaacggtaaacggtaacggttagttagttacgtaagtaacgtaacgtacgtaggttacgtcgttcgtaacg

SEQ ID NO: 428934 - DNA, 577 bp, Homo sapiens
  misc_feature: GZ8MTXP01C94AK.19.71.G05.1.454.CMB.2.raw
  modified_base (235)..(235): a, c, t, g, unknown or other
  modified_base (315)..(315): a, c, t, g, unknown or other
  modified_base (356)..(356): a, c, t, g, unknown or other
  modified_base (362)..(362): a, c, t, g, unknown or other
  modified_base (368)..(368): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtcagccacaatctttanacagttaccaaacaatagaaaactacttaagcttggtaccagacagagaccaggacagcctcctaggctgctcatttacnggcatctacccgggatccggggtcccctgacgatcagtgcngcggtntggganacccgattcactctcaccatcagcagcctgcaggctagaagagtgggtacggtacttaagttttattaagtttgtacctaaactaaattaatttaatttaattaacctttggtaagggtaaccgtttcgggaacccgttaaaggggaaccgtaaagggttggaattagttaaccgaaggaacgtaaacgtggttggtcttcggtaaccc

SEQ ID NO: 428935 - DNA, 652 bp, Homo sapiens
  misc_feature: GZ8MTXP01BSR5T.19.71.G05.1.454.CMB.2.raw
  modified_base (228)..(228): a, c, t, g, unknown or other
  modified_base (238)..(238): a, c, t, g, unknown or other
  modified_base (247)..(247): a, c, t, g, unknown or other
  modified_base (249)..(249): a, c, t, g, unknown or other
  modified_base (251)..(251): a, c, t, g, unknown or other
  modified_base (257)..(257): a, c, t, g, unknown or other
  modified_base (260)..(260): a, c, t, g, unknown or other
  modified_base (305)..(305): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccanaatctttaanacatacaanananaaactntanctgacagcagacgacagacagcctctagctgactactatttacgngggctacgtccgtaacccgggaacgtcccggggtcctacggaccgtattcgagtcggacgacggtcgggtcggtacgggacgtacgtacttactactacctacctacctactacacgacgacgtaccgtcgacgacggacgtagtaagtagtaggtacggggtacgttagtttaagtttaagtttacgtaactaaacttaaatttaatttaatttaacttacgttacggttacggttaaccggttaccggttaccggtaaacgggttaaacggtaaacggtaaggttaacgttacgttacgtaacgtaacgtaacgtacggtacggttacgtcgttaaccgtaaccg

SEQ ID NO: 428936 - DNA, 616 bp, Homo sapiens
  misc_feature: GZ8MTXP01AKVR4.19.71.G05.1.454.CMB.2.raw
  modified_base (238)..(238): a, c, t, g, unknown or other
  modified_base (248)..(248): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcagcgggcacgatacgaactgacaagtccagccacaatcttttanacataccaanatagaaactactagctgacagcagacgaccaggacacgccctccgtaggctgctactatttacgtggacatccgtacccgggaacgtcccggggtccccctggaccgtattcgacgtacggcgcggcgggtcggtcgggtacgagtacttactactcctccaccactacacgacgacgccgtcgcgacggtacgtagaagtagtaggggtcggtacgttagtttagtttagttagttactaaactaaattaatttaatttaatttacgtttacggttaacggtacggttaccggtaccggttaacggtaacggtaaggttaggttagttacgtaacgtagtaacgtacgtaggttacgtcgttcgtcg

SEQ ID NO: 428937 - DNA, 495 bp, Homo sapiens
  misc_feature: GZ8MTXP01DS297.19.71.G05.1.454.CMB.2.raw
  modified_base (237)..(237): a, c, t, g, unknown or other
  modified_base (278)..(278): a, c, t, g, unknown or other
  modified_base (307)..(307): a, c, t, g, unknown or other
  modified_base (334)..(334): a, c, t, g, unknown or other
  modified_base (342)..(342): a, c, t, g, unknown or other
  modified_base (348)..(348): a, c, t, g, unknown or other
  modified_base (358)..(358): a, c, t, g, unknown or other
  modified_base (390)..(390): a, c, t, g, unknown or other
  modified_base (396)..(396): a, c, t, g, unknown or other
  modified_base (408)..(408): a, c, t, g, unknown or other
  modified_base (468)..(468): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgacaagtccagccacaatctttanacagttccaacaatgaaaactcttagcttggaccagcaganaccagacagcctctaggctgctcatttcnggcatcaccggatccgggtccctgacntcagtgcnggcgtntgggacagtnttcactctcacatcagcagcctgcagctgaantggtgntagtttatagtntacaaataattattagttatacttcgtggtacgttcggaccaaaggggaccaagggttgnttaagcaaggcaatgttagcttcgaac

SEQ ID NO: 428938 - DNA, 550 bp, Homo sapiens
  misc_feature: GZ8MTXP01AO79Q.19.71.G05.1.454.CMB.2.raw
  modified_base (237)..(237): a, c, t, g, unknown or other
  modified_base (315)..(315): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaattcttttanacagttaccaaacaatagaaaactactagctggtaccagcagagaccaggacagcctcctaggctgctactatttacngggcacgtccgtaaccccgggaatcccgggggtccctcggaccgtagttcgaggtcggcagggtccgggtcgtggggacaggtactttcgactctacaccatcagcagcctgcaggctagaagatggtgggacttagtttattattgtacaataattattattatacttcgtgtaacgttcggaccgaaggaccgtaaggtgattgttacaaggacgaacgtggaggctcgcaac

SEQ ID NO: 428939 - DNA, 593 bp, Homo sapiens
  misc_feature: GZ8MTXP01CQPO4.19.71.G05.1.454.CMB.2.raw
  modified_base (240)..(240): a, c, t, g, unknown or other
  modified_base (250)..(250): a, c, t, g, unknown or other
  modified_base (254)..(254): a, c, t, g, unknown or other
  modified_base (309)..(309): a, c, t, g, unknown or other
  modified_base (364)..(364): a, c, t, g, unknown or other
  modified_base (393)..(393): a, c, t, g, unknown or other
  modified_base (398)..(398): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggggccacgatcgaactgacaagtccagccacaatcttttanacataccaanatanaaactatagcttagacagcagacgaccagacagcctcgagctgctctatttacgnggactataccgtaaccgggacgtccggggtcccctaggacgtattcgagtggcgnggtcgggtctagggacagtacttcactcncacancagcacgctcgcgagacgtagaagagtagggtcggtacgttagtttaagttattagttactaactaaattaatttaattaattacgttacggttaacggttacggttacggtaccggaaacgggtaaacggtaacggttaggttacgttacgtaacgtaacgtaacgtaacgtacggttacggtcgttcgtaacg

SEQ ID NO: 428940 - DNA, 566 bp, Homo sapiens
  misc_feature: GZ8MTXP01D4Q6I.19.71.G05.1.454.CMB.2.raw
  modified_base (238)..(238): a, c, t, g, unknown or other
  modified_base (247)..(247): a, c, t, g, unknown or other
  modified_base (251)..(251): a, c, t, g, unknown or other
  modified_base (260)..(260): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatctttaanacatacaanatanaaactatanctagacagcagacgacagacagcctactagctgactactagtttacgtgggactacgtaccgtacccgggacgtcccggggtcctacgaccgtattcgagtcggaacgaggtcgggtcgtagggactagtacttcactctacaccatcacgacgacgcgtcgacgacgacgagagtagtagtagggtacgtagtttattagttagtactaactaattaattattattacttcgtggtaacgtacggttacgacggacgtaaggtagttagttattacgtaagacgtaacgtgtgcgtcgcgtaacg

SEQ ID NO: 428941 - DNA, 564 bp, Homo sapiens
  misc_feature: GZ8MTXP01BAO1H.19.71.G05.1.454.CMB.2.raw
  modified_base (227)..(227): a, c, t, g, unknown or other
  modified_base (238)..(238): a, c, t, g, unknown or other
  modified_base (247)..(247): a, c, t, g, unknown or other
  modified_base (251)..(251): a, c, t, g, unknown or other
  modified_base (307)..(307): a, c, t, g, unknown or other
  modified_base (367)..(367): a, c, t, g, unknown or other
  modified_base (403)..(403): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccanaatcttttaanacatacaanatanaaactatagctagacagcagacgacagacacgcctcgtagctgctactatttacgnggacacgttccgtaaccgggacgtcccggggtccccctaggtaccgtatcgaggtcggcnggcgggtcgtagggactagtacttcactctacacancagcacgctgcgaggctagaagtagtgggtaggtacgttagtttattattgtactaaataaattattattacttacgttcggtggtacggttcggacgttaacgggaaccgtaaggttgttattacgtaacgagaacgtacgtggttacgtcgttgtaacc

SEQ ID NO: 428942 - DNA, 633 bp, Homo sapiens
  misc_feature: GZ8MTXP01B2SDU.19.71.G05.1.454.CMB.2.raw
  modified_base (216)..(216): a, c, t, g, unknown or other
  modified_base (228)..(228): a, c, t, g, unknown or other
  modified_base (235)..(235): a, c, t, g, unknown or other
  modified_base (242)..(242): a, c, t, g, unknown or other
  modified_base (244)..(244): a, c, t, g, unknown or other
  modified_base (246)..(246): a, c, t, g, unknown or other
  modified_base (251)..(251): a, c, t, g, unknown or other
  modified_base (254)..(254): a, c, t, g, unknown or other
  modified_base (261)..(261): a, c, t, g, unknown or other
  modified_base (263)..(263): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggggcacggatacgacngataagcagcanatcttanacatcanananaactntantagacananagagacagacacgcctctacgctcgctactattacgtcggcgtactaccgtaccggtacggtccggtccccgtacgtacgtacgtcgtaggtacggacgcggcgggtcgtcggacgtagtacttactactactacactactacacgacgacgccgtcgacgacggtacgtagtaagtagtacggggtacggtacgttaagtttaagtttagttacgtaacgtaaacttaaatttaaatttaatttaacgttacgttacggttaacggttacggttacggtaaccggttaaacgggtaaacggtaacggttacggttacgttacgtaacgtaacgtaacggtaacgtacggttacggtaacgttcgtaacg

SEQ ID NO: 428943 - DNA, 515 bp, Homo sapiens
  misc_feature: GZ8MTXP01DQ5EP.19.71.G05.1.454.CMB.2.raw
  modified_base (450)..(450): a, c, t, g, unknown or other
  modified_base (478)..(478): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccctcgcagacccctctcgctcacctgtgccatctccggggacagagtcgctagcgacagtgttgcttggcactgggtcaggcagtccccatcgagaggtctagagtgctggagacagtattcaatgtcaacacgtgaatacaaattatgacaccatctgttgagagttcgactagaacaactacaaacgtaagacgaacaatacgaaagaaacccagttctcccagctaagctgaacctntagttgacgttccgaggacacggggttnttagtaattacgtgtacggagacggccccaagtaacg

SEQ ID NO: 428944 - DNA, 624 bp, Homo sapiens
  misc_feature: GZ8MTXP01ETAQK.19.71.G05.1.454.CMB.2.raw
  modified_base (240)..(240): a, c, t, g, unknown or other
  modified_base (322)..(322): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgaactgacaagtccagccacaattcttttaanactagttaccaaacaatagaaactactagctaggtacagacaagacgaccagacacgcctcgtagctcgctactatttacgngggactacgtaccgtacccgggaacgttccccggggtcctacggaccgtattcgaggtcggacgagggtccgggtcgtaggggactagtactttcacttcctacacctatacacgacgacgacgtcgacgacggacgtagaagtagtagtcggggtacgttagtttattattagtaactaactaaattaattaattattacgttacgtcggtaacggtacggttacggtaaacggttaacgtaacggtaggttagttacgttacgaacgtaacgtaacgtagtggttacgtcgaacgtaacg

SEQ ID NO: 428945 - DNA, 618 bp, Homo sapiens
  misc_feature: GZ8MTXP01AZVNR.19.71.G05.1.454.CMB.2.raw
  modified_base (236)..(236): a, c, t, g, unknown or other
  modified_base (245)..(245): a, c, t, g, unknown or other
  modified_base (255)..(255): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcacgatacgactgacaagtccagcacaatctttanacatacaanatagaaactntagctagacagacagacgacaggacacgtccctacgtaggctgctactacttacgtcggcactacgtaccggtacgtccggtccccgtacgacgtacgtcgtacgtacgcgcggcgggtcgtcggacgagtacttactactctacacactacacgacgacgcgtcgacgacgacgtacgaagtagtagggtacggtacgttagtttaagtttattagtactaaactaaattaattaatttaacttacgttacggttaacggttacggttaccggtaaccggttaaacgggtaaaccggtaacgggttacggttacgttacgtaacgtacgtaacgtaacgtacggttacggtcgttcgtaacg

SEQ ID NO: 428946 - DNA, 559 bp, Homo sapiens
  misc_feature: GZ8MTXP01DQ5QN.19.71.G05.1.454.CMB.2.raw
  modified_base (241)..(241): a, c, t, g, unknown or other
  modified_base (250)..(250): a, c, t, g, unknown or other
  modified_base (254)..(254): a, c, t, g, unknown or other
  modified_base (275)..(275): a, c, t, g, unknown or other
  modified_base (306)..(306): a, c, t, g, unknown or other
  modified_base (351)..(351): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctggggcgagcgggccacgatacgaactgacaagtccagccacaatcttttanacatacaanatanaaactatagctgacagcaganacagacagcctacagctgctactatttacgnggacatccgtaccggatccgggtcccctgacgtatcgagtcggcnggcgggtcgtagggactagtactttcactctacacatacagcacgctgcagctagaagtgtgggtggtattagtttattattgtaacaaataattattaacttattacgttggtaacggtaacgttcggaaccgaaacgggtaacgtaagggttaggttaattacgtaacgaacgtaacgtaacgtacggttacggtcgttcgtaacg

SEQ ID NO: 428947 - DNA, 618 bp, Homo sapiens
  misc_feature: GZ8MTXP01AN88U.19.71.G05.1.454.CMB.2.raw
  modified_base (244)..(244): a, c, t, g, unknown or other
  modified_base (334)..(334): a, c, t, g, unknown or other
  modified_base (398)..(398): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccacgatcgaactgacaagtccagccacaattctttttaanactacttaccaaactaataagaaaacttacttagcttaggtaccagacaagacgaccgaagacacgcctcgtaggctgctctatttacgnggactacgtcccgtaaccgggacgttcccggggtccccctaggtaccgtattcgaggtcggcgngggtccgggtacgtagggactagtacttcactctaccactatacacgcacgcctgcgaggctagaagtgtgggtcggtattagtttatatgtaactaaactaattattaattacttacgttggtaacggtacgttacgggaacgaacgggtaaccgtaagggttacgttattacgtaacgtaacggtaacggtaacgttgggttacggtcgttcgtaacc

SEQ ID NO: 428948 - DNA, 504 bp, Homo sapiens
  misc_feature: GZ8MTXP01DS9LY.19.71.G05.1.454.CMB.2.raw
  modified_base (236)..(236): a, c, t, g, unknown or other
  modified_base (359)..(359): a, c, t, g, unknown or other
  modified_base (374)..(374): a, c, t, g, unknown or other
  modified_base (411)..(411): a, c, t, g, unknown or other
  modified_base (428)..(428): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatctttanacagttaccaacaatagaaaactactagcttggaccagcagagaccaggacagcctctaggctgctctatttacgtggacatcctacccggggaatcccggggtcccctgacgattcagtgcnggcgggtctgggacngtattcactctcacatcagcagctgcaggctagaagntggtggactagtttatntgtacaaatattatatatctcgtgacgttcggacaaaggaccgaaggttggattatcagaacgaactgcggtgcgc

SEQ ID NO: 428949 - DNA, 664 bp, Homo sapiens
  misc_feature: GZ8MTXP01BUX4J.19.71.G05.1.454.CMB.2.raw
  modified_base (229)..(229): a, c, t, g, unknown or other
  modified_base (238)..(238): a, c, t, g, unknown or other
  modified_base (247)..(247): a, c, t, g, unknown or other
  modified_base (251)..(251): a, c, t, g, unknown or other
  modified_base (257)..(257): a, c, t, g, unknown or other
  modified_base (260)..(260): a, c, t, g, unknown or other
  modified_base (307)..(307): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgacaagccagccanaatctttanacatacaanatanaaactntanctagacagcagacacagacacgcctacgagctgctactagtttacgnggactacgtaccggtaacccgggtacgtccccggggtcccctaggaccgtattcgaggtcggacgtaagggtccgggtacgtacgggactaggttactttccgaccttctaccaacctagtacgacgacgacgtaccgtacgacgacggtacgtacgtaacgtagtacggggtacggtacgttaacgtttaagtttaacgtttacgttaacgtaaacttaaacttaaatttaatttaacgttaacgttacggttaacggttaccggttaccggtaaccggttaaacggtaacggtaacggttacggttacgttacgtaacgtacgtaacgtacgtacggttacggtcgttcgtaacg

SEQ ID NO: 428950 - DNA, 659 bp, Homo sapiens
  misc_feature: GZ8MTXP01B1XEE.19.71.G05.1.454.CMB.2.raw
  modified_base (240)..(240): a, c, t, g, unknown or other
  modified_base (251)..(251): a, c, t, g, unknown or other
  modified_base (327)..(327): a, c, t, g, unknown or other
  modified_base (405)..(405): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggggcctacgatacgactgactaagtccagccacaatcttttaanacattaccaanaatagtaaattactagcttagacagacagacgaccgaggacacgtcctacgtaggctgtcttacgtagtttaccgngggacctacgttacccggtaacccggggtacgttccccgggggtaccccctacggaccgtattccgaggtcgggaccnggggtccgggtacgtaggggactagttactttcgacttcctacaacctatacgacgacgacgtaccgtcgacgacggacgtagaagtagtgggtacggtacgttagtttagtttagttacgtaactaaactaaattaacttaattaacgttacgttcggttaacggtacggttacgggtacggttaacgggtaacggtaacggttaggttagttacgtaacgtacgtaacgtacgtaggttacgtcgttcgtcg

SEQ ID NO: 428951 - DNA, 569 bp, Homo sapiens
  misc_feature: GZ8MTXP01D8680.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccatcgtccggggacagagtcgctagcgacagtgttgcttggcacgtggtcaggcacgtccccatccggagaggtctaggagtggcgtaggggaaggactagttatttcaattcgtcccaaagtaccggtaggaaataacgtaaattatagacacctatctgttgagtagtcgatgaacaatacaaacgtacgaacgactaagtacgaaacgaacctacgttcctaccctagccagctcgacctctcgttcgaccgttcccggaaggacgttacgggttgttaacttaagttacgtggtacggaacggaccggaaccccttaagtaacg

SEQ ID NO: 428952 - DNA, 521 bp, Homo sapiens
  misc_feature: GZ8MTXP01ER3QD.19.71.G05.1.454.CMB.2.raw
  modified_base (232)..(232): a, c, t, g, unknown or other
  modified_base (244)..(244): a, c, t, g, unknown or other
  modified_base (309)..(309): a, c, t, g, unknown or other
  modified_base (495)..(495): a, c, t, g, unknown or other
  modified_base (515)..(515): a, c, t, g, unknown or other
tcagtactctcgtgcacgaccggtgctcgatttagtgtcgtcgcaagagagagggggacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaaanaatagaaactactagctaggtaccagcaagagaccaggacagcctcctaggctgctctatttacngggcatcgtacccgggatcccggggtcctgaccgtattcgagtggacaggcgggtctggggacaggtatttcactctcacatcagcagcctgcaggctagaagatgaggggtctaggtttattattgtacaataattattattatacttcgtggtaacgttcggacgaaggaccgaaggtgagttnttcaagagtaacgtgtcggntcgcgc

SEQ ID NO: 428953 - DNA, 657 bp, Homo sapiens
  misc_feature: GZ8MTXP01B71U7.19.71.G05.1.454.CMB.2.raw
  modified_base (242)..(242): a, c, t, g, unknown or other
  modified_base (254)..(254): a, c, t, g, unknown or other
  modified_base (327)..(327): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggggccacgatacgaactgacaagtccagccacaatcttttaanacagttaccaanaatagaaaactactagcttaggaccagacaagacgaccgaggacacgcctacgtaggctgctactatttacgnggctacgtaccgtaacccggggtacgtccccggggtaccccctacggaccgtattaccgaggtcgggaccgtaagggtccggggtacgtaggggaactaggtactttaccaccttctaccaccatcgacgcacgcctagcgacggtctaggaagtagttggggtcggtacttaagtttattagttacgtaactaaattaatttaatttaagttaacttacgttcgggtaacgggtaacggtttaccgggaaccggttaaacggggtaaccgtaagggttacgttattacgtaacgaaggtaaccgtaacgtgggttacgtcgttcgaacc

SEQ ID NO: 428954 - DNA, 515 bp, Homo sapiens
  misc_feature: GZ8MTXP01CJT75.19.71.G05.1.454.CMB.2.raw
  modified_base (238)..(238): a, c, t, g, unknown or other
  modified_base (312)..(312): a, c, t, g, unknown or other
  modified_base (353)..(353): a, c, t, g, unknown or other
  modified_base (367)..(367): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggggccacatcgaactgcaagtccagccacaatcttttanacagttccaacaatgaaaactacttagcttggtaccagcagagaccaggacagcctctaggctgctcatttacngggcatctaccgggatccgggtcccctgacgattcagtgcngcgggtctgggacngattcactctcaccatcagcagcctgcaggctgaagatggtggctagtttatattgtactaaactaattattattattacttcgtggacgtttcggaccaaggggtaccaagggttggattatcgagaaccgaatgttggcttgaacc

SEQ ID NO: 428955 - DNA, 594 bp, Homo sapiens
  misc_feature: GZ8MTXP01EIWGQ.19.71.G05.1.454.CMB.2.raw
  modified_base (245)..(245): a, c, t, g, unknown or other
  modified_base (320)..(320): a, c, t, g, unknown or other
  modified_base (368)..(368): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccgatacgaactgacaagtccagccacaattcttttanacagttccaaacaatagaaaactactagctggtaccagcagagaccaggacagcctctaggctgctcatttacgnggacacgtaccgaccggtacgtcccccgggtcctgaccgtatcgaagngcgacggtcgggtcgtagggacgtagtactttccacttctacactactacgacgacgacgtcgtcgacgacgacgtagaagtacggtggtaggtacgttaagtttattagttacgtaactaaattaattaatttaacttacttacgttcggtacggttacgttacggacgtaaacgggtaacgttaaggttagttactaagtagaacggtacgagttggtcgcgtg

SEQ ID NO: 428956 - DNA, 573 bp, Homo sapiens
  misc_feature: GZ8MTXP01D8YTJ.19.71.G05.1.454.CMB.2.raw
  modified_base (242)..(242): a, c, t, g, unknown or other
  modified_base (321)..(321): a, c, t, g, unknown or other
  modified_base (358)..(358): a, c, t, g, unknown or other
  modified_base (382)..(382): a, c, t, g, unknown or other
  modified_base (453)..(453): a, c, t, g, unknown or other
  modified_base (475)..(475): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagcggccaccatcaactgacaagtccagccactaattctttanacagttaccaaacaatagaaaactactagcttaggaccagcagacgaccagacagcctcctaggctgctctatttacgnggacagttccgtaacccggggatccccggggtccccnggaccgtattccgaggtcggaccngggtccgggtcgtaggggactagtactttcgaccttctacaaccatcagcagccctgcaggctagaaagtntggggtggacttagtttatatntactaaataattattattatacgttgtaaggtacgttccggacgaaagggacctaaggttggttattagtcaagaacgtaagtgttaggccttgaacc

SEQ ID NO: 428957 - DNA, 518 bp, Homo sapiens
  misc_feature: GZ8MTXP01EJGBD.19.71.G05.1.454.CMB.2.raw
  modified_base (237)..(237): a, c, t, g, unknown or other
  modified_base (279)..(279): a, c, t, g, unknown or other
  modified_base (309)..(309): a, c, t, g, unknown or other
  modified_base (412)..(412): a, c, t, g, unknown or other
  modified_base (433)..(433): a, c, t, g, unknown or other
  modified_base (514)..(514): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaaacaatgaaaactctagcttggtaccagcaganaccaggacagcctctagctgctcatttacngggcatcgtacccgggatcccccggggtcctgaccgattcaagtgcagcgggtctgggactagatttcactctcacatccagcagcctgcagggctagaaagngtgtggctaggtttatagttntacaaatatattacgttatacttgtgacgttcgaccgtaaagggaccaaagggttgaataagtacaagtagacgttagtgngtcg

SEQ ID NO: 428958 - DNA, 523 bp, Homo sapiens
  misc_feature: GZ8MTXP01BU4NR.19.71.G05.1.454.CMB.2.raw
  modified_base (239)..(239): a, c, t, g, unknown or other
  modified_base (316)..(316): a, c, t, g, unknown or other
  modified_base (356)..(356): a, c, t, g, unknown or other
  modified_base (512)..(512): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgacaagtccagccacaattcttttanacagttaccaacaatagaaaactacttagcttggtaccagcagagaccaggacagcctcctaggctgctcatttacnggcatctaccggatccggggtcccctgacgatcagtggcngcgggtctgggacagtattcactctcacatcagcagcctgcagctagaagagtggggtggtctagtttattagttgtactaataattattattattaacttgtaaggtacgttcggacgaacgggaccgtaaggttgattatcagaacgaacgtgnggtcttgaacc

SEQ ID NO: 428959 - DNA, 620 bp, Homo sapiens
  misc_feature: GZ8MTXP01BXAJ5.19.71.G05.1.454.CMB.2.raw
  modified_base (240)..(240): a, c, t, g, unknown or other
  modified_base (249)..(249): a, c, t, g, unknown or other
  modified_base (253)..(253): a, c, t, g, unknown or other
  modified_base (259)..(259): a, c, t, g, unknown or other
  modified_base (262)..(262): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactcctggctgtgtctcgtgggcgagcgggccacgatacgaactgacaagtccagccacaatctttanacatacaanatanaaactntanctagacagacagacgacagacacgcctcgtagctgctactatttacgcggactacgtaccgtaaccggacgtcccggggtccctacggacgtatcgaggtcggacgtcgggtcgggtcgtacgggactagtactttcacctctaccaacctactacgacgacgacgtccgtcgacgacgtacgtagaagtagtacgggtacggtacgttagtttagttagttacgtaactaaactaaattaattaattaacttacgttacgttaacggtacggttacggtaccggttaacggtaacggtaaggttaggttacgttacgtaacgtacgtaacgtacgtacggttacgtcgttcgtaacg

SEQ ID NO: 428960 - DNA, 591 bp, Homo sapiens
  misc_feature: GZ8MTXP01EBW6I.19.71.G05.1.454.CMB.2.raw
  modified_base (236)..(236): a, c, t, g, unknown or other
  modified_base (247)..(247): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatcttttanacattaccaanaatagaaactactagcttaggacagacagacgaccagacacgcctctaggctgctactatttacgtggctacgtccgtacccggggacgtcccggggtccccctacggaccgtagttccgaggtcgggacgtgggtccgggtacgtaggggactagtactttcaccttcctaccaccatcagcacgtcctgcgaggctaggaagtgttggggtcggtacttaagtttattattagtactaaactaaattattaattacttacgttcggtaaggtacgttacggaccgaaagggaccgtaagggttagattacgtaacagaacgacgtagttacgtcgttcgtcg

SEQ ID NO: 428961 - DNA, 608 bp, Homo sapiens
  misc_feature: GZ8MTXP01COEHU.19.71.G05.1.454.CMB.2.raw
  modified_base (239)..(239): a, c, t, g, unknown or other
  modified_base (248)..(248): a, c, t, g, unknown or other
  modified_base (252)..(252): a, c, t, g, unknown or other
  modified_base (261)..(261): a, c, t, g, unknown or other
  modified_base (274)..(274): a, c, t, g, unknown or other
  modified_base (306)..(306): a, c, t, g, unknown or other
  modified_base (370)..(370): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggggccacgatcgaactgacaagtccagccacaatctttanacatacaanatanaaactatanctagacagcaganacagacagcctactagctgctactatttacgnggctacgtccgtaacccggggtacgtcccggggtccccctaggaccgtagttcgaggtcggacnggcgggtacgtagggactagtactttcacttctacaccatacacgcacgcctgacgaggctagaagtagtgggtaggtacttagtttatttagttagtaactaaactaaattaatttaacgttaacttacgttacggtaacgggtaccggtttaccgggaaccggaaagggtaaccgtaagggttacggttaattacgtaacgaaggtaacgtaacgtgggttacgtcgttcgtaacg

SEQ ID NO: 428962 - DNA, 518 bp, Homo sapiens
  misc_feature: GZ8MTXP01C2ORU.19.71.G05.1.454.CMB.2.raw
  modified_base (222)..(222): a, c, t, g, unknown or other
  modified_base (408)..(408): a, c, t, g, unknown or other
  modified_base (431)..(431): a, c, t, g, unknown or other
  modified_base (451)..(451): a, c, t, g, unknown or other
  modified_base (469)..(469): a, c, t, g, unknown or other
  modified_base (480)..(480): a, c, t, g, unknown or other
  modified_base (488)..(488): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctntcgctcacctgtgcccatctccggggacagagtcgctagcgacagtgttgcttggcactgggtcaggcagtccccatcgagaggtctagagtggctaggggaacggacatatttcatcgtaccaacgacgtggaaatacaaattatgcaccatctgttagagagtcgactgaacaatacaacgtanacacactcgaaagaccagttccnccctgacagctgacccttcngtcgactcccgagggacncggggttattnttacgttntggtgaacggcggacccctaagttaagaac

SEQ ID NO: 428963 - DNA, 523 bp, Homo sapiens
  misc_feature: GZ8MTXP01AYAQ5.19.71.G05.1.454.CMB.2.raw
  modified_base (238)..(238): a, c, t, g, unknown or other
  modified_base (313)..(313): a, c, t, g, unknown or other
  modified_base (355)..(355): a, c, t, g, unknown or other
  modified_base (369)..(369): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagagaccaggacagcctctaggctgctcatttacnggcatctacccgggatccggggtcccctgacgattcagtgcngcgggtctgggacngtattcactctcaccatcagcagcctgcaggctgaagatggtggctagtttattattgtacaataaattattaattatactttcgtggtacgtttcggaccgttaaagggaccctaagggttggattagtcagaacgaactgttagcttgaacc

SEQ ID NO: 428964 - DNA, 512 bp, Homo sapiens
  misc_feature: GZ8MTXP01DKUY6.19.71.G05.1.454.CMB.2.raw
  modified_base (237)..(237): a, c, t, g, unknown or other
  modified_base (315)..(315): a, c, t, g, unknown or other
  modified_base (342)..(342): a, c, t, g, unknown or other
  modified_base (355)..(355): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttaccaaacaatagaaaactacttagcttggtaccagcagagaccaggacagcctcctaggctgctcatttacnggcatctaccgggatccggggtccccngacgatcagtgcngcgggtctgggacagatttcactctcaccatcagcagcctgcaggctgaagatgggtggctagtttattattgtcaaataatattattatacttgtggtacgttggaccaaagggaccaagggttggattatcaagaacgaactgttggcttgaacc

SEQ ID NO: 428965 - DNA, 625 bp, Homo sapiens
  misc_feature: GZ8MTXP01D4QJP.19.71.G05.1.454.CMB.2.raw
  modified_base (239)..(239): a, c, t, g, unknown or other
  modified_base (251)..(251): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccaggggacatcgtgatgacccagtctccagacctccctggctgtgtctctgggcgagccgggccaccatcaactgcaagtccagccacaattcttttaanacattaccaaanaatagaaactactagtctacgacagacaagacgaccagacacgcctcgtagctgctactagtttacgcgggactacgtacccgtaacccgggacgttccccggggtaccctacggaccgtatcgaggtcggactagggtccgggtcgtagggaactagttacttcactcctacacatcacgcacgtcctgacaggctagaagtagtgtaggtacttagtttattacgttagtaactaaattaaatttaatttaacgttaacttacgttacggtaggtaaccgttacggaaccggtaaagggttaaccgtaagggtacgttaagttacgttaccgtaaggaacgtaacgtggtacggttaccgtcgaacctaacg

SEQ ID NO: 428966 - DNA, 583 bp, Homo sapiens
  misc_feature: GZ8MTXP01C2YMZ.19.71.G05.1.454.CMB.2.raw
  modified_base (228)..(228): a, c, t, g, unknown or other
  modified_base (237)..(237): a, c, t, g, unknown or other
  modified_base (246)..(246): a, c, t, g, unknown or other
  modified_base (250)..(250): a, c, t, g, unknown or other
  modified_base (258)..(258): a, c, t, g, unknown or other
  modified_base (266)..(266): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccaggggacatcgtgatgacccagtctccagactccctggctgtgtctctgggcgagcggggcacgatacgactgactaagccagccanaatctttanacatacaanatanaactatanctgtacanacagagacagacacgcctctacgctcgctctacttacgtcggctactacgtaccggtacgtccggtccccgtacgacgtactcgacgtacgcgcggcgggtcgtacgggacgagtacttactactactacactactacacgacgacgcgtcgcgacgacgtagaacgtagtcgggtacggtacgttagtttactttactttaactaactaattaattattattacgttacgttaggtaacggttacggttacgtaacggacgtaacggtagttagttacgttacgtaagtacgtaacgtgtcgttcgtcgcgtaacg

SEQ ID NO: 428967 - DNA, 637 bp, Homo sapiens
  misc_feature: GZ8MTXP01ANSDE.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccatccgtccggggacagagtcgctagcgacagtgtgcttggcacgtggtcaggcacgtccccatcgagaggtctagagtggcgtggggaaggactagtatttcaattcgtcccaaacgacggttagggaaactaactaaattatacgaccacctattacgttaggttagaggtagtaccgtacgtacgaaactaactacgaaacgttaacgaaccgaacaagttaaccggaaacggtaaaccctacgtttaccctcccgttacgaccgtaacggcctacggtaacccttcgttacggttacggaacccgttccccgggtaaacgggaaccgaccgggggttattaacgttaacgttaacgtggtaacgggaacggaccggtaaccccaagtaaccg

SEQ ID NO: 428968 - DNA, 823 bp, Homo sapiens
  misc_feature: GZ8MTXP01ETOY9.19.71.G05.1.454.CMB.2.raw
  modified_base (240)..(240): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcaactgacaagtccagccacaatcttttaanactataccaaataatagaaaactacttagcttacgacagacagacgaccgaggacacgtcctacgtaggctcgactactaagtttacgcgggtactacgttacccggtaacccggggtaacgttccccgggggtaccccctacggtaaccgtagtttaccggaacgggtcgggaccgaacggggtccggggttaccgtacggggaacctaaggttacttttaccgaaccttacctacctaaccgtactaccgaacggtaccgtaaccggtcccgttacggaccggtaacgggtaccgtaacggtaaaggtaacggttacgggggttacgggttaacggtttaaacggttttaaacgttttaacgtttaacgttaaacgttaaaacgttaaaactttaaacgttttaaacgttttaaacgtttaaccgtttaacgggtttaacgggttaaccgggtttaaccgggtaaacccgggttaaaccggggtaaaccgggtaaacgggttaaacgggttaaacgttaacgttaacggtaaacggtaacggtaaacggttacggttacggtaaccggttaacggtaaccg

SEQ ID NO: 428969 - DNA, 702 bp, Homo sapiens
  misc_feature: GZ8MTXP01DDDW2.19.71.G05.1.454.CMB.2.raw
  modified_base (253)..(253): a, c, t, g, unknown or other
  modified_base (352)..(352): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctggggcgaggccggggccacgactacgaacgtcgactaagccagcccaacaattcttttaanactacgttaccaaacaatacgaaaacttacttagcttaggaaccagacagaacgaccgaaggacacgtccctacgtaggctcgtactactagtttacgngggactacgtaccggtaacccgggacgtccccggggtcccctacggtaccgtattcgacggtcgggacgtaacggtcgggtcggtacgggtacgtacgtacttactacctactacaccactacacgacgacgtacgcgacgacgacgtagtaagtagtacggggtacggttacgtttaacgtttaagtttaacgtttacgttaacttaaacttaaattaaatttaatttaacgtttacgttacggttaacggttaacggttacggtaaccggttaaacggtaacggtaacggttaggttagttacgtaacgtaacgtaacgtaacgtacggttacggtcgttcgtaaccg

SEQ ID NO: 428970 - DNA, 556 bp, Homo sapiens
  misc_feature: GZ8MTXP01DPW1U.19.71.G05.1.454.CMB.2.raw
  modified_base (237)..(237): a, c, t, g, unknown or other
  modified_base (312)..(312): a, c, t, g, unknown or other
  modified_base (355)..(355): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactactagcttggtaccagcagagaccaggacagcctcctaggctgctcatttacngggcatctaccggatccggggtcccctgaccgattcagtggcnggcgggtctgggacagatttcactctcaccatcagcagcctgcaggctagaagatgggtggctaagtttatattgtacaaataattattaattattacttcgtaaggtacgttcggacccgttaaaggggaaccgtaagggttagggaattaacgtaacgtaaaggaaccgtaaacgtgggttacgggtccttggaacccg

SEQ ID NO: 428971 - DNA, 562 bp, Homo sapiens
  misc_feature: GZ8MTXP01A7F8P.19.71.G05.1.454.CMB.2.raw
  modified_base (237)..(237): a, c, t, g, unknown or other
  modified_base (316)..(316): a, c, t, g, unknown or other
  modified_base (366)..(366): a, c, t, g, unknown or other
  modified_base (426)..(426): a, c, t, g, unknown or other
  modified_base (529)..(529): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaaacaatagaaaactacttagcttggtaccagcagagaccaggacagccctcctaggctgctctatttacngggcatcgtacccggggatccggggtccccctgaccgattcagtcgggcnggcgggtctggggacagtactttcactctcaccatcagcagcctgcaggctaggaaagtntggggtaggcttaaggtttattagttgtactaaactaattaatttattaacttacttcgggtaaggtacggttcggaaccgttaaacggggaccaagggttgnttactcgagtaacgaactggttcggcttgaacc

SEQ ID NO: 428972 - DNA, 553 bp, Homo sapiens
  misc_feature: GZ8MTXP01A8L9H.19.71.G05.1.454.CMB.2.raw
  modified_base (237)..(237): a, c, t, g, unknown or other
  modified_base (425)..(425): a, c, t, g, unknown or other
  modified_base (525)..(525): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccaggggacatcgtgatgacccagtctccagactccctggctgtgtctctgggcgagcgggccacatcaactgacaagtccagccacaattcttttanacagttaccaaacaatagaaaactacttagcttaggtaccagcagagaccggacagcctctaggctgctctatttactgggctagtccgtacccgggaatcccgggggtccctgaccgattcgagtggacaggcgggtctgggacagtatttcgactctcaccatcagcagccctgcaggcagaaagngtgtcggggactaagttttatagttacgtacaaataaagttattaacttattacgttcgtggtaacgttcggacgaaacggaccgaaggtggattacganaacgacgaacgtggcgttctcgcgtaac

SEQ ID NO: 428973 - DNA, 685 bp, Homo sapiens
  misc_feature: GZ8MTXP01C8O71.19.71.G05.1.454.CMB.2.raw
  modified_base (243)..(243): a, c, t, g, unknown or other
  modified_base (253)..(253): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatacgaactgacaagtccagccacaattctttaanactatacaanaatagaaactatagctagacagacagacgacgagacacgcctacgtagctcgtacttactacgtttacgcggactacgtaccggtaacccggggtaacgttccccggggtaccccctaggaccgtattacgaggtcgggacgcgggtccgggtacgtacggggactaggtactttaccaccttcctaccgaacctatcgacgacgacgtaccgtacgacgacgacgtaagtaagtagtaggggttacggttacgtttaagttttaacgtttaacgtttaacgttaactaaacttaaatttaaatttaatttaacgtttacgtttacggttaacggttaacggttaccggtaaccggttaaacggtaaacggtaacggttaggttacgttacgtaacgtaacgtaacgtaacgtagttacgtcgttcgtaacg

SEQ ID NO: 428974 - DNA, 587 bp, Homo sapiens
  misc_feature: GZ8MTXP01D1GNV.19.71.G05.1.454.CMB.2.raw
  modified_base (227)..(227): a, c, t, g, unknown or other
  modified_base (235)..(235): a, c, t, g, unknown or other
  modified_base (244)..(244): a, c, t, g, unknown or other
  modified_base (246)..(246): a, c, t, g, unknown or other
  modified_base (248)..(248): a, c, t, g, unknown or other
  modified_base (257)..(257): a, c, t, g, unknown or other
  modified_base (268)..(268): a, c, t, g, unknown or other
  modified_base (298)..(298): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagacctccctggctgtgtctctggggcgagcgggccacgatacgactgacaagtccagcanatctttanacatacaanananaaactatantgacagcaganacagacagcctcgagctgctctatttacgnggctagtccgtaccgggacgtcccgggtccccagacgtattcgaggtcggacgcgggtcgggtacgtacgggaactagtactttcactctacacctatcacgacgacgccgtcgacgacgacgtagaagtagtagggtaggtagttagtttaattagttagtaactaaactaaattaattaatttattacgttacggttaacggtacggttacggtaccggaacgggtaacggtaaggttaggttagttagtaacgacgtaacgtacgtaggttacgtcgttcgtaacg

SEQ ID NO: 428975 - DNA, 580 bp, Homo sapiens
  misc_feature: GZ8MTXP01ED683.19.71.G05.1.454.CMB.2.raw
  modified_base (230)..(230): a, c, t, g, unknown or other
  modified_base (240)..(240): a, c, t, g, unknown or other
  modified_base (251)..(251): a, c, t, g, unknown or other
  modified_base (322)..(322): a, c, t, g, unknown or other
  modified_base (380)..(380): a, c, t, g, unknown or other
  modified_base (415)..(416): a, c, t, g, unknown or other
  modified_base (451)..(451): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagccgggccaccatcaactgcaagtccagccanaattctttanacattaccaanaatagaaactactagcttaggaccagacagacgaccgaggacacgccctcgtaggctgctactatttacgnggcacgtccgacccggtacgtcccggggtccccctaggaccgtattcgaggtcggcgngggtcgggtctagggactagtacttcactctcacnncagcacgcctgcgaggctagaagtgtgggtacgtnttagtttattatgtactaaataatttattattattacgttcggtaacggtacgttccggaccgttaaacgggaacgtaagggttagttattacgtaacgagtaacgtaacgtggttacgtcgttcgaac

SEQ ID NO: 428976 - DNA, 524 bp, Homo sapiens
  misc_feature: GZ8MTXP01EHYT1.19.71.G05.1.454.CMB.2.raw
  modified_base (238)..(238): a, c, t, g, unknown or other
  modified_base (359)..(359): a, c, t, g, unknown or other
  modified_base (414)..(414): a, c, t, g, unknown or other
  modified_base (423)..(423): a, c, t, g, unknown or other
  modified_base (437)..(437): a, c, t, g, unknown or other
  modified_base (522)..(522): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctctaggctgctcatttactgggcatctacccgggaatccggggtccccctgaccgattcagtggcnggcgggtctgggacagtatttcactctcaccatcagcagcctgcaggctgaaagntgggtggtntagtttattagttnacaataaattattaattattacttcgtggtacgtttcggaccaaagggaccaaaggttggattatcagaaccgtaatgttggtcngc

SEQ ID NO: 428977 - DNA, 636 bp, Homo sapiens
  misc_feature: GZ8MTXP01BIVB2.19.71.G05.1.454.CMB.2.raw
  modified_base (239)..(239): a, c, t, g, unknown or other
  modified_base (253)..(253): a, c, t, g, unknown or other
  modified_base (321)..(321): a, c, t, g, unknown or other
  modified_base (354)..(354): a, c, t, g, unknown or other
  modified_base (361)..(361): a, c, t, g, unknown or other
  modified_base (374)..(374): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgctaagtccagccacaattcttttaanactacgttaccaanaatagaaaactactagcttagtaccagcagacgaccagacacgcctacgtagctgctactatttacgnggacagtccgtaccggacgtcccggggtccccnggacgtntcgaggtcggcgnggtccgggtcgtaggggactagtactttccactcctacacctatcacgcacgtcctagcgaggctagagtagtggggtcggtattagtttattagttacgtaactaaattaatttactttaatttaacgttaccgtttcgggtaacgggttacccgggtttaccgggaaccggttaaacgggtaacccggtaagggttacggttaacttacgtaaccggaacggtaaccgtaacggttcggttacggtaacgttccgaaccg

SEQ ID NO: 428978 - DNA, 533 bp, Homo sapiens
  misc_feature: GZ8MTXP01DNNPK.19.71.G05.1.454.CMB.2.raw
  modified_base (227)..(227): a, c, t, g, unknown or other
  modified_base (237)..(237): a, c, t, g, unknown or other
  modified_base (311)..(311): a, c, t, g, unknown or other
  modified_base (501)..(501): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccgacggggacatcgtgatgacccagtctccagactccctggctgtgtctcgtgggcgagcgggccaccatcaactgcaagtccagccanaatcttttanacagttccaaacaatagaaaactactagctggtaccagcagagaccaggacagcctctaggctgctcatttacngggcatcgtacccgggaatccggggtcctcgaccgattcagtgcagcgggtctgggacagatttcactctacaacatcagcagcctgcaggctagaagatggtggggctaagtttattattgtacaaataattaattattaatacttcgtggtaacgttcggaccgtaaagggacctaagggtggaattnttacgaagaacgtaactggtggctgctaaccg

SEQ ID NO: 428979 - DNA, 508 bp, Homo sapiens
  misc_feature: GZ8MTXP01BZZZ6.19.71.G05.1.454.CMB.2.raw
  modified_base (402)..(402): a, c, t, g, unknown or other
  modified_base (478)..(478): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctggggaaggacagtatttcatgtccaaacacgtggaactacaaattatgcaaccatctgttgagagtcgactgacatcaacgtagacacatacgaagaccagttccncctgcagcgtcgacctctgtcgaccgtcccgaggacgacgggtgtatattactggtaggagcggccccatacgacnttcgccacctcgtctcgttggtcgcgtaag

SEQ ID NO: 428980 - DNA, 530 bp, Homo sapiens
  misc_feature: GZ8MTXP01BG6WW.19.71.G05.1.454.CMB.2.raw
  modified_base (229)..(229): a, c, t, g, unknown or other
  modified_base (239)..(239): a, c, t, g, unknown or other
  modified_base (315)..(315): a, c, t, g, unknown or other
  modified_base (365)..(365): a, c, t, g, unknown or other
  modified_base (422)..(422): a, c, t, g, unknown or other
  modified_base (428)..(428): a, c, t, g, unknown or other
tcagtactctcgtgcacgaccggtgctcgatttagtgtcgtcgcaagagagaggggggaggtacaacaggcaggcaggggcagcaagatggtgttgcagaccccaggtcttcatttctctgttgctctggatctctggtgcccacggggacatcgtgatgacccagtctccagactccctggctgtgtctctgggcgagcgggccaccatcaactgcaagtccagccanaatcttttanacagttccaaacaatgaaaactacttagcttggtaccagcagagaccaggacagcctcctaggctgctcatttacngggcatccgtacccgggaatcccggggtccccctgaccgattcagtggcnggcgggtctgggacagtatttcactctcaccatccagcagcctgccaggctagaagngtgggngtctagtttatagtgtacaataattattaattatacgttggtggtacgttcggacgaaggacgtaaggttgattataacgagtaacgagtgttcgtcttcgc

SEQ ID NO: 428981 - DNA, 644 bp, Homo sapiens
  misc_feature: GZ8MTXP01AGNAY.19.71.G05.1.454.CMB.2.raw
  modified_base (228)..(228): a, c, t, g, unknown or other
  modified_base (238)..(238): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatcttttanacagttccaaacaatagaaaactacttagcttggaccagcagagaccagacagcctctaggctgctctatttacgtgggactacgttccgtaacccggggaacgttccccgggggtcccccctaggaccgtatttccgaggttcgggaccgtaagggtccggggtccgtagggggaacctaggttactttcccaacttcctaccaacccatccgaagcacgccctgccagggctaggaagtagtggggtgtacgttaagtttaattagttcgtaactaaataaattatttaattaacttacgtttcggtaacggtacggtttaccggacgttaaacggggaccgtaaaggggttggttaattaccgtaagaagaaccggtaaacgttggacggtcttaaggtcccc

SEQ ID NO: 428982 - DNA, 516 bp, Homo sapiens
  misc_feature: GZ8MTXP01DVW45.19.71.G05.1.454.CMB.2.raw
  modified_base (237)..(237): a, c, t, g, unknown or other
  modified_base (353)..(353): a, c, t, g, unknown or other
  modified_base (406)..(406): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatcttttanacagttccaaacaatgaaaactacttagcttggtaccagcagagaccaggacagcctctaggctgctcatttactggcatctaccggatccggggtcccctgacgattcagtggcngcgggtctgggacagatttcactctcaccatcagcagcctgcaggctgaaagntggtgtctagtttatatgtacaataatattattatacttcgtaagtacgttcggaccaagggtaccgtaagggttggattagtcgaagccgaaatggttggtcttgaacc

SEQ ID NO: 428983 - DNA, 573 bp, Homo sapiens
  misc_feature: GZ8MTXP01BRSXF.19.71.G05.1.454.CMB.2.raw
  modified_base (237)..(237): a, c, t, g, unknown or other
  modified_base (247)..(247): a, c, t, g, unknown or other
  modified_base (305)..(305): a, c, t, g, unknown or other
  modified_base (389)..(389): a, c, t, g, unknown or other
  modified_base (405)..(405): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgacaagtccagccacatctttanacattccaanaatgaaaactctagcttggaccagcagagaccaggacagcctctagctgctatattgngactacgtaccgacggacgtccccggtcacgacgtctgaagtcgcgcggtcggtcgtggactacgttactccacttcaccaacnctacgacgacacgtcncgacgagtacgtaagagtgggtcggtagtatttagtttatgtactaaactaaattattattacgttacgtcggttcggtacggttaccggtacggaacggtaaacggtaacggttaggttacttacgtaacgaacggtaacgtacgtagttcggtaacgttcgtaacg

SEQ ID NO: 428984 - DNA, 522 bp, Homo sapiens
  misc_feature: GZ8MTXP01DKSH6.19.71.G05.1.454.CMB.2.raw
  modified_base (237)..(237): a, c, t, g, unknown or other
  modified_base (314)..(314): a, c, t, g, unknown or other
  modified_base (354)..(354): a, c, t, g, unknown or other
  modified_base (407)..(407): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatcttttanacagttaccaaacaatagaaaactacttagcttggtaccagcagagaccaggacagcctctaggctgctcatttacnggcatctaccggatccggggtcccctgacgattcagtgcnggcgggtctgggacagatttcactctcacatcagcagcctgcaggctgaaagntgggtggtctagtttattattgtacaataaattattaattatacttcgtggtaacgttcggaccgaagggtaccaaggttggattagtcaagaaccgtaagtgttggcttgaacc

SEQ ID NO: 428985 - DNA, 573 bp, Homo sapiens
  misc_feature: GZ8MTXP01E3FJW.19.71.G05.1.454.CMB.2.raw
  modified_base (232)..(232): a, c, t, g, unknown or other
  modified_base (307)..(307): a, c, t, g, unknown or other
  modified_base (339)..(339): a, c, t, g, unknown or other
  modified_base (377)..(377): a, c, t, g, unknown or other
tcagtactctcgtgcacgaccggtgctcgatttagtgtcgtcgcaagagagagggggtacaacaggcaggcagggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaaacaatgaaaactacttagctggtaccagcagagaccaggacagcctctaggctgctcatttacgnggcatcgtaccggagtccgggtcctcgaccgntcgagtggacaggcgggtcgtgggacagtattcactcncacatcagcacgcctgcgacggctagaagtagtggtaggggtacttaagtttattagttacgtaactaaactaaattaattaattaacttacgttcggtacgggtaacgttacggaccgtaaagggaaccgtaaagggtaggttaacgttacgttacgaagaacgtaacgtggtacggttacgtcgaacctaaccg

SEQ ID NO: 428986 - DNA, 539 bp, Homo sapiens
  misc_feature: GZ8MTXP01CYJCZ.19.71.G05.1.454.CMB.2.raw
  modified_base (239)..(239): a, c, t, g, unknown or other
  modified_base (317)..(317): a, c, t, g, unknown or other
  modified_base (362)..(362): a, c, t, g, unknown or other
  modified_base (444)..(444): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccaacaattcttttanacagttaccaaacaatgaaaactacttaagcttaggtaccagacagagaccagacagcctctagctgctcatttacgnggcatcgtacccggatcccggggtcccctgaccgattcagtggcnggcgggtctggggacagtactttcactctcacatcagcagcctgcaggctagaaagtgtaggtggtcttagtttattagttntacaataaattattaattatacttcgtggtaacgttcggtaccaagggtaaccaagggttaggattagtcaagaacgaagtgttaggcttgaacc

SEQ ID NO: 428987 - DNA, 577 bp, Homo sapiens
  misc_feature: GZ8MTXP01AYVSF.19.71.G05.1.454.CMB.2.raw
  modified_base (213)..(213): a, c, t, g, unknown or other
  modified_base (227)..(227): a, c, t, g, unknown or other
  modified_base (236)..(236): a, c, t, g, unknown or other
  modified_base (245)..(245): a, c, t, g, unknown or other
  modified_base (304)..(304): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatacgactnacaagtccagccanaatctttanacatacaanatagtaaatctagctagacagacagacacagacacgcctcgagctgctactatttacgnggactacgtaccgtaccggacgtcccgggtacccctacggacgtatcgagtcggacgcggtcgggtacgacgggactagttacttcactctaccactactcacgcgacgcgtcgacgacgacgtagaagtagtagggtcgtacgttagttagttattagtactaactaattattattacttacgttcgtaacgtacgttacggtacgaacggtacgtaaggttagttagttacgtaacgtacgtaacgtacgtacgttacgtcgttcgtaacg

SEQ ID NO: 428988 - DNA, 542 bp, Homo sapiens
  misc_feature: GZ8MTXP01AWWDU.19.71.G05.1.454.CMB.2.raw
  modified_base (337)..(337): a, c, t, g, unknown or other
  modified_base (348)..(348): a, c, t, g, unknown or other
  modified_base (496)..(496): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccatcgtccggggacagagtcgctagcgacagtgttgcttggcacgtggtcaggcagtccccatcgagaggtctagagtggctgggaaggactatattnaatcgtccaanacgtaggaatacaaattatgacaacatctgttgagtagtacgactagaacaatacaaacgtagaacacaagtacgaaacgaacctagttcctcccgtagcacgctcgacctcgtgttcgaccgttccggaaggtacgttacggggttnttaactaagttacgtggtacgggacgacggtaaccccgaagtaacg

SEQ ID NO: 428989 - DNA, 581 bp, Homo sapiens
  misc_feature: GZ8MTXP01BHVHV.19.71.G05.1.454.CMB.2.raw
  modified_base (240)..(240): a, c, t, g, unknown or other
  modified_base (322)..(322): a, c, t, g, unknown or other
  modified_base (371)..(371): a, c, t, g, unknown or other
  modified_base (398)..(398): a, c, t, g, unknown or other
  modified_base (427)..(427): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgcaagtccagccacaatcttttanacagttaccaaacaatagaaaaactacttagcttaggtaccagacagagaccaggacacgcctctaggctgctcatttacgnggcatcctaaccggggatccggggtccccctgaccgattcgagtcggcnggcgggtctggggacagtattcactcncaccatcagcagcctgcaggctgaaagtntgggtggacttagtttacttagtagtaccaaatattatttattattacgttcgtaaggtaccgtttcgggaaccgttaaaggggtaaccgtaagggttagggattacgttaaccgaaggtaaccgtaacgtggggttacgtcgttcggtaaccc

SEQ ID NO: 428990 - DNA, 722 bp, Homo sapiens
  misc_feature: GZ8MTXP01D8R6Y.19.71.G05.1.454.CMB.2.raw
  modified_base (239)..(239): a, c, t, g, unknown or other
  modified_base (250)..(250): a, c, t, g, unknown or other
  modified_base (313)..(313): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgcaagtccagccacaatcttttaanacattaccaanaatagaaactctagctagacagcagacgaccagacacgcctcgtaggctgctactatttacgnggactacgttaccgtaacccggggacgttccccgggggtaccccctacggaaccgtagttaccgaggtcgggacgtcggggtccggggttacgtacggggaacctaaggttactttaccgaccttccctaccaacctacgtaccgaacgaccgtaacgtccgtaggaccgaacgggtaccgtaaggtaaagtaggttacgggggttacggtaacgttttaaaggtttttaactttaagttaacgttaaacctaaaacttaaaattttaactttaaactttaaacgttaccggtttacgggttaacgggttaaccggtttaccgggaaccgttaaacggggtaaccgtaagggttacgttaattacgtaacgaacggtaacgtaacgtggttacggtcgttaacgtaacc

SEQ ID NO: 428991 - DNA, 557 bp, Homo sapiens
  misc_feature: GZ8MTXP01DX75G.19.71.G05.1.454.CMB.2.raw
  modified_base (234)..(234): a, c, t, g, unknown or other
  modified_base (292)..(292): a, c, t, g, unknown or other
  modified_base (330)..(330): a, c, t, g, unknown or other
  modified_base (333)..(333): a, c, t, g, unknown or other
  modified_base (347)..(347): a, c, t, g, unknown or other
  modified_base (550)..(553): a, c, t, g, unknown or other
  modified_base (555)..(555): a, c, t, g, unknown or other
  modified_base (557)..(557): a, c, t, g, unknown or other
tcagtactctcgtgcacgaccggtgctcgatttagtgtcgtcgcaagagagaggggcacttctccctctaacactctcccagtctccagactccctggctgtgtctctgggcgagcgggccaccgatacgaactgacaagtccagccacaatcttttatacagttccaacaatgaaaactacttagcttggtaccagcagagaccaggacagcctcctaggctgctcatttacnggcatctacccgggaatccggggtccctgaccgattcagtggcagcgggtctgggacngatttcactctcaccatcagcagcctgcaggctgaagntgngctagtttatagtntacaaactaattaatttattactacttcggtagtacgttacggacaagggactaagggtgatagtacgagacgaacgtagtgtcgtcgactacctacgttcttcgttacttactacttccttcccgtcctactctcgtacgacgtaagtaacgtacgttacggtacggcgggtcgtcggacggacggacggaacgtagtaagnnnngngn

SEQ ID NO: 428992 - DNA, 655 bp, Homo sapiens
  misc_feature: GZ8MTXP01BEIXS.19.71.G05.1.454.CMB.2.raw
  modified_base (245)..(245): a, c, t, g, unknown or other
  modified_base (328)..(328): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacgatacgaactgacaagtccagccacaattcttttaanactacttaccaaataatagaaaactctagcttagaccagacaagacgaccaggacacgccctcgtaggctgctctatttacgnggactacgttaccggtaacccgggacgttcccggggtcccctacggaccgtagttccgaggtcggacgtcgggtcggggttacgtaggggaactaggttactttaccaccttcctaccaacctacgtcgacgacgacgaccgtacgacgacggacgtagaagtagtaggggtagtagttagtttaagtttagttagtacgtaaacttaaattaatttaattaacgttacgttacgttaacggtacggttacggtacggaacggtaacggtaaggttaggttacgttacgtaacgtacgtaacgtacgtacggttacgtcgttcgtcg

SEQ ID NO: 428993 - DNA, 556 bp, Homo sapiens
  misc_feature: GZ8MTXP01CSIPO.19.71.G05.1.454.CMB.2.raw
  modified_base (377)..(377): a, c, t, g, unknown or other
  modified_base (511)..(511): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgacccctctcgctccacctgtcgccatccgtccggggacagagcgctagcgacagtgtgcttggcacgtggtcaggcacgtccccatcgagaggtctagaggtggcgtggggaaggacagtattcaattcgtccaaacgacgtaggaaataacaaattancgacacatctgttagagtagtacgactagaacaatacaaacgtacgacaacaagtaccgaaagtaaccctagttcctcccgtagcagtcctcgaccctcgtcgcgtaccgttccggacggacgttacggggttnttacttaacgttacgtggtagggaacgaccggtccccaagtaacg

SEQ ID NO: 428994 - DNA, 530 bp, Homo sapiens
  misc_feature: GZ8MTXP01APEG2.19.71.G05.1.454.CMB.2.raw
  modified_base (293)..(293): a, c, t, g, unknown or other
  modified_base (331)..(331): a, c, t, g, unknown or other
  modified_base (364)..(364): a, c, t, g, unknown or other
  modified_base (497)..(497): a, c, t, g, unknown or other
  modified_base (508)..(508): a, c, t, g, unknown or other
  modified_base (514)..(514): a, c, t, g, unknown or other
  modified_base (521)..(521): a, c, t, g, unknown or other
  modified_base (523)..(523): a, c, t, g, unknown or other
  modified_base (525)..(530): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatcgtacccgggatccgggggtccctgaccgattcagtggcaggcgggtctgggacngatttcactctcaccatcagcagcctgcaggctgaagntgtggcctagtttatattgtacaaaactaattnttattatacttcgtagggtacgttcggacccaaggggaccaaagggtggaatagtacaaggacgtaactggtcggctggacacctagtctgtcttcacttcctcccgcctatcgtagaccacgagaagtacgnggcggcggcgnggacgnggcgaangngnnnnnn

SEQ ID NO: 428995 - DNA, 515 bp, Homo sapiens
  misc_feature: GZ8MTXP01ED5XB.19.71.G05.1.454.CMB.2.raw
  modified_base (229)..(229): a, c, t, g, unknown or other
  modified_base (238)..(238): a, c, t, g, unknown or other
  modified_base (409)..(409): a, c, t, g, unknown or other
  modified_base (488)..(488): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgcaagtccagccanaatctttanacagttccaacaatgaaaactactagcttggtaccagcagagaccaggacagcctctaggctgctcatttactgggctcgtacccggaatcccggggtcctgaccgattcagtggcagcgggtctggggacagatttcactctcaccatcagcagcctgcaggctgaaagntgtggggctagtttatatgacaataatattattatacttcgtggaacgttcggaccgaaagggaccaaagggtgattanctaaggactaatggtggcctgctaacc

SEQ ID NO: 428996 - DNA, 540 bp, Homo sapiens
  misc_feature: GZ8MTXP01BEVRI.19.71.G05.1.454.CMB.2.raw
  modified_base (242)..(242): a, c, t, g, unknown or other
  modified_base (314)..(314): a, c, t, g, unknown or other
  modified_base (342)..(342): a, c, t, g, unknown or other
  modified_base (355)..(355): a, c, t, g, unknown or other
  modified_base (387)..(387): a, c, t, g, unknown or other
  modified_base (411)..(411): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccacgatacgaactgacaagtccagccacaatcttttanacagttccaacaatgaaaactctagcttggaccagcagagaccaggacagcctcctaggctgctcatttacngggcatctaccgggatccggggtccccngaccatcagtgcngcgggtctgggacagtactttcactctcaccntcagcacgcctgcaggctagaagntggtaggcttagtttattattgtacaaataattatttattattacttggtcggtaacgttccgggacgttaagggacctaaagggttggattagtcgaagtaacgtaactggttacggtccttgaaccc

SEQ ID NO: 428997 - DNA, 593 bp, Homo sapiens
  misc_feature: GZ8MTXP01DWA2F.19.71.G05.1.454.CMB.2.raw
  modified_base (240)..(240): a, c, t, g, unknown or other
  modified_base (322)..(322): a, c, t, g, unknown or other
  modified_base (411)..(411): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccataattcttttaanacgtacgttaccaaataatacgtaaaactactagctacgacagacaagacgacagacacgcctcgagctgctactattacgnggactacgtaccgtaaccgggacgtcccgggtcctacggacgtatcgagtcgaacgaggcggtgaggactagtcttacactcacactancagtacacgcgcgcgagacgagaagagtagtaggtagttagttattattatactaactaattaattaattattacgttacgtacggtaacggtacggttacggtaacggaacgtaacggtaagttacgttacgttacgtaacgtaacgtaacgtacgtacgttacgtaacgttaacgtaacg

SEQ ID NO: 428998 - DNA, 222 bp, Homo sapiens
  misc_feature: GZ8MTXP01A8ST0.19.71.G05.1.454.CMB.2.raw
  modified_base (218)..(222): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactcctggctgtgtctcgtgggcgagcgggctggcaaggcgcatagnnnnn

SEQ ID NO: 428999 - DNA, 515 bp, Homo sapiens
  misc_feature: GZ8MTXP01AHT6Y.19.71.G05.1.454.CMB.2.raw
  modified_base (236)..(236): a, c, t, g, unknown or other
  modified_base (306)..(306): a, c, t, g, unknown or other
  modified_base (393)..(393): a, c, t, g, unknown or other
  modified_base (402)..(402): a, c, t, g, unknown or other
  modified_base (511)..(511): a, c, t, g, unknown or other
tcagtactctcgtgcacgaccggtgctcgatttagtgtcgtcgcaagagagagggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaactactagctggtaccagcagagaccaggacagcctctagctgctcatttacnggcatctacccgggatccccggggcctgaccgattcaagtgcagcgggtctgggacagactttcactctcaccatcagcagcctgcngctgaaagngtgtggctagtttattattgtacaaactatattattataacttcggtaggacgtttcgggcctaaaggggacccttaagggttggataagtcaagacgaacttgtcggngtcg

SEQ ID NO: 429000 - DNA, 539 bp, Homo sapiens
  misc_feature: GZ8MTXP01B9PWR.19.71.G05.1.454.CMB.2.raw
  modified_base (237)..(237): a, c, t, g, unknown or other
  modified_base (248)..(248): a, c, t, g, unknown or other
  modified_base (312)..(312): a, c, t, g, unknown or other
  modified_base (345)..(345): a, c, t, g, unknown or other
  modified_base (353)..(353): a, c, t, g, unknown or other
  modified_base (361)..(361): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatcttttanacagttccaanaatagaaaactacttagcttggtaccagcagagaccaggacagcctctaggctgctcatttacnggcatctacccgggatccggggtcccctgacgntcagtgcngcgggtcngggacagtacttcactctcaccatcagcacgcctgcaggctagaagatgggtggctagtttattattgactaaataattattaattatactttcggtaaggtacgtttacgggaccaaaggggtaccctaagggttggttattataacgaaggaaccgtaagtggttaggcttgaacc

SEQ ID NO: 429001 - DNA, 514 bp, Homo sapiens
  misc_feature: GZ8MTXP01ALZIO.19.71.G05.1.454.CMB.2.raw
  modified_base (428)..(428): a, c, t, g, unknown or other
  modified_base (444)..(444): a, c, t, g, unknown or other
  modified_base (472)..(472): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccgggggacagagtcgctagcgacagtgttgcttggcactgggtcaggcagtccccatcgagaggtctagagtggctggggaaggacatatttcaatgtccaaacacgtggaatacaaattatgacaccatctgttgagagtcgactgaacaatcaacgtagacacatacgaaagaaccagttcnccctgcagctgacctntgttgaccttcccgaggacacggggttnttataattacgtggtagggaacgttacgggccccaagtaacg

SEQ ID NO: 429002 - DNA, 727 bp, Homo sapiens
  misc_feature: GZ8MTXP01EDRH0.19.71.G05.1.454.CMB.2.raw
  modified_base (240)..(240): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagcggccacatcaactgacaagtccagccacaattctttanacagttaccaaacaatagaaaactacttagcttaggtaccagacagacgaccaggacagccctcgtaggctgctactatttaccgtgggctacgttcccgtaaccccggggaacgttcccccgggggtacccccctaggaaccgtagtttccgaacgggttcgggaccgtaaggggtccggggttccgtacgggggaactacggttactttccaaccttcctaccgaaccctatccgagaccaacgtcccgtaggccgaagggccttaaggaaagtagttgggggttacgggttactttaaggttttaatttaagtttacgtaaaccttaaaacttaaattttaattttaaagtttaactttaaccgtttcggggttaacgggttaaccggtttaccgggaaccggttaaacggggaaccgtaaagggttaggttaattaacgtaaccgaaggtaacgtaaactgggttaggtcgttaacgtaaccg

SEQ ID NO: 429003 - DNA, 517 bp, Homo sapiens
  misc_feature: GZ8MTXP01CRWSM.19.71.G05.1.454.CMB.2.raw
  modified_base (236)..(236): a, c, t, g, unknown or other
  modified_base (356)..(356): a, c, t, g, unknown or other
  modified_base (506)..(506): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatctttanacagttccaacaatagaaaactacttagcttggtaccagcagagaccaggacagcctctaggctgctcatttactgggcatctacccgggatccggggtcccctgaccgattcagtggcnggcgggtctgggacagatttcactctcaccatcagcagcctgcaggctgaagatgggtggactagtttatattgtacaactaattattattatacttcggtggtacgttcggccaaagggtaccaagggttggattatcagaacgaatgnggtcttgaacc

SEQ ID NO: 429004 - DNA, 539 bp, Homo sapiens
  misc_feature: GZ8MTXP01DSANB.19.71.G05.1.454.CMB.2.raw
  modified_base (461)..(461): a, c, t, g, unknown or other
  modified_base (503)..(503): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccatcgagaggtctagagtggctagggaagacatatttcatgtaccaaacacgtaggaaactacaaattatgcaaaccatctgttgagagtcgactagaacaatacaacgtagacaacatacgaaagaacctacgttcctcctgacagctcgacctctcgtcgaccgtcccggaggacgacgggtntaattattacgtggtaggaacggacggaccccaagtacgacnttacgccctacctcgtctcgttggtcgttcgttaag

SEQ ID NO: 429005 - DNA, 553 bp, Homo sapiens
  misc_feature: GZ8MTXP01EMIDB.19.71.G05.1.454.CMB.2.raw
  modified_base (228)..(228): a, c, t, g, unknown or other
  modified_base (237)..(237): a, c, t, g, unknown or other
  modified_base (245)..(245): a, c, t, g, unknown or other
  modified_base (247)..(247): a, c, t, g, unknown or other
  modified_base (249)..(249): a, c, t, g, unknown or other
  modified_base (256)..(256): a, c, t, g, unknown or other
  modified_base (262)..(262): a, c, t, g, unknown or other
  modified_base (264)..(264): a, c, t, g, unknown or other
  modified_base (280)..(280): a, c, t, g, unknown or other
  modified_base (289)..(289): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactcctggctgtgtctcgtgggcgagcgggcacgatacgactgacaagtcagccanaatctttanacatacanananaatatantgacananagacgacagacacgcnctacgctcnctactattacgtgcactacgtaccggtacgtccggtcccgtcgacgtatcgagacgcgcggcggtcgtggagagtatctactctcacacacacgacacgcgcgcgagacgtagaagtagtgggtgtagttagtttagttatagtactaataattaattaattacttacgttcgtaacggtacggttacggtacgaacggtaacggtaaggttaggttagttacgtaacgtaacgtaacgtacgtaggttacgtcgttcgtaacg

SEQ ID NO: 429006 - DNA, 650 bp, Homo sapiens
  misc_feature: GZ8MTXP01B7E7R.19.71.G05.1.454.CMB.2.raw
  modified_base (242)..(242): a, c, t, g, unknown or other
  modified_base (254)..(254): a, c, t, g, unknown or other
  modified_base (322)..(322): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatcttttaanactagtaccaanaatacgaaactactagctagacagacagacgaccagacacgcctacgtaggctgctactagtttacgnggactacgtaccgtaacccggggtacgtccccggggtacccctaggaccgtagttccgaggttcgggaccgtaagggtccgggtacgtacggggaactaggttactttccaccttcctaccaacctatcgacgacgacgccgtcgacgacgacgtagtaagtagtagggtacggtacgttagtttaagttagttagtaacgtaaactaaattaattaattaattacgttcggttaacggtacggttacggtacggaacgggtaacggtaacggttaggttacgttacgtaacgtacgtaacgtacgtacggttacgtcgttcgtaacg

SEQ ID NO: 429007 - DNA, 560 bp, Homo sapiens
  misc_feature: GZ8MTXP01BYUNF.19.71.G05.1.454.CMB.2.raw
  modified_base (224)..(224): a, c, t, g, unknown or other
  modified_base (231)..(231): a, c, t, g, unknown or other
  modified_base (235)..(235): a, c, t, g, unknown or other
  modified_base (237)..(238): a, c, t, g, unknown or other
  modified_base (242)..(242): a, c, t, g, unknown or other
  modified_base (244)..(245): a, c, t, g, unknown or other
  modified_base (286)..(286): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgactgcaagtccagcanatcttantcanannaatntnntgacagcagagacagacagcctcagctgctactatttacgngggctacgtaccgtacccgggacgtcccggggtcctcggaccgtattcgaggtcggacgaggtcgggtcgtagggactagtactttcactcctacactatcgacgcacgcctgacacggacagaagtagtggtggggtacttagtttattagttagtacaaattaattaatttattacgttacgttcggtaggtaaccgttacggaccgtaaagggaccgtaaagggtgaacgttcgacgaagtaacgtaacgtggtcggcgtcgttcgtaacg

SEQ ID NO: 429008 - DNA, 656 bp, Homo sapiens
  misc_feature: GZ8MTXP01CXOTN.19.71.G05.1.454.CMB.2.raw
  modified_base (242)..(242): a, c, t, g, unknown or other
  modified_base (252)..(252): a, c, t, g, unknown or other
  modified_base (257)..(257): a, c, t, g, unknown or other
  modified_base (263)..(263): a, c, t, g, unknown or other
  modified_base (318)..(318): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccacgatacgaactgacaagtccagccacaatctttaanactatacaanaatanaaactntagcttagaccagacagacgaccagacacgcctacgaggctgctactatttacgnggactacgtaccgtaaccgggtacgtcccgggtcccctacggacgtagttcgaggtcggacgaacgggtcgggttacgtaggggtaactaggttactttaccaccttcctaccaacctacgtacgacgacgacgtccgtacgacgacggacgtagtaagtagtaggggtaggtacgttaagtttaagtttaagttacgtaactaaactaaattaattaattaacgttacgttacgttaacggtacggttacggtaccggttaacggtaaccggtaacggttacggttacgttacgtaacgtaacgtaacgtaacgtacggttacggtcgttcgtaacg

SEQ ID NO: 429009 - DNA, 575 bp, Homo sapiens
  misc_feature: GZ8MTXP01CMCJ5.19.71.G05.1.454.CMB.2.raw
  modified_base (229)..(229): a, c, t, g, unknown or other
  modified_base (238)..(238): a, c, t, g, unknown or other
  modified_base (249)..(249): a, c, t, g, unknown or other
  modified_base (309)..(309): a, c, t, g, unknown or other
  modified_base (357)..(357): a, c, t, g, unknown or other
  modified_base (391)..(391): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcggaccaccatcaactgcaagtccagccanaatctttanacagttccaanatagaaaactctagcttggaccagcagagaccaggacagcctctaggctgctcatttacnggctatccgtaccgggatccggggtccccctggaccgattcagtcgcnggtcgggtctgggacagtcttcactctcacctancagacacgcctgacgaggtactagaagtgtcgggtacggtattagtttattagttacgtaactaaattaaattaacttattaacgttacgttcggtaacggtaaccggttcggaaccgttaaacgggtaacgtaagggttagacttagtaacgaagtaacgtaagtggttacgtcgttcgaacg

SEQ ID NO: 429010 - DNA, 542 bp, Homo sapiens
  misc_feature: GZ8MTXP01C2UR5.19.71.G05.1.454.CMB.2.raw
  modified_base (227)..(227): a, c, t, g, unknown or other
  modified_base (236)..(236): a, c, t, g, unknown or other
  modified_base (350)..(350): a, c, t, g, unknown or other
  modified_base (362)..(362): a, c, t, g, unknown or other
  modified_base (417)..(417): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagactccctggctgtgtctcgtgggcgagcgggccacatcaactgcaagtccagccanaatctttanacagttaccaaacaatagaaaactacttagcttggaccagcagagaccagacagcctctaggctgctcatttactgggcatccgtacccgggatcccggggtcccctggaccgnttcgagtcggcnggcgggtctggggacagactttcactctcaccatcagcagcctgcagctgaaagntggtggctaagtttattattgacaataaatattattatacttcgtaaggtacgttcggaccgaaagggtaccaagggttaggattacgtaacgaagtaaccgaaagtggttacggtcttggaacc

SEQ ID NO: 429011 - DNA, 574 bp, Homo sapiens
  misc_feature: GZ8MTXP01D2ONM.19.71.G05.1.454.CMB.2.raw
  modified_base (248)..(248): a, c, t, g, unknown or other
  modified_base (252)..(252): a, c, t, g, unknown or other
  modified_base (305)..(305): a, c, t, g, unknown or other
  modified_base (401)..(401): a, c, t, g, unknown or other
  modified_base (407)..(407): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatacgaactgacaagtccagccacatctttaacatacaanatanaaactatagctagacagcagacacagacagcctctagctgctactatttacgnggactagtaccgtaaccggtacgtcccgggtacccctagacgtatcgaggtcgacgcggcgggtcgtagggactagtacttcactcacacatacancacgcncgcgacgcgagaagtagtagggtagtagtagttagttagttagtactaactaaattaattattattacgttcgttaacggtacggttacggtacgttaacggtaacgtaacggttagttagttacgtaacgtaacgtaacgtacgtacggttacgtcgttcgtaacg

SEQ ID NO: 429012 - DNA, 605 bp, Homo sapiens
  misc_feature: GZ8MTXP01AD2ZR.19.71.G05.1.454.CMB.2.raw
  modified_base (217)..(217): a, c, t, g, unknown or other
  modified_base (229)..(229): a, c, t, g, unknown or other
  modified_base (237)..(237): a, c, t, g, unknown or other
  modified_base (245)..(245): a, c, t, g, unknown or other
  modified_base (249)..(249): a, c, t, g, unknown or other
  modified_base (254)..(254): a, c, t, g, unknown or other
  modified_base (305)..(305): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggcacgatacgactnacaagcagccanatctttanacatacanatanaactntagctgacagcagacgacagacacgcctacgtagctcgctactatttacgnggactacgtaccgtaaccgggtacgtcccggggtacccctcggacgtacgttcgagtacggcgcggtcgggtcgtacggacgtagtacttactactactacaccactacacgacgacgtcgtcgacgacgtacgtagacgtagtagggtggtacgttagtttagttagttacgtactaataattattattacttacgttcggttaacggtacggttacggtaccggttaacggtaacggtaacggttaggttagttacgtaacgtacgtaacgtacgtacggttacggtcgttcgtaacg

SEQ ID NO: 429013 - DNA, 623 bp, Homo sapiens
  misc_feature: GZ8MTXP01D7LT7.19.71.G05.1.454.CMB.2.raw
  modified_base (236)..(236): a, c, t, g, unknown or other
  modified_base (239)..(239): a, c, t, g, unknown or other
  modified_base (618)..(623): a, c, t, g, unknown or other
tcagtactctcgtgcacgaccggtgctcgatttagtgtcgtcgcaagagagagggggcacttctccctctaacactctccccagtctccagactccctggctgtgtctctggggcgagcgggccaccgatacgaactgcaagtccagccacaatcttttatacagttccaacaatgaaaactacttagcttggtaccagcagagaccaggacagcctctaggctgctcatttacgnggnatccgtacccgggatcccggggtccctgacgtatcgaggtcggcgaggtcgggtcgtagggaactagtactttcactctaccaccatcacgcagcctggacaggctaggaagtagtggtaggtacttagttttatagttacgtaacaaaaacttaattaatttaattacgttacgtttcggtacgggtacgttcgggaacctaaaggggtacctaagggtgaattacgtacgtaagtaacgtaacgtagtaggtcgtacgtacacctacgttacgttcgttcttacttacttcccgttcccgtacctactactacgtacgtaacgagtaacgtacgttacggacggcggtcggtcggacggacggacgaacgtagaagnnnnnn

SEQ ID NO: 429014 - DNA, 523 bp, Homo sapiens
  misc_feature: GZ8MTXP01A6HQ8.19.71.G05.1.454.CMB.2.raw
  modified_base (238)..(238): a, c, t, g, unknown or other
  modified_base (314)..(314): a, c, t, g, unknown or other
  modified_base (359)..(359): a, c, t, g, unknown or other
  modified_base (421)..(421): a, c, t, g, unknown or other
tcagtactctcgtgcacgaccggtgctcgatttagtgtcgtcgcaagagagaggggggaggtacaacaggcaggcaggggcagcaagatggtgttgcagaccccaggtcttcatttctctgttgctctggatctctggtgcccacggggacatcgtgatgacccagtctccagactccctggctgtgtctctgggcgagcgggccacatcaactgcaagtccagccacaatcttttanacagttccaacaatagaaaactacttagcttggtaccagcagagaccaggacagcctcctaggctgctcatttacnggcatctacccgggaatccggggtccccctgaccgattcagtgcngcgggtactgggacagactttcactctcaccatcagcagcctgcaggcagaagagtggtggntagtttattatgtacaaatatattattatacttcgtgacgttcggaccgttaaagggacctaagggttgattagtcagaacgaacgtgttggcgttcgaacc

SEQ ID NO: 429015 - DNA, 574 bp, Homo sapiens
  misc_feature: GZ8MTXP01DDNND.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgacccctctcgctcacctgtcgccatcgtccggggacagagtcgctagcgacagtgttgcttggcacgtgggtcaggccacgtccccatcgagtaggtctagagtggcgtaggggaacgactagttatttcatcgtaccaacgacggtaggaaataacaaattatacgacacctatctgttagagtagtacgactagaacaattacaaacgtaagaaccaactaacgtacgaaagaacctagttcctccctagactaggtctacgacctcgttcgcgaccgtcccggaggtacgtacggggttattagttaacttaacgtaggtaacgggaaacgaccggttaccccaagttaacgaac

SEQ ID NO: 429016 - DNA, 592 bp, Homo sapiens
  misc_feature: GZ8MTXP01CCVDF.19.71.G05.1.454.CMB.2.raw
  modified_base (247)..(247): a, c, t, g, unknown or other
  modified_base (259)..(259): a, c, t, g, unknown or other
  modified_base (313)..(313): a, c, t, g, unknown or other
  modified_base (320)..(320): a, c, t, g, unknown or other
  modified_base (355)..(355): a, c, t, g, unknown or other
  modified_base (359)..(359): a, c, t, g, unknown or other
  modified_base (366)..(366): a, c, t, g, unknown or other
  modified_base (402)..(402): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgaggccgggccacgatacgaactgacaagtccagccacaattcttttaanactactaccaanaatagtaaaactactagctagacagcagacgacgagacacgcctcgagctgctntattcgngcacgtccgaccggacgtcccgggtccccagactntcgngtcgcgnggcgggtcgtagggactagtacttcactcacaccancacgacgacgcgtcgacgacgcgtagagtagtgggtagtagttagttagttattagtactaaataaattaattaattagttacgttcggttaacggtacggttacggtaccggttaaacggtaacggtaacggttaggttagttacgtaacgtaacgtaacgtacgtacggttacggtcgttcgtaaccg

SEQ ID NO: 429017 - DNA, 677 bp, Homo sapiens
  misc_feature: GZ8MTXP01DX4FT.19.71.G05.1.454.CMB.2.raw
  modified_base (241)..(241): a, c, t, g, unknown or other
  modified_base (250)..(250): a, c, t, g, unknown or other
  modified_base (255)..(255): a, c, t, g, unknown or other
  modified_base (316)..(316): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgaactgacaagtccagccacaattctttaanacatacaanaatanaaactactagctagacagacagacgaccaggacacgcctacgaggctgctactatttacgnggactacgtccgtaaccggacgttccccggggtcccctaggaccgtattccgacggtacgggaccgtaacggggtccggggttacgtacggggaacctaggttacttttaccaccttcctaccaaccgtactacgacgacgacgtaccgtcgacgacggtacgtaggtaagtagttacggggttaggttacgttaagttttaagtttaacgtttacgttaactaaacttaaatttaatttaatttaatttacgttacggttaacggttacggttacggtaccggttaaacgggtaaacggtaaggttaggttagttacgtaacgtaacgtaacgtaacgtaggttacggtcgttcgtaacg

SEQ ID NO: 429018 - DNA, 514 bp, Homo sapiens
  misc_feature: GZ8MTXP01B2MAX.19.71.G05.1.454.CMB.2.raw
  modified_base (225)..(225): a, c, t, g, unknown or other
  modified_base (234)..(234): a, c, t, g, unknown or other
  modified_base (306)..(306): a, c, t, g, unknown or other
  modified_base (488)..(488): a, c, t, g, unknown or other
  modified_base (506)..(506): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatctttanacagttccaacatgaaaactctagctggtaccagcagagaccaggacagcctcctaggctgctcatttacgngggcatccgtacccgggaatcccggggtcctgacccgtattcgagtggacaggcgggtctggggacagtactttcactctcacatcagcagccctgacaggctagaagatggtgggctagtttatattgacaatatattatatacttcgtgtaacgttcgacgaagggactaaaggtgattnttacgaagacgaactggngctgcaac

SEQ ID NO: 429019 - DNA, 545 bp, Homo sapiens
  misc_feature: GZ8MTXP01AD4UD.19.71.G05.1.454.CMB.2.raw
  modified_base (312)..(312): a, c, t, g, unknown or other
  modified_base (428)..(428): a, c, t, g, unknown or other
  modified_base (512)..(512): a, c, t, g, unknown or other
  modified_base (530)..(530): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatcttttatacagttccaacaatagaaaactacttagctggtaccagcagagaccaggacacgcctcctaggctgctctatttacgngggcagtccgtaacccggggaattcccgggggtcccctggaccgtattcgagtggacaggcgggtctggggacaggtatttcactctcaccatcagcagcctgcagctgaagatgnggggctagtttattagttgtcaaataattatttaatactacttcggtggtaacgttcggacgaacgggactaagggtgttattnttacgaagacgaagtggnggttactgcgtaacg

SEQ ID NO: 429020 - DNA, 685 bp, Homo sapiens
  misc_feature: GZ8MTXP01D9TXS.19.71.G05.1.454.CMB.2.raw
  modified_base (241)..(241): a, c, t, g, unknown or other
  modified_base (253)..(253): a, c, t, g, unknown or other
  modified_base (257)..(257): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtcgcccgacggggacatcgtgatgacccagtctccagactcctggctgtgtctcgtgggcgagccgggccacatcaactgacaagtccagccaataattctttaanactactacaaanatanaaactctagctagacagacaagacgaccgagacacgcctacgtagctcgtactactacgtttacgcggactacgtaccggtaacccgggacgttcccgggtacctacggaccgtattcgaggtcggaacgtacgggtcggtacgtagggactagttctttaccacttcctaccaacacgtacgaacgcgacgtaccgtacgacgacggacgtacgtaagtagttaggttacggggttacgtttaagttttaagtttaacgttacgttaacgtaaacttaaatttaaactttaactttaacgtttacgttacggttacggtaacggttacggttaacggtaaacggttaaacggtaaacggtaaggttaacgttaacgttacgtaacgtaacgtaacgtacggtacggttacgtaacgttaacgtaacg

SEQ ID NO: 429021 - DNA, 662 bp, Homo sapiens
  misc_feature: GZ8MTXP01ATZTS.19.71.G05.1.454.CMB.2.raw
  modified_base (240)..(240): a, c, t, g, unknown or other
  modified_base (318)..(318): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgactaagtccagccacaattcttttaanactagtaccaaactaatagaaactctagctagacagcagacgacaggacacgcctacgtaggctgctactatttacgngggactacgtaccgtaaccgggacgtcccggggtcctacggaccgtattcgagtcggacgacgggtcgggtcggtacgggacgtacgtacttactactactacctacctactacacgacgacgtaccgtcgacgacggacgtagaagtagtaggtacggggtacgttagtttaagtttagttacgttaactaaacttaaattaatttaactttaacttacgttacggttacggttaacggttaccggttaccggtaacgggttaaccggtaaacgggtaaggttacgttacgttacgtaacgtaacgtaacgtacggtacggttacgtaacgttaaccgtaacg

SEQ ID NO: 429022 - DNA, 599 bp, Homo sapiens
  misc_feature: GZ8MTXP01DQURE.19.71.G05.1.454.CMB.2.raw
  modified_base (237)..(237): a, c, t, g, unknown or other
  modified_base (313)..(313): a, c, t, g, unknown or other
  modified_base (354)..(354): a, c, t, g, unknown or other
  modified_base (362)..(362): a, c, t, g, unknown or other
  modified_base (387)..(387): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcaactgcaagtccagccacaatctttanacagttccaacaatagaaaactacttagcttggtaccagacagagaccaggacagcctctaggctgctcatttacnggcatctaccgggaatccggggtcccctgacgatcagtgcnggcgggtngggacagtatttcaatctcacctancacgacacgcctcgcgacggacgtagtaagtagttaggggtacggtacgttagtttaagtttacgttacgtactaaactaaattaatttaatttaacttacgttacggttaacggttacggttaccggtaccggttaaacgggtaaacggtaagggttaggttagttacgtaacgtaagtaacgtaacgtacggttacggtcgttcgtaacg

SEQ ID NO: 429023 - DNA, 625 bp, Homo sapiens
  misc_feature: GZ8MTXP01CT1S3.19.71.G05.1.454.CMB.2.raw
  modified_base (228)..(228): a, c, t, g, unknown or other
  modified_base (237)..(237): a, c, t, g, unknown or other
  modified_base (246)..(246): a, c, t, g, unknown or other
  modified_base (250)..(250): a, c, t, g, unknown or other
  modified_base (256)..(256): a, c, t, g, unknown or other
  modified_base (259)..(259): a, c, t, g, unknown or other
  modified_base (306)..(306): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgacaagtccagccanaatctttanacatacaanatanaaactntanctagacagacagacgacagacacgcctacagctgctactatttacgnggactacgtaccgtaacccgggtacgttcccggggtccccctaggaccgtattcgaggtcggacgtaacgggtccgggtacgtaggggaactaggtactttcaccttctacaaccatacagaccagccgtgacgaggtactagaacgtgtgggtacggtactttaagtttaattagttacgtaactaaattaaattatttaatttaactacgtttaggtaacggtaacgttaccgggaacgaaacggggtaacgtaagggttacgttaattacgtaacgaaacggtaacgtaacggttggttacggtaacgttcgaacc

SEQ ID NO: 429024 - DNA, 541 bp, Homo sapiens
  misc_feature: GZ8MTXP01BZMI2.19.71.G05.1.454.CMB.2.raw
  modified_base (417)..(417): a, c, t, g, unknown or other
  modified_base (463)..(463): a, c, t, g, unknown or other
  modified_base (504)..(504): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctaggagtggctagggggaaggactattatttcattgtaccaacgacggtggaaactacaaatttatgacaaaccattctgttgagagtcgactgacaatacaacgtagacacatacgaagaaccagttccncctgacagcgtcgaccttctgtcgaccgtccggaggacgacgggtntattacttcgtggtaggaacggaccggccccaagtacgacncttcgccctacctcgttctcgttggtcgttcgttaag

SEQ ID NO: 429025 - DNA, 610 bp, Homo sapiens
  misc_feature: GZ8MTXP01CA8XQ.19.71.G05.1.454.CMB.2.raw
  modified_base (243)..(243): a, c, t, g, unknown or other
  modified_base (257)..(257): a, c, t, g, unknown or other
  modified_base (323)..(323): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactcctggctgtgtctcgtgggcgagcgggccacatacgaactgacaagtccagccactaattcttttaanactacgttaccaanaatacgaaactactagcttagacagacagacgacagacacgcctcgagctgactactagtttacgnggactacgtaccggtaacccgggtacgttccccggggtcccctaggacgtatcgaggtcggcgcgggtcgggtacgtacgggactagtacttcactctacacatcagcacgcctgacgacggctagaagtgtggggtacgtacttaagtttattagttacgtaactaaattaattatttaacttaacttacgttcggtaacggtacgttacggaacgaaacgggtaacgtaaggttacgttattacgaacgacgtaacggtaacgtcggttacgtaacgttcgaacc

SEQ ID NO: 429026 - DNA, 601 bp, Homo sapiens
  misc_feature: GZ8MTXP01BZ686.19.71.G05.1.454.CMB.2.raw
  modified_base (228)..(228): a, c, t, g, unknown or other
  modified_base (235)..(235): a, c, t, g, unknown or other
  modified_base (243)..(243): a, c, t, g, unknown or other
  modified_base (245)..(245): a, c, t, g, unknown or other
  modified_base (247)..(247): a, c, t, g, unknown or other
  modified_base (252)..(252): a, c, t, g, unknown or other
  modified_base (255)..(255): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactcctggctgtgtctcgtgggcgagcgggctacgatacgactcgataagcagcanatcttanacatacanananaactntanctagacagcagacgacagacacgcctacgagctgctactacttacgtcggtacgtacgtaccgtaccggtaccgtacccggtcccccgtacgtacgtacgtcgtacgtacgcgcggtcgggtcggtacgggacgtacgtactactactctacacactacacgacgacgcgtcgcgacgacgtagaagtagtacgggtacgtacgttagttagttagttagtacgtaactaaattaattattacttacgttacgtaacggtacggttacggtacggaacggtaacggtaacggttacggttacgttacgtaagtacgtaacgtacgtacgttacgtcgttcgtaacg

SEQ ID NO: 429027 - DNA, 549 bp, Homo sapiens
  misc_feature: GZ8MTXP01BQRUQ.19.71.G05.1.454.CMB.2.raw
  modified_base (238)..(238): a, c, t, g, unknown or other
  modified_base (315)..(315): a, c, t, g, unknown or other
  modified_base (368)..(368): a, c, t, g, unknown or other
  modified_base (426)..(426): a, c, t, g, unknown or other
  modified_base (538)..(538): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttaccaacaatgaaaactacttagcttggtaccagcagagaccaggacagcctcctaggctgctcatttacgngggcatcgtacccggggatcccgggggtccccctggaccgattcaggtggccnggccgggtctggggacagtatttcactctacaccatcagcagcctgcaggctagaagntggggtggtctagttttattattgtacaactaattattaattattacttcggtaaggtacgttcggacgttaaacgggacctaaggttggattagtaacagaacgaacgtgngtcgttgaacc

SEQ ID NO: 429028 - DNA, 521 bp, Homo sapiens
  misc_feature: GZ8MTXP01A84QF.19.71.G05.1.454.CMB.2.raw
  modified_base (240)..(240): a, c, t, g, unknown or other
  modified_base (314)..(314): a, c, t, g, unknown or other
  modified_base (360)..(360): a, c, t, g, unknown or other
  modified_base (374)..(374): a, c, t, g, unknown or other
  modified_base (496)..(496): a, c, t, g, unknown or other
tcagtactctcgtgcacgaccggtgctcgatttagtgtcgtcgcaagagagagggggaggtacaacaggcaggcaggggcagcaagattgtgttgcagaccccaggtcttcatttctctgttgctctggatctctggtgccccacggggacatcgtgatgaccccagtctccagactccctggctgtgtctctgggcgagcgggccaccatcaactgcaagtccagccacaatcttttanacagttccaacaatgaaaactacttagcttggtaccagcagagaccaggacagcctctaggctgctcatttacngggcatctacccgggaatccggggtcccctgaccgattcagtggcngcgggtctgggacngatttcactctcaccatcagcagcctgcaggctgaagtatggtggctagttttatagttgtacaactaatattattatacttcggtggaacgttcggaccttaaagggaccaaaggttgganatcagaacgaatgttggcttgaacc

SEQ ID NO: 429029 - DNA, 795 bp, Homo sapiens
  misc_feature: GZ8MTXP01BUYZC.19.71.G05.1.454.CMB.2.raw
  modified_base (240)..(240): a, c, t, g, unknown or other
  modified_base (251)..(251): a, c, t, g, unknown or other
  modified_base (321)..(321): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgacaagtccagccacaatctttaanacataccaaanaatagaaaactctagcttagaccagacagacgaccaggacacgccctacgtaggctgctactatttacgnggactacgttaccgtaacccggggacgtccccggggtccccctacggaccgtagttaccgagggtacgggaccgtaacggggtccggggttaccgtacggggtaacctaaggttactttacccaacccttccctacccaacccgtactaccgaacggtacccgtaacggtcccgtaggaccgacgggtacgtaagggaaacgtaggttacgggggttacgggttacgttttaaaggtttttaacgtttaacgtttaacggttaaacctaaaacgtttaaaattttaacttttaaacgttttaacgtttaaccggttttaccggggttaaccgggggtttaaacccgggtttacccggggtaaacccgggttaaaacggggtaaacccggtaaaggggttacggttaaacgttaacgtaaccggtaaacggtaaccggtaacgttacgggttacggtaaccgttaacgtaacccg

SEQ ID NO: 429030 - DNA, 560 bp, Homo sapiens
  misc_feature: GZ8MTXP01CKR5H.19.71.G05.1.454.CMB.2.raw
  modified_base (240)..(240): a, c, t, g, unknown or other
  modified_base (384)..(384): a, c, t, g, unknown or other
  modified_base (394)..(394): a, c, t, g, unknown or other
  modified_base (530)..(530): a, c, t, g, unknown or other
  modified_base (549)..(549): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgacaagtccagccactaattctttanactagttaccaaacaatagaaaactacttagcttaggtaccagcagagaccaggacagcctctaggctagctctatttaccgtgggcctagtccgtaacccggggactcccgggggtcccccctggaccgtattcgaggtggcnggtcgggtcnggggacagtactttcactctcacatcagcagcctgcgaggctagaagtgtgggtggtactagtttattattgactaaataaattattattaattacgtggtaaggtacgttcggacgaagggaacctagggttagnttagcagtaaccgaatggngtcgttgaacc

SEQ ID NO: 429031 - DNA, 515 bp, Homo sapiens
  misc_feature: GZ8MTXP01EL6PD.19.71.G05.1.454.CMB.2.raw
  modified_base (239)..(239): a, c, t, g, unknown or other
  modified_base (356)..(356): a, c, t, g, unknown or other
  modified_base (501)..(501): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtccagccacaatcttttanacagttccaacaatgaaaactacttaagcttggtaccagcagagaccaggacagcctcctaggctgctcatttactggcatctaccgggatccggggtcccctgacgattcagtgcngcgggtctgggcagatttcactctcaccatcagcagcctgcaggctgaagatgggtggctagtttattatgtacaataatattattatacttgtggacgttcggccgttaagggaccaaggttggattatcgagaaccgaagtgngtaacgttggaacc

SEQ ID NO: 429032 - DNA, 657 bp, Homo sapiens
  misc_feature: GZ8MTXP01CINVV.19.71.G05.1.454.CMB.2.raw
  modified_base (229)..(229): a, c, t, g, unknown or other
  modified_base (241)..(241): a, c, t, g, unknown or other
  modified_base (256)..(256): a, c, t, g, unknown or other
  modified_base (324)..(324): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccgatcaactgacaagtccagccanaattcttttaanactacgttaccaaanaatagaaactactagtctagacagacagacgaccaggacacgcctcgtagctcgactactatttacgnggactacgtaccgtaccgggacgtcccggggtcctacggaccgtattcgaggtcggaacgacgggtccgggtcgtacgggactagtactttacacttctaccacctatacgacgaccacgtcctagacgacggactagaagtagtggtacggggtacgtttaagttttattagttacgtaacctaaacttaaatttaatttaattaacgttacgttacggtaggttaaccggttacggaaccggtaaacgggaaccgtaaagggttacggttaagttacgttacgtaacggtaacggtaacgttcgggtacggttactaacgaaccgtaaccg

SEQ ID NO: 429033 - DNA, 552 bp, Homo sapiens
  misc_feature: GZ8MTXP01CQNNM.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagaaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcacgtccccatcgagaggtctagagtggcgtaggggaacggactatatttcatcgtaccaacgacgtaggaaatacaaattatgacacctatctgttgagagtacgactagaacaatacaaacgtagaacacaatacggaaacgaacctagttcctaccctgaccacgtctacgacctctgtcgaccgtcccgaggtaccgtcgggttagttattacgttaacgtaggtaacggaacgccggacccctaagttaacggaac

SEQ ID NO: 429034 - DNA, 630 bp, Homo sapiens
  misc_feature: GZ8MTXP01ACCL6.19.71.G05.1.454.CMB.2.raw
  modified_base (234)..(234): a, c, t, g, unknown or other
  modified_base (246)..(246): a, c, t, g, unknown or other
  modified_base (314)..(314): a, c, t, g, unknown or other
tcagtactctcgtgcacgaccggtgctcgatttagtgtcgtcgcaagagagaggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgcaagtccagccacaatctttanacagttccaaanaatagaaactactagctaggacagcagacgaccgaggacacgtcctcgtagctgtctactatttacgngggactacgtaccgtacccgggtacgtcccggggtcctacggaccgtagttacgaggtcggaacacgggtccgggtcgtagggactagttactttcacttcctaccacctacgtacgacgacgacgcgtcgcgacgacgtacgtaagtagtggtcggggtacgttagtttagtttagttacgtaactaaactaaattaattaatttaacttacgttacgttacggtaacggttacggttacggtaacggaaacggtaacggtaaggttacgttacttacgtaacgacgtaacgtacgtcggttacgtcgcgtaacg

SEQ ID NO: 429035 - DNA, 512 bp, Homo sapiens
  misc_feature: GZ8MTXP01D77KP.19.71.G05.1.454.CMB.2.raw
  modified_base (290)..(290): a, c, t, g, unknown or other
  modified_base (479)..(479): a, c, t, g, unknown or other
  modified_base (486)..(486): a, c, t, g, unknown or other
  modified_base (491)..(491): a, c, t, g, unknown or other
  modified_base (496)..(496): a, c, t, g, unknown or other
  modified_base (498)..(498): a, c, t, g, unknown or other
  modified_base (500)..(500): a, c, t, g, unknown or other
  modified_base (504)..(512): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactggcatctacccgggaatccggggtccctgaccgattcagtggcagcgggtctgggacngatttcactctcaccatcagcagcctgcaggctagaagatgtggcctaggttttatattgtacaaaactaattaatttaatttattaacttcggtaggacgtttcgggaccaaaggggaccaaaggtggaatatcgaagacgaatgtggctgacaccattctgtcttcattctcccgcatctgacacgngaagtcnggcgnggcgngngngcgnnnnnnnnn

SEQ ID NO: 429036 - DNA, 525 bp, Homo sapiens
  misc_feature: GZ8MTXP01DS78R.19.71.G05.1.454.CMB.2.raw
  modified_base (238)..(238): a, c, t, g, unknown or other
  modified_base (250)..(250): a, c, t, g, unknown or other
  modified_base (308)..(308): a, c, t, g, unknown or other
  modified_base (314)..(314): a, c, t, g, unknown or other
  modified_base (355)..(355): a, c, t, g, unknown or other
  modified_base (362)..(362): a, c, t, g, unknown or other
  modified_base (466)..(466): a, c, t, g, unknown or other
  modified_base (499)..(499): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgccccacggggacatcgtgatgacccagtctccagacctccctggctgtgtctctgggcgagcgggccaccatcaactgcaagtccagccataatctttanacagttcccaanaatagaaaactactagcttaggaccagacagacgaccaggacagcctctaggctgctnatttcnggcatccgaccggatccgggtcccctggacatcagtcggcnggcggtntaggggacagtactttcactctacaccatcagcacgcctgcaggctagaagatggggtggtactagtttatagttgtactaaataattattattatacttcggngtacgttcggacgttaaggacaaaggttgattntcaagaacgaatgttcgccttgaacc

SEQ ID NO: 429037 - DNA, 644 bp, Homo sapiens
  misc_feature: GZ8MTXP01AXGWU.19.71.G05.1.454.CMB.2.raw
  modified_base (247)..(247): a, c, t, g, unknown or other
  modified_base (328)..(328): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccggggccacgatacgaactgactaaagtccagccacaattcttttaanacagttaccaactaatacgaaactactagcttagacagacagacgaccaggacacgcctacgaggctgctactatttacgnggactacgtaccgtaaccgggtacgtcccggggtcccctacggacgtatcgaggtcgggacgaacgggtcgggtcgtacgggactaggttactttacacctctaccacctactcgacgacgacgaccgtcgacgacgacgtacgtaagtagtacggggtaggtacgttagtttagttagttacgtactaactaaattaattaattacttacgttcgttaacggtacggttacggtacggttaacgggtaacggtaacggttacggttacgttacgtaacgtacgtaacgtacgtacggttacggtcgttcgtaacg

SEQ ID NO: 429038 - DNA, 554 bp, Homo sapiens
  misc_feature: GZ8MTXP01DQQJB.19.71.G05.1.454.CMB.2.raw
  modified_base (235)..(235): a, c, t, g, unknown or other
  modified_base (304)..(304): a, c, t, g, unknown or other
  modified_base (311)..(311): a, c, t, g, unknown or other
  modified_base (338)..(338): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctggggcgagcgggccaccatcaactgcaagtccagccacaatcttttanacagttaccaaacaatagaaaactacttagcttggtaccagcagagaccaggacagcctcaggctgctnatttacnggcatcgtaccggatccggggtccccngacgattcagtgcaaggcgggtctagggacagatttcactctcaccatcagcagcctgcaggctgaagatggggtacggctaggtttattagttgttacaaataaattattattattaacgttcggttggtaacgtttcggaccgttaaaggggtaccctaagggttaggattaactcaaaggtaacgtaaacgtggttacggtccttggtaaccc

SEQ ID NO: 429039 - DNA, 732 bp, Homo sapiens
  misc_feature: GZ8MTXP01EHD32.19.71.G05.1.454.CMB.2.raw
  modified_base (247)..(247): a, c, t, g, unknown or other
  modified_base (329)..(329): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgaggggacatcgtgatgacccagtctccagactccctggctgtgtctcgtgggcgagccgggccacgatacgaactgacaagtccagccaactaattcttttaanactacttaccaataatagaaaactacttagcttagacagacagacgaccgagacacgcctacgagctgctactagtttacgnggactacgttacccggtaacccggggtacgtccccggggtaccccctacggaaccgtagttccgacggtcgggacgtaacggggtccgggtacggtacgggtaacctaggtttactttaccgaccttacctaccaaccgtactaccgaacgaccgtacgtccgtaggaccgaggacgtaaggtaaagtgttacgggggtacggttaacgtttaagtttttaacgttaagttaaccgtaaactaaaacgtttaaatttaacgtttaatttaacgttacgtttcggtaacgggttaaccggttaccgggaaaccggttaaacgggtaccgttaaaggggttacgttaacgttaacgtaacgaacggtaacgtaacggttcggttacggtaaccgttaacgtaacc

SEQ ID NO: 429040 - DNA, 643 bp, Homo sapiens
  misc_feature: GZ8MTXP01BK1PA.19.71.G05.1.454.CMB.2.raw
  modified_base (235)..(235): a, c, t, g, unknown or other
  modified_base (244)..(244): a, c, t, g, unknown or other
  modified_base (253)..(253): a, c, t, g, unknown or other
  modified_base (255)..(255): a, c, t, g, unknown or other
  modified_base (257)..(257): a, c, t, g, unknown or other
  modified_base (267)..(267): a, c, t, g, unknown or other
  modified_base (274)..(274): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtggggcgagccggggccacgatacgaactgacaagtccagccanaatctttanacatacaanananaaactatagntgacagnagacgaccagacacgtccctaccgtaggctgccttactacgtttacgcgggtacctacgttcccggtaacccggggacggttccccggggtaccccctacggaccgtagttcgacggtcggacgcggtcgggtcggtacgggacgtagtacttactactactacacactacacgacgacgtccgtcgacgacggacgtagtaagtagtagggtggtacgttagtttagttattagtactaacttaattaatttaattaacttacgttcggttaacggttacggttaccggtaccggaacggtaacggtaacggttaggttagttacgtaacgtacgtaacgtacgtacgttacggtaacgttcgtaacg

SEQ ID NO: 429041 - DNA, 678 bp, Homo sapiens
  misc_feature: GZ8MTXP01C3DQZ.19.71.G05.1.454.CMB.2.raw
  modified_base (246)..(246): a, c, t, g, unknown or other
  modified_base (255)..(255): a, c, t, g, unknown or other
  modified_base (320)..(320): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccggggccacgatacgaactgactaagccagccacaattctttaanacatacaanaatagaaactatagctagacagacagacgacgagacacgcctacgagctgactactagtttacgnggactacgtaccggtaacccgggtacgtccccggggtacccctaggtaaccgtagttaccgaggtacgggacgtcgggtccgggtacgtacggggaactagtactttaccaccttcctaccaacctacacgacgacgacgtaccgtcgacgacgtacgtaacgtaagtagtaggggtacggtacgttaagtttagtttaacgttaacgtaactaaacttaaattaaatttaactttaacgttacgttacggttaacggttaacggttaccggtaaccggttaaacggtaaacggtaacggttaggttacgttacgtaacgtaacgtaacgtaacgtacggttacggtcgttcgtaacg

SEQ ID NO: 429042 - DNA, 518 bp, Homo sapiens
  misc_feature: GZ8MTXP01CP1UU.19.71.G05.1.454.CMB.2.raw
  modified_base (234)..(234): a, c, t, g, unknown or other
  modified_base (244)..(244): a, c, t, g, unknown or other
  modified_base (255)..(255): a, c, t, g, unknown or other
  modified_base (337)..(337): a, c, t, g, unknown or other
  modified_base (342)..(342): a, c, t, g, unknown or other
  modified_base (351)..(351): a, c, t, g, unknown or other
  modified_base (377)..(377): a, c, t, g, unknown or other
  modified_base (381)..(381): a, c, t, g, unknown or other
  modified_base (384)..(385): a, c, t, g, unknown or other
  modified_base (391)..(391): a, c, t, g, unknown or other
  modified_base (398)..(398): a, c, t, g, unknown or other
  modified_base (495)..(495): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccggggccacgatacgaacgtgacaagtccagccanaatcttttanacagttccaanatgaaaactcttagcttggaccagcagagaccaggacagcctctaggctgctcatttacggcatcgaccggatccggtcccngactntcgagtgcnggcggtcgaggacagtacttcactcncacntcnncacgcncgcgagngagagagtggtgtagtagttattatatactaataatattattattacgttgtcgtacgttacggtacgaacggtaacgtaggttagttattagtaanagaacgacgtgttgtcgttcgtc

SEQ ID NO: 429043 - DNA, 521 bp, Homo sapiens
  misc_feature: GZ8MTXP01DR210.19.71.G05.1.454.CMB.2.raw
  modified_base (234)..(234): a, c, t, g, unknown or other
  modified_base (305)..(305): a, c, t, g, unknown or other
  modified_base (355)..(355): a, c, t, g, unknown or other
  modified_base (362)..(362): a, c, t, g, unknown or other
  modified_base (402)..(402): a, c, t, g, unknown or other
  modified_base (424)..(424): a, c, t, g, unknown or other
  modified_base (508)..(508): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtccagccacaatctttanacagttccaaacatgaaaactctagctggaccagcaagagaccaggacagcctctaggctgctcatttacngggcatcgtacccggatccggggtccctgaccgattcagtgcagcgggtntgggacngtattcactctcacatcagcagtcctgcaggctagaagtntgtaggggctagtttatagttntcaataattattattatacttgtggtaacgttcgggactaaaggggacctaaagggtgaattgttacgaaggaacaacgttggngccgtgcctaacc

SEQ ID NO: 429044 - DNA, 504 bp, Homo sapiens
  misc_feature: GZ8MTXP01DKJ7Q.19.71.G05.1.454.CMB.2.raw
  modified_base (237)..(237): a, c, t, g, unknown or other
  modified_base (311)..(311): a, c, t, g, unknown or other
  modified_base (431)..(431): a, c, t, g, unknown or other
  modified_base (484)..(484): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctagatctctggtgcccacggggacatcgtgatgacccagtctccagactccctggctgtgtctctgggcgagcgggccaccatcaactgcaagtccagccacaatctttanacagttccaacaatgaaaactactagcttggtaccagcagagaccaggacagcctcctaggctgctcatttacngggcatctacccgggaatccccggggtccctgaccgattcaagtgcagcgggtctgggacagatttcactctcacatcagcagcctgcaggctgaagagtgtggctagtttattattgtnaaacaattattattatacttcgtggacgttcggctaagggaccaaggttgatntacaagacgaattgtggctg

SEQ ID NO: 429045 - DNA, 564 bp, Homo sapiens
  misc_feature: GZ8MTXP01CM481.19.71.G05.1.454.CMB.2.raw
  modified_base (238)..(238): a, c, t, g, unknown or other
  modified_base (249)..(249): a, c, t, g, unknown or other
  modified_base (259)..(259): a, c, t, g, unknown or other
  modified_base (309)..(309): a, c, t, g, unknown or other
  modified_base (365)..(365): a, c, t, g, unknown or other
  modified_base (455)..(455): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccacgatacgaactgacaagtccagccacaatctttanacagttccaanaatgaaactntagctggaccagcagagaccaggacagcctctaggctgctctatttaccngggcatcctacccgggaatcccggggtcctgaccgtattcagtgaccaggcgggtntcgggacagtactttcactctacaccatcagcagcctgcgaggcagaagtagtgtggggctagtttataattgtacaataattattattntacttcggtggtaacgttcggacccgtaaagggaccgtaaagggtgggttaagttcttaccgaagggtaaccgtaacgtagggttaccgggttacgtaacgccgtaacg

SEQ ID NO: 429046 - DNA, 514 bp, Homo sapiens
  misc_feature: GZ8MTXP01DMMND.19.71.G05.1.454.CMB.2.raw
  modified_base (477)..(477): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctggggaaggacagtatttcaattgtccaaacacgtaggaaataacaaattatgcaccatctgttgagagtcgaatgacaatcaaacgtagacacatacgaaagaacctagttcctcctgcagtctgacctctgttcgacttcccgaggcgacggggttnttataattacgtgtaggaagacggtccccaagtaacg

SEQ ID NO: 429047 - DNA, 523 bp, Homo sapiens
  misc_feature: GZ8MTXP01ACT25.19.71.G05.1.454.CMB.2.raw
  modified_base (440)..(440): a, c, t, g, unknown or other
  modified_base (483)..(483): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccgggggacagagtcgctagcgacagtgttgcttggcacgtgggtcaggcagtccccatcgagaggtctagagtggctaggggaaggacagtatttcaatgtcccaaacacgtagggaaatacaaattatagacaccatcgtagttgagagtcgactagaacaatacaacgtagacacaatacgaagaaccagttcncctgcagctcgactctgttgccgttaccgaggacacggggttnttacgttaattacgtggtacggagacgccccgaagtaacg

SEQ ID NO: 429048 - DNA, 525 bp, Homo sapiens
  misc_feature: GZ8MTXP01DNB6P.19.71.G05.1.454.CMB.2.raw
  modified_base (236)..(236): a, c, t, g, unknown or other
  modified_base (312)..(312): a, c, t, g, unknown or other
  modified_base (337)..(337): a, c, t, g, unknown or other
  modified_base (342)..(342): a, c, t, g, unknown or other
  modified_base (350)..(350): a, c, t, g, unknown or other
  modified_base (358)..(358): a, c, t, g, unknown or other
  modified_base (380)..(380): a, c, t, g, unknown or other
  modified_base (502)..(502): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcaactgcaagtccagccacaatctttanacagttccaaacaatgaaaactacttagcttggtaccagcagagaccaggacagcctctaggctgctcatttacgnggcatccgaccggagtccggtcccngactntcagtgcnggcggtgngggacagtcttcactctcacancagcacgctcgcgacgcgagagtagtgggtgtgttagtttattattagtactaataaattattattattacgttcgtgtacgttacggtacgaacggtaacgtaaggttagttattagtaanagaacgacgtgttgtcgttcgtc

SEQ ID NO: 429049 - DNA, 571 bp, Homo sapiens
  misc_feature: GZ8MTXP01B3D5X.19.71.G05.1.454.CMB.2.raw
  modified_base (224)..(224): a, c, t, g, unknown or other
tcagtactctcgtgcacgaccggtgctcgatttagtgtcgtcgcaagagagaggggggcagagtctgctgaattctggttgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctntcgctcacctgtgccatctccggggacagagtcgctagcgacagtgttgcttggcactgggtcaggcagtccccatcgagaggtctagagtggcgtgggaacggacatatttcatgtaccaacacgtagaaatacaaattatgacacctatctgtgagagtacgatgaactaatacaacgtagaccaagaacgtacgaaagaaccgtagttccctccctagcctaagtccttacgaacccttcgtaacggtcgttaccgtaccccggagggaccgtaacgggttggttattaacgtttaacgtgggtaacggaaacggaccggacccccgtaagttaacggtaaccg

SEQ ID NO: 429050 - DNA, 593 bp, Homo sapiens
  misc_feature: GZ8MTXP01ARU4X.19.71.G05.1.454.CMB.2.raw
  modified_base (227)..(227): a, c, t, g, unknown or other
  modified_base (236)..(236): a, c, t, g, unknown or other
  modified_base (245)..(245): a, c, t, g, unknown or other
  modified_base (249)..(249): a, c, t, g, unknown or other
  modified_base (305)..(305): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactcctggctgtgtctctgggcgagcgggccacatcaactgacaagtccagccanaatctttanacatacaanatanaaactactagctagacagacagacacagacacgcctctagctgctactatttacgnggactacgtaccgtaacccgggacgtcccggggtccccctaggaccgtagttcgaggtcggacgaagggtccgggtcgtagggactagtactttacactctacaccatacgagcacgcctcgcgacgacgtagaagagtaggtgtagtagttattattacgtactaaactaaattaattaattaacttacgttacgtaacggtacggttacggtaccggaaacggtaacggtaaggttaggttagttagtaacgacgaacgtaacgtacgttacggtcgttcgtaacg

SEQ ID NO: 429051 - DNA, 630 bp, Homo sapiens
  misc_feature: GZ8MTXP01DWZR2.19.71.G05.1.454.CMB.2.raw
  modified_base (243)..(243): a, c, t, g, unknown or other
  modified_base (316)..(316): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctcgtggggcgagccgggccaccgatcaactgcaagtccagccactaattctttanacagttccaacaatgaaaactctagcttggtaccagcagacgaccaggacagcctcaggctgctcattttacngggctacgtccgtacccggggaacttccccccgggggtcccctaggacccgtatttccgaaagggttcgggcgtaaggggtcccggggttactagggggaacctaggtacttttcccacttcctaccaacctatccaagccacgccctgcaggctagaagagtggtggacttagtttatattagtaccaaaataattatttaattacgttacgttaacggttcggttaacggttcggaaacccgtaaaggggtaacccgaagggttcgggaattaagtacgaaggtaaccgtaacgttggtaacggcgtaaccg

SEQ ID NO: 429052 - DNA, 521 bp, Homo sapiens
  misc_feature: GZ8MTXP01D3DOO.19.71.G05.1.454.CMB.2.raw
  modified_base (236)..(236): a, c, t, g, unknown or other
  modified_base (335)..(335): a, c, t, g, unknown or other
  modified_base (349)..(349): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatctttanacagttccaaacaatagaaaactacttagcttggtaccagcagagaccagacagcctctaggctgctcatttactggcatctaccggatccgggtcccngacgattcagtgcnggcgggtctgggacagatttcactctcacatcagcagcctgcaggctagaagattgggtggtctagtttattattgtcaaataaattattaattattacttcgtaagtacgttcggaccttaaagggaccgaaggttggattatcaagaacgtaactgttaggtcttgaacc

SEQ ID NO: 429053 - DNA, 579 bp, Homo sapiens
  misc_feature: GZ8MTXP01BS6IX.19.71.G05.1.454.CMB.2.raw
  modified_base (243)..(243): a, c, t, g, unknown or other
  modified_base (253)..(253): a, c, t, g, unknown or other
  modified_base (257)..(257): a, c, t, g, unknown or other
  modified_base (317)..(317): a, c, t, g, unknown or other
  modified_base (372)..(372): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacgatacgactgactaagtccagcactaatctttaanactatacaanatanaaactctagctagacagacagacgaccgagacacgcctacgtagctgctactagtttcgnggactacgtccgtaccgggacgtcccgggtccccaggacgtatcgaggtcgacgnggtcgggtgtacgggactagtacttcactctacacatacacgacacgcgcgcgacgacgagagtagtgggtagtagtagtttattagttacgtactaactaattattattacttacgttacgtaacggtacggttacggtacggaacggtaacggtaaggttagttagttacgtaagagaacgtacgtagttacgtcgttcgtaacg

SEQ ID NO: 429054 - DNA, 632 bp, Homo sapiens
  misc_feature: GZ8MTXP01CKSF1.19.71.G05.1.454.CMB.2.raw
  modified_base (240)..(240): a, c, t, g, unknown or other
  modified_base (250)..(250): a, c, t, g, unknown or other
  modified_base (255)..(255): a, c, t, g, unknown or other
  modified_base (261)..(261): a, c, t, g, unknown or other
  modified_base (264)..(264): a, c, t, g, unknown or other
  modified_base (315)..(315): a, c, t, g, unknown or other
  modified_base (383)..(383): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcggccaccagtcaactgacaagtccagccacaatctttaanacataccaanaatanaaactntanctagacagacagacgaccagacacgtcctcgtagctgctactactttacgnggactacgttaccggtaacccgggtacgtcccggggtcccctacggaccgtattccgaggtcggacgngggtcgggtcgagggactagtactttcactctaccacctatcgacgacgacgtaccgtcgacgacggacgtacgagtagtacggggtggtacgttagtttaagttattacgtactaaactaaattaattaattaacttacgttacggttaacggttacggttaccggtaccggttaaacgggtaacggtaacggttaggttagttacgtaacgtacgtaacgtaacgtacggttacgtcgttcgtaacg

SEQ ID NO: 429055 - DNA, 615 bp, Homo sapiens
  misc_feature: GZ8MTXP01BOALT.19.71.G05.1.454.CMB.2.raw
  modified_base (239)..(239): a, c, t, g, unknown or other
  modified_base (252)..(252): a, c, t, g, unknown or other
  modified_base (321)..(321): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccacgatacgaactgacaagtccagccacaatcttttaanactactaccaaanaatagaaactactagctagaccagacagacgaccgaggacacgcctacgtaggctgctactatttacgnggctacgtccgtaaccggacgtcccgggtccccagaccgtatcgaggtcgacgcgggtcgggtcgagggactagtactttcactctacacctatcacgacgacgcgtcgacgacgacgtagaagtagtgggtcggtacgttagtttagtttagttagtaactaaacttaaattaatttaattaacttacgttacggttaacggttacggttaccggtaccggaacgggtaacggtaagggttaggttacgttacgtaacgtacgtaacgtacgtaggttacgtcgttcgtaacg

SEQ ID NO: 429056 - DNA, 575 bp, Homo sapiens
  misc_feature: GZ8MTXP01CZ4XP.19.71.G05.1.454.CMB.2.raw
  modified_base (241)..(241): a, c, t, g, unknown or other
  modified_base (251)..(251): a, c, t, g, unknown or other
  modified_base (255)..(255): a, c, t, g, unknown or other
  modified_base (278)..(278): a, c, t, g, unknown or other
  modified_base (311)..(311): a, c, t, g, unknown or other
  modified_base (352)..(352): a, c, t, g, unknown or other
  modified_base (365)..(365): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccacgatacgaactgacaagtccagcacaattctttaanactatacaanatanaaactatagctagacagacaganacgagacacgcctacgagctgctctatttacgnggactagtaccgtaccggacgtccgggtaccccaggacgtntacgagtcgacgnggtcggtcgagggactagtcttcactcctacacatcacgacgacgcgtcgcgacgcgagagtagtagggtcgtagttagtttagttattagtactaataattaattattagttacgttcgtcggtacggttacggtacggaacggtaaacggtaaggttagttagttacgtaacgtacgtaacgtacgtaggttacggtcgttcgtaacg

SEQ ID NO: 429057 - DNA, 645 bp, Homo sapiens
  misc_feature: GZ8MTXP01DNX0N.19.71.G05.1.454.CMB.2.raw
  modified_base (239)..(239): a, c, t, g, unknown or other
  modified_base (248)..(248): a, c, t, g, unknown or other
  modified_base (252)..(252): a, c, t, g, unknown or other
  modified_base (258)..(258): a, c, t, g, unknown or other
  modified_base (309)..(309): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagactccctggctgtgtctctgggcagcgggccacgatcgaactgacaagtccagccaacaattctttanacatacaanatanaaactntagcttgacagacagacaccagacagcctacgagctgctactagtttacgnggactacgttacccgtaaccgggacgtccccggggtcccctacggtaccgtattccgacggtcggacgtgggtcgggtacgtagggactagtactttcactctacaccatcgacgacgacgcgtcgacgacgtacgtacgtaagtagttacgggtacggtacgttaagtttagtttacgttacgttaacgtaaacgttaaattaatttaatttaacgttacgttacggttaacggtaacggttaccggtaccggttaaacggtaacggtaacggttaacggttacgttaacgtaacgtaacgtaacgtaacgtacggttacggtcgttcgtaaccg

SEQ ID NO: 429058 - DNA, 597 bp, Homo sapiens
  misc_feature: GZ8MTXP01DF54Y.19.71.G05.1.454.CMB.2.raw
  modified_base (243)..(243): a, c, t, g, unknown or other
  modified_base (252)..(252): a, c, t, g, unknown or other
  modified_base (256)..(256): a, c, t, g, unknown or other
  modified_base (262)..(262): a, c, t, g, unknown or other
  modified_base (266)..(266): a, c, t, g, unknown or other
  modified_base (279)..(279): a, c, t, g, unknown or other
  modified_base (310)..(310): a, c, t, g, unknown or other
  modified_base (365)..(365): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctggggcgagcggggccacgatacgaactgacaagtccagccacaatctttaanacatacaanatanaaactntagntagacagacaganacagacagcctcgagctgctactatttacgnggactagtaccgtaccgggacgtccgggtcccctaggacgtatcgaggtcgacgnggcggtcgtagggactagtacttcactctacacagtcagacacgctacgacgacgacgtagagtagtagggtggtacgttagtttattattagtactaaactaaattaattaattaattacgttacggttaacggttacggttacggtaccggttaaacgggtaaacggtaacggttaggttagttacgtaacgtaacgtaacgtaacgtacggttacggtcgttcgtaacg

SEQ ID NO: 429059 - DNA, 591 bp, Homo sapiens
  misc_feature: GZ8MTXP01EKZKJ.19.71.G05.1.454.CMB.2.raw
  modified_base (236)..(236): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgacaagtccagccacaatctttanacagttccaaacaatagaaaactctagctgaccagcagagaccaggacagcctcgtaggctgctactatttacgtgggactagtccgtaacccgggaagtcccgggggtccctacggacccgtattcgaggtcggacaggcgggtctgggacagtactttcactctcacatcagcagcctgcaggacagaagtagtggtacgggtacttaagtttattagttacgaaactaaacttaatttaatttaattaacttacgttcggtagggtaacgttacggacggtaaacggacgtaagggtacgttagttacgttacgaaggtaacgtaacggtggtacggttactcgaactaacg

SEQ ID NO: 429060 - DNA, 611 bp, Homo sapiens
  misc_feature: GZ8MTXP01CS7M7.19.71.G05.1.454.CMB.2.raw
  modified_base (244)..(244): a, c, t, g, unknown or other
  modified_base (324)..(324): a, c, t, g, unknown or other
  modified_base (367)..(367): a, c, t, g, unknown or other
  modified_base (380)..(380): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagccgggccacatcaactgacaagtccagccactaattctttaanacagttaccaaacaatagaaactacttagcttaggaccagcagagaccaggacacgcctctaggctgctactatttacgnggcagtccgtaaccgggagtcccggggtccccctaggaccgtnttacgaggtcgcnggcgggtacgtgggactagtctttcactctacaccatcagcagtcctgcaggctaggaagtgtggggtggtacttaagtttattagttgaactaaattaaatttattaatttacgttacgtttggtcggtaaccggtttcggaacccgaaaggggttaacctaaggggttacggttaattacggttaaccgaaggtaaccgttacgttggttcgggtccttaacggaaccc

SEQ ID NO: 429061 - DNA, 595 bp, Homo sapiens
  misc_feature: GZ8MTXP01BQN54.19.71.G05.1.454.CMB.2.raw
  modified_base (240)..(240): a, c, t, g, unknown or other
  modified_base (314)..(314): a, c, t, g, unknown or other
  modified_base (339)..(339): a, c, t, g, unknown or other
  modified_base (356)..(356): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcaactgacaagtccagccacaattcttttanacagttccaaacaatgaaaactcttagcttggaccagcagagaccaggacagcctctaggctgctcatttacgngcatcgtaccggatccgggtccccngacgtatcgagtcggcnggcgggtcgtgggactagtactttcacttctacaccatcagcgacgcctgacgaggtctaggaagtgtggggtacggtagttaagtttattacgttacgtaactaaactaaatttaattaagtttaacttacgttcggtaagggtacgttacgggaccgttaaacgggtaaccgtaagggttcgttaattacgtaacgaacggtaacgtaacgtacggttacggtcgttaacgtaaccg

SEQ ID NO: 429062 - DNA, 657 bp, Homo sapiens
  misc_feature: GZ8MTXP01DZT1F.19.71.G05.1.454.CMB.2.raw
  modified_base (221)..(221): a, c, t, g, unknown or other
  modified_base (234)..(234): a, c, t, g, unknown or other
  modified_base (252)..(252): a, c, t, g, unknown or other
  modified_base (267)..(267): a, c, t, g, unknown or other
  modified_base (274)..(274): a, c, t, g, unknown or other
  modified_base (276)..(276): a, c, t, g, unknown or other
  modified_base (280)..(280): a, c, t, g, unknown or other
  modified_base (286)..(286): a, c, t, g, unknown or other
  modified_base (289)..(289): a, c, t, g, unknown or other
  modified_base (298)..(298): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggcctacgatacgactnactaagcagccanatcttagacagttccaanatagaaactactagntgtacananaganacaganacnctcacgctntctactattacgtcgactacgtaccgtaccggtacggtccccggtccgtacgtacgtactacgtaacgtacggcgacggtcgggtcggtacggacgtacgtacttactactacctacctacctactacgacgacgacgtaccgtacgacgacggtacgtaagtaagtacgggtacggtacggtacgtttaagtttaagtttagttacgttaacgtaaacttaaacttaatttaactttaacgttacgtttaacggttacggttaccgggttaccggttaaccggtaaacgggtaacggttaacggttaggttaacgtaacgtacgtaacgtaacggtacgttacggtcggttcgtaacg

SEQ ID NO: 429063 - DNA, 592 bp, Homo sapiens
  misc_feature: GZ8MTXP01ERT3Q.19.71.G05.1.454.CMB.2.raw
  modified_base (246)..(246): a, c, t, g, unknown or other
  modified_base (326)..(326): a, c, t, g, unknown or other
  modified_base (371)..(371): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctggggcgagccgggccaccgatacaactgacaagtccagccaacaattctttaanacagttaccaaacaatagaaaactacttagcttaggaccagcagagaccaggacagccctctaggctgctcatttaccgnggacacgtccgaccggacgtccgggtcccagacatcgagtcgcgnggtcggtcgaggacagtcttcactctacacatcagcacgtctagacgaggactaagaagtagttgggggtacgttacgtttaagtttaagttattacgtaactaaattaatttatttaatttacgttacgttcggtaacggtacgttacgggaacgttaaacgggtacgtaagggttagacttacgtaacgaacgtaacgtagtggttacgtcgttcgaac

SEQ ID NO: 429064 - DNA, 670 bp, Homo sapiens
  misc_feature: GZ8MTXP01CW8YX.19.71.G05.1.454.CMB.2.raw
  modified_base (246)..(246): a, c, t, g, unknown or other
  modified_base (258)..(258): a, c, t, g, unknown or other
  modified_base (290)..(290): a, c, t, g, unknown or other
  modified_base (365)..(365): a, c, t, g, unknown or other
  modified_base (369)..(369): a, c, t, g, unknown or other
  modified_base (377)..(377): a, c, t, g, unknown or other
  modified_base (388)..(388): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggccgggccacgatacgaactgacaagtccagccacaattctttanacagttaccaanaatgaaaactcttaagcttaggaccagcaganaccaggacagcctccgtagctgctctatttacgtggcagtccgaacccgggatcccggggtccccctggaccgtntcgnggtcgcgnggtcgggtcgngggacagtacttcactcctacacctactcacgacgacgccgtcgacgacgacgtagtaagtaggtacggggtacggtacgtttaacgtttaagtttaacgtttaacgttaacgtaaacttaaatttaaacttttaaacgtttaacgtttaacgtttacggttaacgggttaaccgggttaccgggtaaccgggttaaacgggtaaacggtaacgggttaacggttacgttaacgtaacgtaacggtaacgtaacggtacggttacggtaacgttcgtaaccg

SEQ ID NO: 429065 - DNA, 583 bp, Homo sapiens
  misc_feature: GZ8MTXP01ALCV0.19.71.G05.1.454.CMB.2.raw
  modified_base (242)..(242): a, c, t, g, unknown or other
  modified_base (316)..(316): a, c, t, g, unknown or other
  modified_base (365)..(365): a, c, t, g, unknown or other
  modified_base (423)..(423): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccacgatacgaactgacaagtccagccacaatctttanacagttaccaacaatgaaaactctagcttggaccagcagagaccaggacagccctctaggctgctcatttacgnggctataccgtaccggacgtccgggtccccagacgtatcgaggtcgcgnggcgggtcgagggactagtacttccactcctacactatacagcacgccacgcgacggngtagagtagtgggtgtagttagtttattattagtactaactaattattaatttacttacgttcggttaacggtacggttacggtacggttaacgggtaacggtaaggttaggttagttacgtaacgtacgtaacgtacgtacggttacggtcgttcgtcg

SEQ ID NO: 429066 - DNA, 522 bp, Homo sapiens
  misc_feature: GZ8MTXP01EV3CA.19.71.G05.1.454.CMB.2.raw
  modified_base (485)..(485): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgcccctcgcagaccctctcgctcacctgtgcccatcgtccggggacagagtcgctagcgacagtgttgcttggcacgtggtcaggcagtccccatcgagaggtctagagtggctgggaagacatattcaatgtccaaacacgtaggaatacaaattatgcacatactgttagagagtcgactagaacaatacaaacgtagaacgacaagtacgaaacgaacctagttcctccctagcagctcgacctctcgttgaccttcccgaggacgacgggttnttattaattacgtgtaggacgacggccccgaataacg

SEQ ID NO: 429067 - DNA, 625 bp, Homo sapiens
  misc_feature: GZ8MTXP01CB8C5.19.71.G05.1.454.CMB.2.raw
  modified_base (235)..(235): a, c, t, g, unknown or other
  modified_base (315)..(315): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcaactgacaagtccagccacaattctttanacagttaccaaacaatgaaaactacttaagcttaggaccagcagacgaccaggacagcctcctaggctgctcatttacgngcactacgtacggacgtccggtcccctacgactatcgaggtcgacgcgggtcgggtcgacgggactagtactttccactacctacaactactcgacgacgacgtccgtacgacgacgacgtagaagtagtacggggtacggtacgttaagtttaagtttagttacgttaactaaacttaaattaatttaatttaacttacgttacggttaacggttacggttacggtaacggttaaacggtaaacggtaacggttaggttagttacgtaacgtaacgtaacgtaacgtacggttacggtcgttcgtaacg

SEQ ID NO: 429068 - DNA, 588 bp, Homo sapiens
  misc_feature: GZ8MTXP01BTJEV.19.71.G05.1.454.CMB.2.raw
  modified_base (242)..(242): a, c, t, g, unknown or other
  modified_base (328)..(328): a, c, t, g, unknown or other
  modified_base (434)..(434): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgcaagtccagccacaattcttttaanactacgttaccaaactaatagaaaactacttagctacgacagcaagacgaccagacacgtcctacgtagctcgctactatttacgnggactacgtaccgtaacccgggtacgtcccggggtacccctacggaccgtattacgaggtcggacgcgggtcgggtcgtagggactagtacttcactctacaccancagcacgctgcagctagaagtgtggggtagtacttaatttattagtagtaactaaataattattaattattacgttggtaacggtacgttcggaacgaaagggtacgtaagggttgttacttacgtaacgagtaacgtagtgttacgtcgttgc

SEQ ID NO: 429069 - DNA, 522 bp, Homo sapiens
  misc_feature: GZ8MTXP01C205M.19.71.G05.1.454.CMB.2.raw
  modified_base (237)..(237): a, c, t, g, unknown or other
  modified_base (308)..(308): a, c, t, g, unknown or other
  modified_base (315)..(315): a, c, t, g, unknown or other
  modified_base (344)..(344): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgcaagtccagccacaatctttanacagttaccaaacaatagaaaactattagcttaggtaccagacagagaccaggacagcctctaggctgctnatttacnggcatccgtaccgggatccggggtccccngacgattcagtggcaaggcgggtctgggacagactttcactctcaccatcagcagcctgcagctgaagatgggtggctagtttatattgtacaataatattattatacttgtggtacgttcggacgaaagggacctaaggttagattaacgtcgaagtaacgaatgaggtcttgaacc

SEQ ID NO: 429070 - DNA, 625 bp, Homo sapiens
  misc_feature: GZ8MTXP01C9SIQ.19.71.G05.1.454.CMB.2.raw
  modified_base (229)..(229): a, c, t, g, unknown or other
  modified_base (240)..(240): a, c, t, g, unknown or other
  modified_base (249)..(249): a, c, t, g, unknown or other
  modified_base (254)..(254): a, c, t, g, unknown or other
  modified_base (311)..(311): a, c, t, g, unknown or other
tcagtactctcgtgcacgaccggtgctcgatttagtgtcgtcgcaagagagaggggggaggtacaacaggcagacaggggcagcaagatggtgttgcagacccaggtcttcatttctctgttgctctggatctctggtgcccaggggacatcgtgatgacccagtctccagacctccctggctgtgtctctgggcgaggcgggccacatcaactgacaagtccagccanaattctttaanacatacaanaatanaaactatagctagacagacagacgaccagacacgcctacagctgctactatttacgnggactacgtaccgtaacccgggtacgtccccggggtcccctaggaccgtagttcgaggtcggacgtcgggtcgggtacgtagggactagtactttaccaccttctaccaaccatcacgcacgtcctgcgagtactagaagtgtggggtagtacttaagtttattagttagtaactaaattaaattagtttaattacgtacgtttcggtaacggtaaccggttacgggaaaccgttaaacggggtaaaccgtaagggttagttagttaacgtaacgtaaggtaaccgtaagttggttacggtcgttaacgaaccg

SEQ ID NO: 429071 - DNA, 564 bp, Homo sapiens
  misc_feature: GZ8MTXP01D6691.19.71.G05.1.454.CMB.2.raw
  modified_base (237)..(237): a, c, t, g, unknown or other
  modified_base (246)..(246): a, c, t, g, unknown or other
  modified_base (248)..(248): a, c, t, g, unknown or other
  modified_base (250)..(250): a, c, t, g, unknown or other
  modified_base (256)..(256): a, c, t, g, unknown or other
  modified_base (259)..(259): a, c, t, g, unknown or other
  modified_base (271)..(271): a, c, t, g, unknown or other
  modified_base (302)..(302): a, c, t, g, unknown or other
  modified_base (350)..(350): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacatacaanananaaactntanctgacagcaganacagacagcctcgtagctgctctatttacgnggcactccgtaccggacgtccgggtcccccaggacgattcgagtcgcnggcgggtctgggacagtacttcactctacacatcagcacgcctgacgaggtcgtagaaagtgttggggtacgtacttaagtttattagttcgtaactaaacttaaattattaacgttaattacgttggtaacggtacgttcggaaccgaaagggaaccgtaagggttgttaacttacgtaacgaagtaacgtaacgtagttacgtcgttcgtcg

SEQ ID NO: 429072 - DNA, 541 bp, Homo sapiens
  misc_feature: GZ8MTXP01EFSD9.19.71.G05.1.454.CMB.2.raw
  modified_base (244)..(244): a, c, t, g, unknown or other
  modified_base (302)..(302): a, c, t, g, unknown or other
  modified_base (313)..(313): a, c, t, g, unknown or other
  modified_base (380)..(380): a, c, t, g, unknown or other
  modified_base (388)..(388): a, c, t, g, unknown or other
  modified_base (393)..(393): a, c, t, g, unknown or other
  modified_base (411)..(413): a, c, t, g, unknown or other
  modified_base (416)..(416): a, c, t, g, unknown or other
  modified_base (420)..(420): a, c, t, g, unknown or other
  modified_base (442)..(442): a, c, t, g, unknown or other
  modified_base (520)..(520): a, c, t, g, unknown or other
  modified_base (522)..(522): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatccaactgacaagtccagccaacaattcttttanacagttaccaaacatagaaaactctagcttaggaccagcagacgaccaggacacgccncgtagctgctnatttacgtgggacactccgtacccgggaagtccccccggggtccctagacccgtattcgaagtggcnggcgggtncgggntagcttacactcacacannnacncgcncgacgagagtagagagtgtgtntattattattatactaataattaattattattacgtcgtcggttacgtacgacgtaacggaacgaggttgttagtaananaagacgagttagtcgcgtg

SEQ ID NO: 429073 - DNA, 544 bp, Homo sapiens
  misc_feature: GZ8MTXP01DIS3O.19.71.G05.1.454.CMB.2.raw
tcagtactctcgtgcacgaccggtgctcgatttagtgtcgtcgcaagagagagggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcacgtggcttttaggcagtccccatcgagaggtctagagtggcgtggggaaggacagtatttcaatgtccaaacacgtaggaaataacaaattatgacaccatctgttgagagtacgactgaacaatacaacgtaagaacaacaattacgaaacggaaacctacgttacctcccttacgcgagacctcgaacctctgttcgaccgttccgacggacgacgggttgttataattacgtggtaggaagacggaaccccgaagtaacg

SEQ ID NO: 429074 - DNA, 532 bp, Homo sapiens
  misc_feature: GZ8MTXP01BUSZB.19.71.G05.1.454.CMB.2.raw
  modified_base (492)..(492): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatcgtccggggacagagtcgctagcgacagtgttgcttggcacgtggtcaggcacgtccccatcgagaggtctagagtggctggggaaggactatattcaatcgtccaaacacgtgaaatacaaattatgcactatctgttgagtagtcgatgacaatacaacgtacgacgacaatacgaaacgtaacctagttcctccgtagcaagcctcgacctctgttcgaccgttcccggaaggtacgttacgggttnttagtaattactggtagggacgacggaaccccaagtaacg

SEQ ID NO: 429075 - DNA, 546 bp, Homo sapiens
  misc_feature: GZ8MTXP01DWZL3.19.71.G05.1.454.CMB.2.raw
  modified_base (228)..(228): a, c, t, g, unknown or other
  modified_base (238)..(238): a, c, t, g, unknown or other
  modified_base (367)..(367): a, c, t, g, unknown or other
  modified_base (424)..(424): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgacaagtccagccanaatcttttanacagttaccaaacaatagaaaactacttagcttaggtaccagacagagaccaggacagcctctaggctgctctatttactgggcatccgtacccgggatcccggggtcccctgaccgattcgagtggcnggcgggtctggggacagactttcactctacaccatcagcagcctgcaggctgaaagngtgggtggctaagtttattattgtacaataaattattaattattacttcggtaaggtacgttcggaccaaagggtaccaagggttagattaagaacgaagaacgtagtggttcgtcgttcgc

SEQ ID NO: 429076 - DNA, 626 bp, Homo sapiens
  misc_feature: GZ8MTXP01C0BO4.19.71.G05.1.454.CMB.2.raw
  modified_base (224)..(224): a, c, t, g, unknown or other
  modified_base (240)..(240): a, c, t, g, unknown or other
  modified_base (244)..(244): a, c, t, g, unknown or other
  modified_base (250)..(250): a, c, t, g, unknown or other
  modified_base (253)..(253): a, c, t, g, unknown or other
  modified_base (300)..(300): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgcccacggggacatcgtgatgacccagtctccagactccctggctgtgtctctgggcagcgggccacgatcgaactgacaagtccagcanatctttaacatacaanatanaaactntanctagacagcagagacagacacgcctctagctcgctactagtttacgngggacacgttaccgtaacccgggaacgtccccggggtacctacggaccgtattcgaggtcggaaccgagggtccgggtcgtaggggaactagtactttaccacttcctaccaacctactacgacgaccgacgccgtcgcgacggacgtagaagtagtagtacgggtacgttagtttaagtttagttacgtaacgtaaactaaattaatttaatttaattacgttacgttacggttaacggttacggttaccggtaacgggaacggtaacggtagttagttacgttacgtaacgaacgtaacgtagtaggttacgtcgaacgtaacg

SEQ ID NO: 429077 - DNA, 533 bp, Homo sapiens
  misc_feature: GZ8MTXP01A7S0T.19.71.G05.1.454.CMB.2.raw
  modified_base (232)..(232): a, c, t, g, unknown or other
  modified_base (500)..(500): a, c, t, g, unknown or other
  modified_base (508)..(508): a, c, t, g, unknown or other
  modified_base (523)..(523): a, c, t, g, unknown or other
  modified_base (526)..(526): a, c, t, g, unknown or other
  modified_base (528)..(533): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttacnggcatctacccgggaatccggggtccctgaccgattcagtggcaggcgggtctgggacagatttcactctcaccatcagcagcctgcaggctagagatgtggcctagttttatagtgtacaaaacaattaatttattatacgttcgtggtacgttcggaccaaggggaccaaagggtgatatcgaaggacgtaactgtaggctgacctaccagttctgttaccttcacttccgttccccgctaagtctcgactacggagtaattacgnggagcggngtggacgacggcaanagngnnnnnn

SEQ ID NO: 429078 - DNA, 532 bp, Homo sapiens
  misc_feature: GZ8MTXP01AHEM9.19.71.G05.1.454.CMB.2.raw
  modified_base (489)..(489): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatcgtccggggacagagtcgctagcgacagtgttgcttggcacgtgggtcaggcagtccccatcgagaggtctagagtggctaggggaacgacagttatttcatacgtaccaacgacgtaggaaatactaaattatgacacctatctgtgagagtacgactgaacaatacaacgtagacaacgatacgaaagaacctagtcctcctgacagtctcgacctcgtgtcgaccgtcccggagtaccgacgggttnttattattcgtaggtaaggaacgacgcccctaagttaacgaac

SEQ ID NO: 429079 - DNA, 595 bp, Homo sapiens
  misc_feature: GZ8MTXP01DKABX.19.71.G05.1.454.CMB.2.raw
  modified_base (245)..(245): a, c, t, g, unknown or other
  modified_base (324)..(324): a, c, t, g, unknown or other
  modified_base (362)..(362): a, c, t, g, unknown or other
  modified_base (372)..(372): a, c, t, g, unknown or other
  modified_base (381)..(381): a, c, t, g, unknown or other
  modified_base (407)..(407): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagactccctggctgtgtctcgtgggcgagcgggccacatcaactgacaaagtccagccactaattcttttaanactagttaccaaacaatagaaaactcttaagcttaggaaccagcagagaccagacagcctctagctgctctatttacgnggcatccgtaaccgggatcccggggtcccctggacgtntcagtcggcnggcgggtcnggggacagtacttcactctcactacncacgcacgctgacgaggctaagaagtgtggggtacgtactttaagtttattagttactaactaaattaattaatttaatttacttacggtttcggtaacggtaccggttacggaaaccggaaagggtaaccggtaaggttacgttattacgtaacgaacgtaacgagtggttcgtaaccgttcgaacc

SEQ ID NO: 429080 - DNA, 535 bp, Homo sapiens
  misc_feature: GZ8MTXP01AQ8SF.19.71.G05.1.454.CMB.2.raw
  modified_base (239)..(239): a, c, t, g, unknown or other
  modified_base (318)..(318): a, c, t, g, unknown or other
  modified_base (351)..(351): a, c, t, g, unknown or other
  modified_base (369)..(369): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanacagttaccaacaatagaaaactactagcttaggtaccagcagagaccaggacagcctcctaggctgctctatttacgngggcatccgtacccgggatcccggggtcccccnggaccgattccagtggcnggcgggtctggggacagtactttcactctcaccatcagcacgcctgcaggctagaagatgggtggctagtttattattgtacaactaatattattatcttcggtgacgttcggaccaagggacctaaggttgattataacagaacgaacgtgacgggtcttgaacc

SEQ ID NO: 429081 - DNA, 588 bp, Homo sapiens
  misc_feature: GZ8MTXP01D9QUG.19.71.G05.1.454.CMB.2.raw
  modified_base (242)..(242): a, c, t, g, unknown or other
  modified_base (253)..(253): a, c, t, g, unknown or other
  modified_base (258)..(258): a, c, t, g, unknown or other
  modified_base (264)..(264): a, c, t, g, unknown or other
  modified_base (313)..(313): a, c, t, g, unknown or other
  modified_base (351)..(351): a, c, t, g, unknown or other
  modified_base (403)..(403): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctcctggctgtgtctcgtgggcgagcggccacgatacaactgacaagtccagccataattctttanactactacaanaatanaaactntagctagacagcagacacgagacacgcctacgagctgctactagttcgnggactacgtaccgaccggacgtcccggtccctagactntcgaggtcgcgcgggtcggtagtacgggactagtcttacactcctacacacncacgcgacgctcgacgagacgtagaagtgtcggggtagttacttaagtttattattacgtaactaaattaaatttatttaagttacgttacgttcggtaacggttaccggttacggaaaccggttaaggtaaccgtaaggttagttacttacgtaacgagtaacgtagtgttacgtcgttcgaac

SEQ ID NO: 429082 - DNA, 642 bp, Homo sapiens
  misc_feature: GZ8MTXP01DSDFH.19.71.G05.1.454.CMB.2.raw
  modified_base (231)..(231): a, c, t, g, unknown or other
  modified_base (242)..(242): a, c, t, g, unknown or other
  modified_base (252)..(252): a, c, t, g, unknown or other
  modified_base (256)..(256): a, c, t, g, unknown or other
  modified_base (265)..(265): a, c, t, g, unknown or other
  modified_base (316)..(316): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggcgggccacgatacgactgacaagtccagccanaattctttaanacataccaanatanaaactatanctagacagacagacgacagacacgcctacgagctcgtctactagtttacgnggactacgtaccggtaacccgggtacgtcccgggtcctacggacctagttaccgaggtcggaacgtagggtcgggtacgtagggactagtacttacacttaccctaccaaccgtactacgacgacgacgacgtacgacgacggacgtagaagtagtagtacgggtacgttagtttagttacgttacgtaactaaactaattaattaattaattacgttacgttacggtaacggtacggttaccggtaaacggaacggtaacggtaagttacgttacgttacgtaacgtaacgtaacgtacgtacgttacgtaacgttaacgtaacg

SEQ ID NO: 429083 - DNA, 602 bp, Homo sapiens
  misc_feature: GZ8MTXP01AQSQK.19.71.G05.1.454.CMB.2.raw
  modified_base (229)..(229): a, c, t, g, unknown or other
  modified_base (241)..(241): a, c, t, g, unknown or other
  modified_base (254)..(254): a, c, t, g, unknown or other
  modified_base (433)..(433): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacaactgcaagtccagccanaattcttttaanactattaccaaanaatacgaaactactagcttacgacagacaagacgaccgaggacacgccctacgtaggctcgctactatttacgcggacctacgttacccggtaaccgggtacgttccccggggtcccctacggaccgtattcgaggtcgcgcggtcgggtcgtagggactagtacttcactctacacancacgcacgctgacgagctagagtagtggggtagtacttagtttatattagtaactaaattaattaattattacttacgttcggtaacggtacgttaccggacgttaaagggtaacgtagggttacgttattacgaacgtacgaacgtaagtcggcgtaacgttcgtaac

SEQ ID NO: 429084 - DNA, 557 bp, Homo sapiens
  misc_feature: GZ8MTXP01C8RHY.19.71.G05.1.454.CMB.2.raw
  modified_base (377)..(377): a, c, t, g, unknown or other
  modified_base (510)..(510): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccagtcgtccggggacagagtcgctagcgacagttgttgcttggcacgtggtcaggcacgtccccagtcgagaggtctagagtggcgtgggaaggactattattcaatcgtccaaacgtacgtaggaaataacaaattangacacatcgtgtagagagtcgactagaacaatacaaacgtaacgaactaacgacgtaacgaaacgaacctacgttcctacccgtgcacgtctcgactctcgttcgaccgttccggacggtacgttacgggttnttaacgtaagttacgtggtacgggaacggacgtccccgaagtaaccg

SEQ ID NO: 429085 - DNA, 591 bp, Homo sapiens
  misc_feature: GZ8MTXP01D9YPN.19.71.G05.1.454.CMB.2.raw
  modified_base (238)..(238): a, c, t, g, unknown or other
  modified_base (319)..(319): a, c, t, g, unknown or other
  modified_base (447)..(447): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttggctctggatctctggtgcccacggggacatcgtgatgacccagtctccagactccctggctgtgtctcgtgggcgagcgggccaccatcaactgcaagtccagccataattctttanacagttaccaaacaatagaaaactacttagctaggaccagcaagagaccaggacagccctcgaggctgctactatttacgngggactacgtccgtaaccccgggaagtccccgggggtccctcggacccgtattcgagtcggacagggtcggggtctggggaactagtactttcgacttctacacatcagcagcctgcaggctagaaangtggtcggggtacttaaggtttattagtgtaactaaataatttaattattattacgttcggtaggtaaccggttcggaccggtaaagggttaccaaggggtagaattagttacgaaggacgtaacgttggaggcctgcctaacc

SEQ ID NO: 429086 - DNA, 520 bp, Homo sapiens
  misc_feature: GZ8MTXP01D2LHG.19.71.G05.1.454.CMB.2.raw
  modified_base (321)..(321): a, c, t, g, unknown or other
  modified_base (339)..(339): a, c, t, g, unknown or other
  modified_base (402)..(402): a, c, t, g, unknown or other
  modified_base (488)..(488): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctgggaagacatatttcatgtaccaanacgtagaactacaaattngcaaccatctgttgagagtcgactgaacatcaacgtagacacatacgaagaacagttctcctnacagctacgactctgtcgaccgtcccggaggaacgtacgggtagtattattacgtaaggtaggaaggacggaccccaagtacgacnttcgccctacctcgtctcgttggtcgcttaag

SEQ ID NO: 429087 - DNA, 531 bp, Homo sapiens
  misc_feature: GZ8MTXP01D1PMU.19.71.G05.1.454.CMB.2.raw
  modified_base (226)..(226): a, c, t, g, unknown or other
  modified_base (237)..(237): a, c, t, g, unknown or other
  modified_base (312)..(312): a, c, t, g, unknown or other
  modified_base (505)..(505): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatcttttaanacagttccaaacaatagaaaactactagctggtaccagcagagaccaggacagcctctaggctgctcatttacgngggcagtccgtaacccgggaatcccgggggtcccctggaccgtattcgagtcggaccaggcggggtctggggaacaggtatttcactctcaccatcagcagcctgcaggctagaagatgtggggctaagtttatattgtacaataattattattatacttcgtggaacgttggacgaagggacaaggtgattnttcaagacgaatggtgctcgctaacc

SEQ ID NO: 429088 - DNA, 573 bp, Homo sapiens
  misc_feature: GZ8MTXP01B5BWM.19.71.G05.1.454.CMB.2.raw
  modified_base (238)..(238): a, c, t, g, unknown or other
  modified_base (250)..(250): a, c, t, g, unknown or other
  modified_base (255)..(255): a, c, t, g, unknown or other
  modified_base (311)..(311): a, c, t, g, unknown or other
  modified_base (364)..(364): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccaggggacatcgtgatgacccagtctccagactccctggctgtgtctctgggcgagcgggccacgatcaactgacaagtccagccacaatcttttaanactattaccaanaatanaaactactagctagacagacagacacagacagcctcgtagctgctactatttacgnggactactaccgtaccggacgttcccgggtccccacgacgtatcgagtcgcgnggcggtcgtagggactagtacttcactctacacatcgagcacgtcctgacgaggcagagtagtggggtagtacttagtttattagttacgtaactaaattaattattaattacgttacgttcggtaacggtacggttacggaccgaaacgggtacgtaagggttagttattacgtaacgaagtaacgtaacgtggttacgtcgttcgcc

SEQ ID NO: 429089 - DNA, 605 bp, Homo sapiens
  misc_feature: GZ8MTXP01AELNC.19.71.G05.1.454.CMB.2.raw
  modified_base (232)..(232): a, c, t, g, unknown or other
  modified_base (240)..(240): a, c, t, g, unknown or other
  modified_base (249)..(249): a, c, t, g, unknown or other
  modified_base (253)..(253): a, c, t, g, unknown or other
  modified_base (259)..(259): a, c, t, g, unknown or other
  modified_base (309)..(309): a, c, t, g, unknown or other
  modified_base (370)..(370): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatacgaactgacaagtccagccanatctttanacatacaanatanaaactntagctagacagcagacacagacacgcctcgtagctgctactagtttacgnggactacgtaccgtaaccgggtacgtcccggggtcccctacggacgtatcgaggtcgacgngggtcgggtcgtagggactagtacttcactctacacatacagacacgctagcgaggcgtagaagtagtggggtacggtacttaagtttaagttagttacgtaactaaacttaaattatttaattaacgttacgttcggtaacggtacggttaccggaccggaaacgggtaaccgtaagggttacgttaattacgtaacgaacggtaacgtacggtggttacgtcgttaacgaacc

SEQ ID NO: 429090 - DNA, 572 bp, Homo sapiens
  misc_feature: GZ8MTXP01A4XUA.19.71.G05.1.454.CMB.2.raw
  modified_base (244)..(244): a, c, t, g, unknown or other
  modified_base (322)..(322): a, c, t, g, unknown or other
  modified_base (458)..(458): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccaggggacatcgtgatgacccagtctccagactccctggctgtgtctcgtgggcgaggcgggccacgatacgaactgacaagtccagccaactaattctttanacagttccaaacaatagaaaactctagcttaggaccagcagagaccaggacagcctacgaggctgctcacttttacgngggctagtccgtacccggggaatccccccgggggtccctaggaccgtattccgaaaggttcgggcagggccgggttcgtaggggactaggtactttcactcctacaccatcagcagcctgacgaggctaggaaagnggtggtcggtatagtttatattgtacaaactatattatactcgttgtacggttacgttcggacgaaagggtacttaaggttgataagtcaagtacgtagttcgtaaggctaacg

SEQ ID NO: 429091 - DNA, 615 bp, Homo sapiens
  misc_feature: GZ8MTXP01DJEKO.19.71.G05.1.454.CMB.2.raw
  modified_base (235)..(235): a, c, t, g, unknown or other
  modified_base (310)..(310): a, c, t, g, unknown or other
  modified_base (370)..(370): a, c, t, g, unknown or other
tcagtactctcgtgcacgaccggtgctcgatttagtgtcgtcgcaagagagaggaggtacaacaggcaggcaggggcagcaagatggtgttgcagaccccaggtcttcatttctctgttgctctggatctctggtgcccacggggacatcgtgatgacccagtctccagactccctggctgtgtctcgtgggcgagccgggccacatcaactgcaagtccagccataatctttanacagttaccaacaatagaaaactactagcttggtaccagcagagaccaggacagcctctagctgctcatttacgnggactacgtaccgtaccgggacgtcccgggtccccctacgacgtagttcgaggtcggcgnggtccgggtacgtacgggactagtacttcactcctacaccatcacgcgacgccgtgcgaggcgtaggaagtagtggggtaggtacgttaagttttaattaattcgtaactaaacttaaattatttaatttaacgttacgtttcggtaacggtacggttaccgggtaaccgaaacgggtaaccgtaaggttaggttacttacgtaacgaacggtaacgtaacgtggttacggtccgttcgtaaccg

SEQ ID NO: 429092 - DNA, 574 bp, Homo sapiens
  misc_feature: GZ8MTXP01A9F2R.19.71.G05.1.454.CMB.2.raw
  modified_base (241)..(241): a, c, t, g, unknown or other
  modified_base (309)..(309): a, c, t, g, unknown or other
  modified_base (318)..(318): a, c, t, g, unknown or other
  modified_base (369)..(369): a, c, t, g, unknown or other
  modified_base (446)..(446): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccacatcaactgacaagtccagccactaatctttanacagttaccaacaatagaaaactactagcttggtaccagcagagaccaggacagccctcaggctgctntatttacgnggcatcgtacccgggaatcccggggtcccctaggaccgtatcgaggtcgcnggcgggtctgggacctagtactttcactctacacatcagacacgccgtgaccgaggctagaaagtgttggggaggtnttagtttattagttgtaactaataaatttattaattacttacgttcggtaaggtaccggttacggacccgaaagggtaccgaaagggttggcttaagaacgagaacgtaagtgttacgtcgttcgaac

SEQ ID NO: 429093 - DNA, 687 bp, Homo sapiens
  misc_feature: GZ8MTXP01AI8VH.19.71.G05.1.454.CMB.2.raw
  modified_base (230)..(230): a, c, t, g, unknown or other
  modified_base (241)..(241): a, c, t, g, unknown or other
  modified_base (257)..(257): a, c, t, g, unknown or other
  modified_base (263)..(263): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactcctggctgtgtctcgtgggcgagcgggccacgatcaactgacaagtccagccanaattctttaanactactacaataatanaaactntagctagacagacagacgacgagacacgtcctacgtagtctagtactactacttacgtacggtacgtacgtaccggtaacccgggtaaccggtacccggggtacccccgtacgtacgtacgtacgtacggtaacggacggtcgggtcgggtacgggtacgggtaacgtacgtacgttactacctacctacacctactacgacgacgacgacgtacgacgacgtacgtaacgaagtagtacggggtagtagttaagtttaacgtttaagttaacgtaactaaacttaaattaactttaatttaacgttacgttacggttaacggtaacggttacggtaacggttaaacggtaaacggtaacggttaacgttagttaacgtaacgtaacgtaacgtaacgtaggttacggtaacgttaacgtaacg

SEQ ID NO: 429094 - DNA, 632 bp, Homo sapiens
  misc_feature: GZ8MTXP01BDY99.19.71.G05.1.454.CMB.2.raw
  modified_base (238)..(238): a, c, t, g, unknown or other
  modified_base (249)..(249): a, c, t, g, unknown or other
  modified_base (254)..(254): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanactattacaanaatanaaactactagcttagacagacagacgaccgagacacgcctacgtagctgctactatttacgtggactacgttaccgtaacccgggtacgttcccggggtaccccctcggaccgtattccgaggtcggacgcgggtcgggtcgtacgggactagttacttccactctaccacactacacgcacgccgtagacgaggtctaggaagtagtggggtaggtacgttaagtttattagttagtaacctaaattaatttaattaattaacgttacgttcggttaacgggttaaccggttaccgggaaccgttaaacgggtaaccgtaagggttaggttattaacgtaacgaaggtaacgtaacgtggttacggtcgttcgaacc

SEQ ID NO: 429095 - DNA, 611 bp, Homo sapiens
  misc_feature: GZ8MTXP01BRKX4.19.71.G05.1.454.CMB.2.raw
  modified_base (236)..(236): a, c, t, g, unknown or other
  modified_base (245)..(245): a, c, t, g, unknown or other
  modified_base (304)..(304): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgaccagtctccagactcctggctgtgtctctgggcgagcgggccacgatcaactgacaagtccagccacaatctttaanacatacaanatacaaactctagctagacagacagacgacagacacgcctcgagctgctactattacgnggactacgtaccgaccgggtacgtcccggggtacccctagacgtatcgaggtcgggacgtgggtcgggtcgtagggactagtactttacacttctacacacgtcacgacgacgcgtcgacgacgacgtagaagtagtaggggtaggtagttagtttaagtttagttagtaactaaactaaattaactttaattacttacgttacggttaacggttacggttacggtacggaaacggtaaccgtaacggttacggttacgttacgtaacgtacgtaacgtaacgtacgttacggtcgttaacgtaacg

SEQ ID NO: 429096 - DNA, 597 bp, Homo sapiens
  misc_feature: GZ8MTXP01DD3ED.19.71.G05.1.454.CMB.2.raw
  modified_base (240)..(240): a, c, t, g, unknown or other
  modified_base (249)..(249): a, c, t, g, unknown or other
  modified_base (253)..(253): a, c, t, g, unknown or other
  modified_base (259)..(259): a, c, t, g, unknown or other
  modified_base (262)..(262): a, c, t, g, unknown or other
  modified_base (307)..(307): a, c, t, g, unknown or other
  modified_base (360)..(360): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccaggggacatcgtgatgacccagtctccagactccctggctgtgtctctggggcgagcggggccacgatacgaactgacaagtccagccacaatctttanacatacaanatanaaactntanctgacagcagacacagacacgcctcgtagctgctactatttacgnggctagtccgtaccgggacgtcccgggtcccctaggacgtatcgaggtcgacnggtcggtcgtagggacagtacttcactctacactagtacacgacacgcgtcgacgacgacgtagaagtagtagggtaggtacgttaagtttagttagttagtaactaaactaaattaattaattaattacgttacggttaacggtacggttacggtaaccggaaacggtaaacggtaaggttaggttagttacgtaacgtaacgtaacgtaacgtacggttacggtcgttcgtaacg

SEQ ID NO: 429097 - DNA, 530 bp, Homo sapiens
  misc_feature: GZ8MTXP01D8J6G.19.71.G05.1.454.CMB.2.raw
  modified_base (320)..(320): a, c, t, g, unknown or other
  modified_base (337)..(337): a, c, t, g, unknown or other
  modified_base (496)..(496): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactggtgaagccctcgcagaccctctcgctcacctgtgccatcgtccggggacagagtcgctagcgacagtgtgcttggcacgtgggtcaggcagtccccatcgagagtctagagtggctgggaagcatatttcatgtaccaanacgtgaactacaaattngcaaccatctgttgagagtcgactgaacatacgaacgtagacacatacgaagaacctgtcctaccctgacagctcgtacctcgtcgtacgaccgtccggaggacgtacggggtataatacgttacgtggtaggaacgaccggttaccccaagtacgacngttcgccctacgtcgtctcgttggtcgcgttaag

SEQ ID NO: 429098 - DNA, 630 bp, Homo sapiens
  misc_feature: GZ8MTXP01DAUI3.19.71.G05.1.454.CMB.2.raw
  modified_base (242)..(242): a, c, t, g, unknown or other
  modified_base (327)..(327): a, c, t, g, unknown or other
  modified_base (377)..(377): a, c, t, g, unknown or other
  modified_base (440)..(440): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacgatcaactgacaagtccagccaacaattctttanactagttaccaaacaatagaaaactacttagacttggaccagacagacgaccaggacagccctctaggcctgctctagtttacgngggactagtccgtaacccgggaagtccccgggggtccccctggaaccgtnttccaggtggacctaagggccgggtcgtggggaactaggtactttccacttcctacacctacncacgcacgcctgacgagacgtaggaagtgtaggggtacggtaacgtttaagtttaagttagttacgtaactaaattaaatttaatttaacgttacttaccgtttgggtaacggtaacgttaccgggtaaacggaaacgggtaacgtaggttagttattagtaacgaagtaacgagtggttcgtcgcgaac

SEQ ID NO: 429099 - DNA, 613 bp, Homo sapiens
  misc_feature: GZ8MTXP01AN59T.19.71.G05.1.454.CMB.2.raw
  modified_base (455)..(455): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccatcgagaggtctaggagtggcgtaggggaaaggactattatttcagttcggtacccaaacgtacggtaggaaacttaacaaaatttatcgacctaaacccattccgtagttaggaagtacggtcgaacgtagaacaaatacaaacggtagaacacaatacgaaagaacctacgttccnccctagacacggctcgtacctcgtacgtacgaccgtcccggaaggtaccgtacgggtagttaacttacgttacgtggtacgggaaacggtaccggaccccctaaagtacgacttagttccgaaccctaccgttcgttctcgttcggtcgttcgttaag

SEQ ID NO: 429100 - DNA, 521 bp, Homo sapiens
  misc_feature: GZ8MTXP01C4DRK.19.71.G05.1.454.CMB.2.raw
  modified_base (222)..(222): a, c, t, g, unknown or other
  modified_base (305)..(305): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctntcgctcacctgtgccatcgtccggggacagagtcgctagcgacagtgttgcttggcacgtgggtcaggcagtccccatcgagnggtctagagtggctgggaaggacatatttcaattgtccaacacgtaggaatacaaattatgcacatctgttgagagtacgactagaacaatacaaacgtagaacgaacaagtacgaaacgaaccagttcctccctgctagctcgtacctctgttgaccgttcccggacggacgacgggttgttataattacgtgtaggagacggccccaagtaacg

SEQ ID NO: 429101 - DNA, 566 bp, Homo sapiens
  misc_feature: GZ8MTXP01DIVF0.19.71.G05.1.454.CMB.2.raw
  modified_base (206)..(206): a, c, t, g, unknown or other
  modified_base (223)..(223): a, c, t, g, unknown or other
  modified_base (242)..(242): a, c, t, g, unknown or other
  modified_base (340)..(340): a, c, t, g, unknown or other
  modified_base (361)..(361): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcaacaagtacagctgcagcagtcaggtccaggactggtnaagccctgcagaccctntcgctcacctgtgccatcncggggacagagcgctagcgacagtgttgcttggcacgtggcaggcagtccccatcgagagtctagagtggctggggaagacatattcaatgtccaaanacgtaggaaataacaaattancacactatctgtagagagtacgactagaacaactaactaacgtaacgaacgaacaacgtaacgaaacgaaaccgtaacgttaccgtaccgtacgacgtacgtacgtacgtacctcgtcgttacgtaccgttaccggaacggtaacgttacggttacgttagttaattacgtaacggtaggaacggaccgtaacccgaacgtaacg

SEQ ID NO: 429102 - DNA, 546 bp, Homo sapiens
  misc_feature: GZ8MTXP01CQ4KP.19.71.G05.1.454.CMB.2.raw
  modified_base (227)..(227): a, c, t, g, unknown or other
  modified_base (236)..(236): a, c, t, g, unknown or other
  modified_base (247)..(247): a, c, t, g, unknown or other
  modified_base (310)..(310): a, c, t, g, unknown or other
  modified_base (339)..(339): a, c, t, g, unknown or other
  modified_base (347)..(347): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccanaatctttanacagttccaanatagaaaactcttagcttaggtaccagcagagaccaggacagcctctaggctgctcatttacnggcatcgaccggatccgggtccctgacgntcagtgcngcgggtctgggacagatttcactctcaccatcagcagcctgcaggctagaagtatgggtgtctagtttattagttgtacaaactaattattaagttactacgtttcggtggtaccggtttcggacccgaaaggggtaaccctaagggttcggttattagtaacgaaggtaaccggtaacttggttaggccttggaaccc

SEQ ID NO: 429103 - DNA, 571 bp, Homo sapiens
  misc_feature: GZ8MTXP01BQG59.19.71.G05.1.454.CMB.2.raw
  modified_base (227)..(227): a, c, t, g, unknown or other
  modified_base (235)..(235): a, c, t, g, unknown or other
  modified_base (244)..(244): a, c, t, g, unknown or other
  modified_base (246)..(246): a, c, t, g, unknown or other
  modified_base (248)..(248): a, c, t, g, unknown or other
  modified_base (254)..(254): a, c, t, g, unknown or other
  modified_base (304)..(304): a, c, t, g, unknown or other
  modified_base (339)..(339): a, c, t, g, unknown or other
  modified_base (357)..(357): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagccagcanatctttanacatacaanananaaactntagctagacagacagacaccagacacgcctcgtagctgctactatttcgnggactacgtccgtaaccggtacgtcccgggtcccngacgtatcgaggtcgcgnggcggtcgtagggactagtacttcactctacacatcgagacgacgtcctgacgacggcgtagaagtagtggggtgtattagtttattagttacgtactaaataattatttaattattacgttacggtaacggtacggttcgggaaccgaacgggtaaccgtaaggttagacttacgtaacgtagtaacgtaacgtggttacgtcgttcgtaacg

SEQ ID NO: 429104 - DNA, 584 bp, Homo sapiens
  misc_feature: GZ8MTXP01AWSBT.19.71.G05.1.454.CMB.2.raw
  modified_base (236)..(236): a, c, t, g, unknown or other
  modified_base (314)..(314): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcggccacatcaactgcaagtccagccactaattctttaanactagttaccaaacaatagaaaactcttagcttaggaccagcagacgaccagacagcctcaggctgctctatttacgngggactagtccgtaacccgggagtcccggggtaccccctgaccgtattcgaggtcgggcaagggccgggtcgtaggggacaggtactttcactcctacaccatcagcacgcctgacgaggctagaagtagtggggtggtacttagtttattagttcgtactaaattaattaatttattacttaccgttcggtgggtaaccgttcgggaccgaaagggtacctaagggttgttattacgtaacgagaacgtacgtggcggtaacttgaacc

SEQ ID NO: 429105 - DNA, 510 bp, Homo sapiens
  misc_feature: GZ8MTXP01EACV1.19.71.G05.1.454.CMB.2.raw
  modified_base (345)..(345): a, c, t, g, unknown or other
  modified_base (478)..(478): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatctccggggacagagtcgctagcgacagtgtgcttggcacgtgggtcaggcagtccccatcgagaggtctagagtggctggggaaggacatatttcaatgtccaaanacgtaggaaatacaaattatgacaccatctgttgagtagtcgactgaacaatacaaagtagacaacatacgaaagaaccaagttcctccctagcaagctcgacctctgttcgaccttcccgagacacgggttnttataatactgtagagacgccccgttaagaag

SEQ ID NO: 429106 - DNA, 490 bp, Homo sapiens
  misc_feature: GZ8MTXP01A1GK4.19.71.G05.1.454.CMB.2.raw
  modified_base (238)..(238): a, c, t, g, unknown or other
  modified_base (313)..(313): a, c, t, g, unknown or other
  modified_base (353)..(353): a, c, t, g, unknown or other
  modified_base (413)..(413): a, c, t, g, unknown or other
  modified_base (428)..(428): a, c, t, g, unknown or other
  modified_base (478)..(478): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatgaaaactactagcttggtaccagcagagaccaggacagcctcctaggctgctcatttacnggcatctaccgggatccggggtcccctgacgatcagtgcngcgggtctgggacagatttcactctcaccatcagcagcctgcaggctagaagatggtggntagttatatgtcaanatattatatactgtgcgttgcaagggaccaaggttggattatcaagcgangttaggcttgcc

SEQ ID NO: 429107 - DNA, 667 bp, Homo sapiens
  misc_feature: GZ8MTXP01A0ODX.19.71.G05.1.454.CMB.2.raw
  modified_base (241)..(241): a, c, t, g, unknown or other
  modified_base (253)..(253): a, c, t, g, unknown or other
  modified_base (384)..(384): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctcctggctgtgtctctgggcgagcgggccacgatacgaactgacaagtccagccacaatctttaanactactaccaanaatagaaactactagctagacagacagacacgagacacgcctcgtagctcgctactatttacgcggtacacgtccgtaaccgggtacgtccccggggtacccctaggaccgtattcgacggtcgggaccgngggtccgggtacgtaggggactaggtactttccgacctcctacgacctactcgacgacgacgtaccgtacgacgacgtacgtacggtaagtagtaggggttacggttacgttaagtttaacgtttaagttacgttaacgtaaacgttaaatttaaactttaatttaactttacgttacggttaacggtacggttacggtaccgttaacggtaacggtaacggttacggttacgttacgtaacgtacgtaacgtaacgtacggttacggtaacgttcgtaaccg

SEQ ID NO: 429108 - DNA, 602 bp, Homo sapiens
  misc_feature: GZ8MTXP01COXHE.19.71.G05.1.454.CMB.2.raw
  modified_base (233)..(233): a, c, t, g, unknown or other
  modified_base (243)..(243): a, c, t, g, unknown or other
  modified_base (320)..(320): a, c, t, g, unknown or other
  modified_base (378)..(378): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggccgggccacgatacgaactgacaagtccagccanaattctttanacagttccaacaatagaaaactctagcttggtaccagcagagaccaggacagcctcctaggctgctcattttacggnggctacgtaccgtaccgggtacgtccggggtccccctaggacgtatcgaggtcggcgnggtcgggtcgtagggactagtactttaccactctaccacctatacagcgacgtccgtgacgagctagaagtagtggggtgtacttagtttaattagttagtaactaaattaattaatttaattaacgtacgtttcgggtaacggtacggttaccgggaaccgaaagggtaaccgtaaggttagttattacgtaacgagtaacgtacgtgttacggtcttcgaac

SEQ ID NO: 429109 - DNA, 664 bp, Homo sapiens
  misc_feature: GZ8MTXP01DBCAR.19.71.G05.1.454.CMB.2.raw
  modified_base (242)..(242): a, c, t, g, unknown or other
  modified_base (253)..(253): a, c, t, g, unknown or other
  modified_base (257)..(257): a, c, t, g, unknown or other
  modified_base (265)..(265): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccacgatacgaactgacaagtccagccataatctttanactactacaanatanaactatanctagacagacagacgacagacacgcctacgtagctcgtctactatttcgcggactacgtaccggtaaccgggtacgtcccgggtacctacgaccgtattacgaggtcggacgacgggtcgggtacgtacgggaactagtacttacacttcctactactactacgacgccgacgacgtcgacgacgacgtagtaagtagtagtacggggttacgttaagtttaagtttaacgttacgtaacgtaaacttaaactttaactttaactttaacgttacgttacgttacggttaacggttacggttaaccggtaaacgggttaaacggtaacggtaacgttacgttaacgttaacgtaacgtaacggtaacgtacggtacgttacgtaaccgttaacgtaacg

SEQ ID NO: 429110 - DNA, 538 bp, Homo sapiens
  misc_feature: GZ8MTXP01A6AP8.19.71.G05.1.454.CMB.2.raw
  modified_base (497)..(497): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctcacctgtcgccatcgtccggggacagagcgctagcgacagtgtgcttggcacgtgggtcaggcacgtccccagtcgagaggtctagaggtggcgtggggaaggacagtatttcaattcgtccaaacgacggtaggaaatacaaattatacgacaccatctgttgagtagtacgatgaacaatacaaacgtagacgacaagtacgaacgaaccagttcctaccctgctagctcgacctctgttcgaccttccggacggacacgggttnttacgttaattacgtggtaggacgaccggccccaagtaacg

SEQ ID NO: 429111 - DNA, 554 bp, Homo sapiens
  misc_feature: GZ8MTXP01BIQ2M.19.71.G05.1.454.CMB.2.raw
  modified_base (316)..(316): a, c, t, g, unknown or other
  modified_base (426)..(426): a, c, t, g, unknown or other
  modified_base (456)..(456): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccatcgtccggggacagagtcgctagcgacagtgtgcttggcacgtgggtcaggcacgtccccagtccgagaggtctagngtggctaggggaagactagtatttcaattcgtccaaacgtagtaggaaataacgtaaattatagacaacctattctgttagagtacgtcgactgaactaatacaaagtanactacaatacgaaacgaacctacgttaccnccctagctacgctacgacctgtgttacgaccttcccggaggtacccgagggttcttattaagttaccgtggtaggaacgaccggccccttaagtaacg

SEQ ID NO: 429112 - DNA, 438 bp, Homo sapiens
  misc_feature: GZ8MTXP01C8417.19.71.G05.1.454.CMB.2.raw
  modified_base (229)..(229): a, c, t, g, unknown or other
  modified_base (236)..(237): a, c, t, g, unknown or other
  modified_base (242)..(242): a, c, t, g, unknown or other
  modified_base (244)..(244): a, c, t, g, unknown or other
  modified_base (246)..(246): a, c, t, g, unknown or other
  modified_base (248)..(248): a, c, t, g, unknown or other
  modified_base (252)..(254): a, c, t, g, unknown or other
  modified_base (258)..(259): a, c, t, g, unknown or other
  modified_base (261)..(261): a, c, t, g, unknown or other
  modified_base (263)..(263): a, c, t, g, unknown or other
  modified_base (271)..(271): a, c, t, g, unknown or other
  modified_base (273)..(273): a, c, t, g, unknown or other
  modified_base (275)..(275): a, c, t, g, unknown or other
  modified_base (277)..(278): a, c, t, g, unknown or other
  modified_base (281)..(281): a, c, t, g, unknown or other
  modified_base (288)..(288): a, c, t, g, unknown or other
  modified_base (302)..(302): a, c, t, g, unknown or other
  modified_base (306)..(306): a, c, t, g, unknown or other
  modified_base (308)..(308): a, c, t, g, unknown or other
  modified_base (310)..(310): a, c, t, g, unknown or other
  modified_base (312)..(313): a, c, t, g, unknown or other
  modified_base (315)..(315): a, c, t, g, unknown or other
  modified_base (317)..(317): a, c, t, g, unknown or other
  modified_base (319)..(319): a, c, t, g, unknown or other
  modified_base (322)..(322): a, c, t, g, unknown or other
  modified_base (324)..(324): a, c, t, g, unknown or other
  modified_base (327)..(327): a, c, t, g, unknown or other
  modified_base (329)..(329): a, c, t, g, unknown or other
  modified_base (331)..(331): a, c, t, g, unknown or other
  modified_base (339)..(340): a, c, t, g, unknown or other
  modified_base (342)..(342): a, c, t, g, unknown or other
  modified_base (344)..(345): a, c, t, g, unknown or other
  modified_base (349)..(349): a, c, t, g, unknown or other
  modified_base (353)..(353): a, c, t, g, unknown or other
  modified_base (373)..(373): a, c, t, g, unknown or other
  modified_base (415)..(415): a, c, t, g, unknown or other
  modified_base (420)..(420): a, c, t, g, unknown or other
  modified_base (426)..(426): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccaggggacatcgtgatgacccagtctccagactccctggctgtgtctcgtgggcgagccgggccacgatacgactgacaagtccagccanatcttannatcananananatannnacannananacagacancncngnnctntatatgnactcacgacgcgcncacntngngnngngngngantntcncncncacacacnnancnnaganaganagtgtgtatattatatatanatatatatatatgtgtcgtcgacgacgagtagtagttagttnagaanagaagngtgctcgcgtaa

SEQ ID NO: 429113 - DNA, 500 bp, Homo sapiens
  misc_feature: GZ8MTXP01EW1XI.19.71.G05.1.454.CMB.2.raw
  modified_base (343)..(343): a, c, t, g, unknown or other
  modified_base (418)..(418): a, c, t, g, unknown or other
  modified_base (443)..(443): a, c, t, g, unknown or other
  modified_base (473)..(473): a, c, t, g, unknown or other
  modified_base (490)..(490): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcactgggtcaggcagtccccatcgagaggtctagagtggctggggaagacatatttcatgtccaacgacgtggaaactacaaattangcaaccatctgtgagagtcgactgacaatcaacgtagacacatacgaagaaccagttcacctgacagctgacctntgtcgactcccgaggacgacgggtntatacttcgtgtaggagcgcccatacgacnttcgccactcgtctcgngtcgcttaag

SEQ ID NO: 429114 - DNA, 544 bp, Homo sapiens
  misc_feature: GZ8MTXP01EFSXH.19.71.G05.1.454.CMB.2.raw
  modified_base (282)..(282): a, c, t, g, unknown or other
  modified_base (321)..(321): a, c, t, g, unknown or other
  modified_base (341)..(341): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagnggtcagagtggctgggaagacatatttcatgtaccaaanacgtagaaatacaaatttangccaaacctatcgtgttagagagtcgaactgaacaatacaaacgtagacaacaatacgaaagaaccagttacctccctgacaagctacgtacctctgtacgacctcccggaggacgacgggttgtattacttacgtggtaggaaggaccggaccccataacgacttattcgaaccctacctcgtctcgttcggtgttcttaag

SEQ ID NO: 429115 - DNA, 639 bp, Homo sapiens
  misc_feature: GZ8MTXP01AOFTS.19.71.G05.1.454.CMB.2.raw
  modified_base (238)..(238): a, c, t, g, unknown or other
  modified_base (251)..(251): a, c, t, g, unknown or other
  modified_base (315)..(315): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccgacggggacatcgtgatgacccagtctccagactccctggctgtgtctcgtggcgagcgggccacatcaactgcaagtccagccactaattcttttanacagttaccaaanaatagaaaactctagctggaccagcagagaccaggacagcctcgtaggctgctactatttacgngggacctacgtccgtaaccccggggaacgtccccgggggtcccctacggaccgtattccgaggtcggaccgagggtccgggtcgtaggggactaggtactttccgacttcctaccacctactacgagccacgcccgtgaccgaggctaggaagtagttggtggggtacttaggttttattagttagtaactaaattaatttatttattacgttacgttcgggttaggtaaccggttcgggaccggtaaacgggttaccgtaaagggtacggttattacgttacgaaggtaccgtaacgtggtcggacgtaacgaaccgtaaccg

SEQ ID NO: 429116 - DNA, 607 bp, Homo sapiens
  misc_feature: GZ8MTXP01AVS6L.19.71.G05.1.454.CMB.2.raw
  modified_base (226)..(226): a, c, t, g, unknown or other
  modified_base (234)..(234): a, c, t, g, unknown or other
  modified_base (239)..(239): a, c, t, g, unknown or other
  modified_base (241)..(241): a, c, t, g, unknown or other
  modified_base (243)..(243): a, c, t, g, unknown or other
  modified_base (248)..(248): a, c, t, g, unknown or other
  modified_base (251)..(251): a, c, t, g, unknown or other
  modified_base (257)..(257): a, c, t, g, unknown or other
  modified_base (259)..(259): a, c, t, g, unknown or other
  modified_base (294)..(294): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccggggccacgatacgactgactagcagcanatcttacntacanananaactntantagacnanagacacgagacacgcctcagctgactatatttcgnggactacgtccgtaaccgggacgtcccgggtacccctcggaccgtatccgagtacggcgtcggtcgggtcggtacgggacgtacgtactactactactacacactacacgacgacgacgtacgacgacggacgtagaagtagtaggggtacggtacgttagtttagttacgttacgttactaacttaattaattaatttacttacgttacgttaacggttacggttacggtaccggttaacgggtaacggtaacggttacggttacgttacgtaacgtacgtaacgtacgtacggttacggtcgttcgtaacg

SEQ ID NO: 429117 - DNA, 565 bp, Homo sapiens
  misc_feature: GZ8MTXP01B629X.19.71.G05.1.454.CMB.2.raw
  modified_base (231)..(231): a, c, t, g, unknown or other
  modified_base (242)..(242): a, c, t, g, unknown or other
  modified_base (281)..(281): a, c, t, g, unknown or other
  modified_base (315)..(315): a, c, t, g, unknown or other
  modified_base (354)..(354): a, c, t, g, unknown or other
  modified_base (366)..(366): a, c, t, g, unknown or other
  modified_base (405)..(405): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatacaactgacaagtccagccanaattcttttanacagttccaacaatgaaaactctagcttgaccagcaganaccaggacagcctcctaggctgctacatttacgnggcacgtccgaccgggtacgtccgggtcccctagacgtntcgaggtcgcgnggtcgggtcgtagggactagtacttcactctacacctancagcacgtcctgacgagacagaagtgtaggggtacgtagttaagtttattagtagtaactaataattacttaattacttacgttcggtaaggtaccgttcggacgaacggtacgtaaggttgattagaacgaagtaacgtagtgttacgtcgttcgaacc

SEQ ID NO: 429118 - DNA, 631 bp, Homo sapiens
  misc_feature: GZ8MTXP01DIXR3.19.71.G05.1.454.CMB.2.raw
  modified_base (242)..(242): a, c, t, g, unknown or other
  modified_base (320)..(320): a, c, t, g, unknown or other
  modified_base (416)..(416): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctcagacctcctggctgtgtctcgtgggcgaggcgggccacgatacgaactgacaagtccagccacaattctttanacagttaccaaactaatagaaaactactagcttaggaccagcagagaccaggacagcctctaggctgctcatttacgnggcacgtaccgtaccggacgtccgggtccccaggacgtatcgacggtcgacgcgggtcgggtacgtagggactagtacttccactcctacactacncacgacgacgcgtcgacgacgtacgtagtaagtagtaggggtacggtacgttaagtttaagtttagttacgtaactaaactaaattaactttaatttaacgttacgttacggttaacggtacggttaccggtaaccggaaacgggtaaacggtaacggttacggttacgttacgtaacgtaacgtaacgtaacgtacgttacgtcgttcgtaacg

SEQ ID NO: 429119 - DNA, 507 bp, Homo sapiens
  misc_feature: GZ8MTXP01AJQNE.19.71.G05.1.454.CMB.2.raw
  modified_base (425)..(425): a, c, t, g, unknown or other
  modified_base (471)..(471): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcacgtgggtcaggcagtccccatcgagagtctagagtggctgggaaggacatatttcaatcgtccaaacacgtgaatacaaattatgcaccatctgttgagagtcgactgacaatcaacgtagacacagtcgaacgaaccagttccncctgctagctgaccctcgtgttcgaccttcccgaggacacgggttnttagtaattactgtaggacgacggccccaagtaacg

SEQ ID NO: 429120 - DNA, 521 bp, Homo sapiens
  misc_feature: GZ8MTXP01CDW6N.19.71.G05.1.454.CMB.2.raw
  modified_base (238)..(238): a, c, t, g, unknown or other
  modified_base (315)..(315): a, c, t, g, unknown or other
  modified_base (350)..(350): a, c, t, g, unknown or other
  modified_base (365)..(365): a, c, t, g, unknown or other
  modified_base (427)..(427): a, c, t, g, unknown or other
  modified_base (443)..(443): a, c, t, g, unknown or other
  modified_base (502)..(502): a, c, t, g, unknown or other
  modified_base (512)..(512): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttaccaacaatgaaaactactagcttaggtaccagcagagaccaggacagcctcctaggctgctctatttacngggcatccgtaacccgggaatcccggggtcccccngacgattcagtggcnggcgggtctgggacagtattcactctcacatcagcagcctgcaggctagaagctggggtgtntagtttattagtctanaaataatattattatactcggtaaggtacgttcggacaagggtaccaaggttgattatnaagcgaatgngtcttgaac

SEQ ID NO: 429121 - DNA, 735 bp, Homo sapiens
  misc_feature: GZ8MTXP01B8MM7.19.71.G05.1.454.CMB.2.raw
  modified_base (238)..(238): a, c, t, g, unknown or other
  modified_base (253)..(253): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactcctggctgtgtctcgtgggcgagcgggccacgatcaactgacaagtccagccaacaatcttttaanactacgttaccaaanaatagaaaacttactagctacggaccagacaagacgaccaggacacgcctcgtaggctcgacctactactttacggtcgggactacgtaccggtaaccccgggtaacgtccccggggtacctaccggaccgtacgttcgacggtcggaaccgacgggtcgggttacgtacggggaactacggtactttaccgaacgttcctaccaacctacgtaccgaacgtaccgtacggtaccgtacgaccgtacgggtactaaggtaaaggtagttgggttacggggtaactttaaggttttaactttacgtttacgtaactaaaacgttaaatttaacttttaacgttaacgtttacgtttacgggttcgggtaaccggttacgggaccgggtaaacggggttaaccgtaaaggggttcgttaaacgttacgttaccgtaaacgggtaacgtaacggttgggtacgttacgtaacgttaaccgtaacg

SEQ ID NO: 429122 - DNA, 564 bp, Homo sapiens
  misc_feature: GZ8MTXP01BF2E8.19.71.G05.1.454.CMB.2.raw
  modified_base (241)..(241): a, c, t, g, unknown or other
  modified_base (306)..(306): a, c, t, g, unknown or other
  modified_base (314)..(314): a, c, t, g, unknown or other
  modified_base (350)..(350): a, c, t, g, unknown or other
  modified_base (370)..(370): a, c, t, g, unknown or other
  modified_base (390)..(390): a, c, t, g, unknown or other
tcagtactctcgtgcacgaccggtgctcgatttagtgtcgtcgcaagagagagggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccataatctttanacagttccaacaatgaaaactctagcttggtaccagcagagaccaggacagcctctaggctgctnatttacgnggcatccgtaccggagtcccccgggtcctgaccgtntcgaagtcgcagggcgggtntggactagtacttccactcnccacatcacgacacgctcgcgacgacgtagagaggtgtgtacgtagtttattattacgtactaactaattaattaattacttacgttcggttacggttacggtacggttaccggtaacggtaacggttaacggttaggttagtaatacgtaacgacgtacgttacgtcgcgtcg

SEQ ID NO: 429123 - DNA, 531 bp, Homo sapiens
  misc_feature: GZ8MTXP01CC6XZ.19.71.G05.1.454.CMB.2.raw
  modified_base (236)..(236): a, c, t, g, unknown or other
  modified_base (245)..(245): a, c, t, g, unknown or other
  modified_base (249)..(249): a, c, t, g, unknown or other
  modified_base (255)..(255): a, c, t, g, unknown or other
  modified_base (290)..(290): a, c, t, g, unknown or other
  modified_base (293)..(293): a, c, t, g, unknown or other
  modified_base (302)..(302): a, c, t, g, unknown or other
  modified_base (331)..(331): a, c, t, g, unknown or other
  modified_base (336)..(336): a, c, t, g, unknown or other
  modified_base (386)..(386): a, c, t, g, unknown or other
  modified_base (506)..(506): a, c, t, g, unknown or other
tcagtactctcgtgcacgaccggtgctcgatttagtgtcgtcgcaagagagagggggagtacaacaggcaggcaggggcagcaagatggtgttgcagacccaggtcttcatttctctgttgctctggatctctggtgcccaggggacatcgtgatgacccagtctccagactccctggctgtgtctctgggcgagcgggccacgatcgaactgacaagtccagccacaatctttanacatacaanatanaaactntagctagacagacagacacgagacacgctcagctnctntatttacgnggacatccgaccggacgtccgggtccccngactntcgagtcgacgcggtcgggtacgtagggactagtacttcactctacacanacagacacgctcgcgacgacgtagagtagtggtgtagtagttagttattagtactaataatattattattacttgtcgtacgttacgtacgaacggtaacgtagttagttagttagtaanagaacgtagtagttgtcgttcgtcg

SEQ ID NO: 429124 - DNA, 552 bp, Homo sapiens
  misc_feature: GZ8MTXP01DOKCT.19.71.G05.1.454.CMB.2.raw
  modified_base (506)..(506): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccatcgtccggggacagagtcgctagcgacagtgttgcttggcacgtggtcaggcacgtccccagtcgagaggtctagagtggcgtagggaaggacatatttcaagtcgtccaaacgtacgtaggaaataacaaattatgacactatctgttagagtagtacgactgaacaatacaaacgtacgaactaacagtacgaaacgtaacctacgttcctcctagctacgctcgacctctgttcgaccgttcccggaaggtacgttacgggttnttaacgtaagttacgtggtaggaacgttaccggccccaagtaaccg

SEQ ID NO: 429125 - DNA, 567 bp, Homo sapiens
  misc_feature: GZ8MTXP01CP7B7.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtgccatccgtccggggacagagtcgctagcgacagtgttgcttggcacgtgggtcaggcagtccccatcgagaggtctagagtggctaggggaaggactagtatttcaatgtccaaacacgtaggaataacgaaattatgacacctatactgttacgagtagtcgactgaactaatacaaacgtagacgaactagtaacgaacgaaccagttcctcctacgcacgctacgtacctctgttacgaccgttcccgaaaggaccgttacgggttagttattaacgttaacgtcggttacgggaaacgttaccgggtaacccccttaagtaacccg

SEQ ID NO: 429126 - DNA, 653 bp, Homo sapiens
  misc_feature: GZ8MTXP01CYXN4.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtgcccagtccgtccggggacagagtcgctagcgacagtgttgcttggctacgtgggtcaggcacgtcccatcgagtaggtctaggagtggcgtaggggaacggtactagttactttcacgttcgggtacccaacgtacggttaagggaaacttaactaaaatttacgtacgacctaaccctaagttcgttaggttagacggtacgtacgtaacgttagaaacctaaagttaccgaaacggttagaaaccaactaagttaaccgggaaactaaaccgtacgttccctccgttaggaccaggtcctcggtacccttcgtgtacgacccgtacccgggaaggtaacccggtacggggttacttaagttacgtttaacggaggttaacgggaaacgccgggacccctaagttaacgtaaccg

SEQ ID NO: 429127 - DNA, 553 bp, Homo sapiens
  misc_feature: GZ8MTXP01EBQK6.19.71.G05.1.454.CMB.2.raw
  modified_base (236)..(236): a, c, t, g, unknown or other
  modified_base (316)..(316): a, c, t, g, unknown or other
  modified_base (345)..(345): a, c, t, g, unknown or other
  modified_base (350)..(350): a, c, t, g, unknown or other
  modified_base (359)..(359): a, c, t, g, unknown or other
  modified_base (540)..(540): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccacatcaactgcaagtccagccacaattcttttanactagttaccaaacaatagaaaactacttagcttaggtaccagcagagaccaggacagcctctaggctgctctatttacnggcatccgtaaccgggatccggggtcccngacgnttcagtgcnggcgggtctagggacagtactttcactctacaccatcagcagcctgcgaggctaggaaagtcgtggggtggtcttaagtttattattgtaccaaataaattattaattaattacttggtaaggtacgttcggacgttaaagggaccaagggttgattacgtaacgaagaacgtaacgtggnggtcttgtaaccc

SEQ ID NO: 429128 - DNA, 553 bp, Homo sapiens
  misc_feature: GZ8MTXP01EYAIN.19.71.G05.1.454.CMB.2.raw
  modified_base (240)..(240): a, c, t, g, unknown or other
  modified_base (284)..(284): a, c, t, g, unknown or other
  modified_base (317)..(317): a, c, t, g, unknown or other
  modified_base (377)..(377): a, c, t, g, unknown or other
  modified_base (442)..(442): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgcaagtccagccacaatcttttanacagttaccaaacaatgaaaactacttagcttggaccagcaganaccaggacagcctccaggctgctctatttacgngggcagtccgtaccccggggaatcccggggtccccctggaccgtattccgagtcgggccngggtccgggtctaggggactaggtactttcaactctcaccatccagcacgctgcaggctagaagntggggtgtcttaagtttattagtgactaataattattattatacttgtggtacgttcgaccgttaaggacgtaaggttgattatcgagaacgaacgtgttacggtgttcgc

SEQ ID NO: 429129 - DNA, 688 bp, Homo sapiens
  misc_feature: GZ8MTXP01DVFEU.19.71.G05.1.454.CMB.2.raw
  modified_base (251)..(251): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgaggccgggccacgatacgaacgtgactaagtccagccaactaattcttttaanactacttaccaaacaatagaaactatagctagacagacagacgaccgagacacgcctacgtaggctgctactacgtttacgcggtactacgttaccgtaacccggggtacgtccccggggtacccctaggaaccgtagtacgacggtacggtacggtcggtcgggtacggtacgggtacgtacgtacgttactacctacctacctacctactacgacgacgacgtaccgtacgtacgacggtacgtagtaagtagtacggggtacggtacgttaagtttaacgttaagttacgtaacgtaaacttaaattaattaattaacgttacgttacggttaacggtacggttaccggtaccggaaacggtaaacggtaacggttacggttacgttaacgtaacgtaacgtaacgtaacgtacggttacgtcgttcgtaaccg

SEQ ID NO: 429130 - DNA, 599 bp, Homo sapiens
  misc_feature: GZ8MTXP01C8M78.19.71.G05.1.454.CMB.2.raw
  modified_base (242)..(242): a, c, t, g, unknown or other
  modified_base (251)..(251): a, c, t, g, unknown or other
  modified_base (256)..(256): a, c, t, g, unknown or other
  modified_base (314)..(314): a, c, t, g, unknown or other
  modified_base (358)..(358): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagactccctggctgtgtctcgtgggcgaggccgggccacgatacgaactgacaagtccagccacaatctttanacatacaanaatanaaactatagctagacagacagacgacagacacgtcctacgagctgctactatttacgnggactacgtaccgtacccgggacgtcccgggtcccctagacgtntacgaggtcgacgcggtcgggtacgtagggacagtacttcactctacacatcacgacgacgcgtcgacgacgacgagagtagtagggtaggtacgttagtttagttagttagtactaactaaattaatttaattacttacgttacggttaacggttacggttacggtaccggaacggtaacggtaaggttaggttagttacgtaacgtacgtaacgtacgtacgttacgtcgttcgtaacg

SEQ ID NO: 429131 - DNA, 499 bp, Homo sapiens
  misc_feature: GZ8MTXP01BLUQR.19.71.G05.1.454.CMB.2.raw
  modified_base (232)..(232): a, c, t, g, unknown or other
  modified_base (303)..(303): a, c, t, g, unknown or other
  modified_base (401)..(401): a, c, t, g, unknown or other
  modified_base (404)..(404): a, c, t, g, unknown or other
  modified_base (427)..(427): a, c, t, g, unknown or other
  modified_base (476)..(476): a, c, t, g, unknown or other
  modified_base (492)..(492): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgcccacggggacatcgtgatgacccagtctccagactccctggctgtgtctctggcgagcgggccaccatcaactgcaagtccagccacaatctttanacagttccaaacaatgaaaactctagctggacagcagagaccaggacagcctcctaggctgctcatttacngggcatcgtacccgggaatccggggtcctgaccgattcgagtggcagcgggtctgggacagatttcactctcacatcagcagcctgcaggctgaaagntgnggggctaggtttatattgtcaanaattattattagtacttcgtgcgttcgcaaagggaccgaaggtgagttnttcaagacgaactggngctgcgc

SEQ ID NO: 429132 - DNA, 538 bp, Homo sapiens
  misc_feature: GZ8MTXP01DR5W4.19.71.G05.1.454.CMB.2.raw
  modified_base (241)..(241): a, c, t, g, unknown or other
  modified_base (319)..(319): a, c, t, g, unknown or other
  modified_base (349)..(349): a, c, t, g, unknown or other
  modified_base (354)..(354): a, c, t, g, unknown or other
  modified_base (362)..(362): a, c, t, g, unknown or other
  modified_base (377)..(377): a, c, t, g, unknown or other
  modified_base (417)..(417): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgcaagtccagccacaattcttttanacagttaccaaacaatagaaaactacttagcttaggtaccagcagagaccaggacagcctctaggctgctcatttacnggcatccgtaccgggatcccggggtccccngaccntcagtgcnggcgggtctgggacngatttcactctcacatcagcagcctgccaggctgaaagtntgggtggtcttaagtttattagttgtactaaactaattattaattatacgttgtaaggtacgttcggacttaaagggacctaagggttgattatcaaggaactaagtgttaggcttgaacc

SEQ ID NO: 429133 - DNA, 604 bp, Homo sapiens
  misc_feature: GZ8MTXP01C2NOF.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgtgcttggcactgggtcaggcagtccccatcgagaggtctagagtggctgggaagacatatttcatgtccaagacgtaggaaactacgaaatttatcgacaaaccctatctgttagaagtagtcgaactgacaatacaacgtagacaacagtaacgaacgtaacctagttcctacctgactaaggctcggtaaccttcgtacgtacgtaccgtccccggaggtaaccgtaacgggttagtaataacgtttaacgtgggttaacggaacggtaaccggacccccgtaaagttaacggaaccttagttaccggtccctaaccgttcgttaccgtcgttacgggtcgttaacgtttaacggg

SEQ ID NO: 429134 - DNA, 634 bp, Homo sapiens
  misc_feature: GZ8MTXP01AHLZU.19.71.G05.1.454.CMB.2.raw
  modified_base (235)..(235): a, c, t, g, unknown or other
  modified_base (244)..(244): a, c, t, g, unknown or other
  modified_base (253)..(253): a, c, t, g, unknown or other
  modified_base (255)..(255): a, c, t, g, unknown or other
  modified_base (257)..(257): a, c, t, g, unknown or other
  modified_base (262)..(262): a, c, t, g, unknown or other
  modified_base (265)..(265): a, c, t, g, unknown or other
  modified_base (284)..(284): a, c, t, g, unknown or other
  modified_base (311)..(311): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctggggcgagccggggccacgactacgactgactaagtccagccanaatctttanacatacaanananaactntanctgacagcagacacagacncgcctacgtagctgctactatttacgnggactacgtaccgtaccgggacgtcccggggtcccctacggacgtagtcgaggtacggcgcggtcgggtcggtacgggacgtacgtacgttactactacctactaccactacgacgacgacgtcgtcgcgacggtacgtagaagtagtacggggtacggtagttagtttaagtttagttacgtaactaaacgttaaattaatttaatttaacgttacgttacggttaacggtacggttaccggtaaccggaaacgggtaacggtaaggttaggttacgttacgtaacgacgtaacggtacgtacggttacgtcgttcgtaacg

SEQ ID NO: 429135 - DNA, 564 bp, Homo sapiens
  misc_feature: GZ8MTXP01EFMKR.19.71.G05.1.454.CMB.2.raw
  modified_base (247)..(247): a, c, t, g, unknown or other
  modified_base (259)..(259): a, c, t, g, unknown or other
  modified_base (327)..(327): a, c, t, g, unknown or other
  modified_base (430)..(430): a, c, t, g, unknown or other
  modified_base (451)..(451): a, c, t, g, unknown or other
  modified_base (550)..(550): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtcctccagacctccctggctgtgtctcgtgggcgaggccgggccaccatacaactgacaagtccagccataattctttanacattaccaaanaatagaaaactcttagcttaggaaccagacagacaccaggacagcctccaggctgctactatttacgnggcagtccgtaacccggggaattccccgggggtcccctggaaccgtattccgaggtcgggcaagggtcgggtctggggactaggtactttcactctacactancagcacgcctgcgagcagaangtggtggtcttaagtttatattgactaataattattattatacttgtaaggtacgttcggaccgttaaggactaggttaggcttagcaggaactaacgngttcgcgttcgaac

SEQ ID NO: 429136 - DNA, 555 bp, Homo sapiens
  misc_feature: GZ8MTXP01BSRKY.19.71.G05.1.454.CMB.2.raw
  modified_base (228)..(228): a, c, t, g, unknown or other
  modified_base (236)..(236): a, c, t, g, unknown or other
  modified_base (245)..(245): a, c, t, g, unknown or other
  modified_base (306)..(306): a, c, t, g, unknown or other
  modified_base (341)..(341): a, c, t, g, unknown or other
  modified_base (363)..(363): a, c, t, g, unknown or other
  modified_base (425)..(425): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanatctttanacatccaanaatgaaaactctagcttggaccagcagagaccaggacagcctcctaggctgctcatttacngggcatcgacccgggatccccggggcctgacccgnttcaaggttggcaggtcgggtntggggacaggtatttcactctcaccatcagcacgcctgaccaggtcagaagagttggtcggntagtttattattgacaaataaattatttaattattacgttcggttaggttacgttacggaccgtaaaggggaccttaagggttcggttataacgttagaacggaaccgtaacgttggtcgggttaactcg

SEQ ID NO: 429137 - DNA, 643 bp, Homo sapiens
  misc_feature: GZ8MTXP01DQEBG.19.71.G05.1.454.CMB.2.raw
  modified_base (236)..(236): a, c, t, g, unknown or other
  modified_base (245)..(245): a, c, t, g, unknown or other
  modified_base (249)..(249): a, c, t, g, unknown or other
  modified_base (255)..(255): a, c, t, g, unknown or other
  modified_base (258)..(258): a, c, t, g, unknown or other
  modified_base (308)..(308): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagactcctggctgtgtctcgtgggcgagcgggccacgatacgactgacaagtcagcacaatctttanacatacaanatanaaactntanctagacagacagacgacagacacgcctacgagctgactactagtttacgnggactacgtaccgtaacccgggtacgtccccggggtacccctacggtaccgtagttcgaggtcgggacgtcggtcgggtacggtacgggtacgtacgtacgttactactactactactactacgtacgtacgtacgtacgacgacggacgtagtaagtagtaggtacgggtacgttaagtttaagtttagttacgtaactaaacttaaattaatttaattaacgttacgttacggttcggtaacggttacggttacggtaaacggttaacggtaacggtagttagttacgttacgtaacgtaacgtaacgtacgtacgttacgtcgaacgtaacg

SEQ ID NO: 429138 - DNA, 528 bp, Homo sapiens
  misc_feature: GZ8MTXP01BJIW4.19.71.G05.1.454.CMB.2.raw
  modified_base (319)..(319): a, c, t, g, unknown or other
  modified_base (337)..(337): a, c, t, g, unknown or other
  modified_base (352)..(352): a, c, t, g, unknown or other
  modified_base (493)..(493): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagagtctagagtggctgggaagacatatttcatgtccaanacgtggaactacaaattngcaacatctgtgagngtcgatgaacatcaagtagacaacatacgaagaacctagttcctacctgcacgctcgaccctctcgtacgaccgtcccggagaccgacgggttgtaattacgttacgtggtaggaacgggtaccgcccctaagtacgaccnttcgccctacttcgtctcgttcggtcgcttaacgg

SEQ ID NO: 429139 - DNA, 561 bp, Homo sapiens
  misc_feature: GZ8MTXP01C3QAG.19.71.G05.1.454.CMB.2.raw
  modified_base (307)..(307): a, c, t, g, unknown or other
  modified_base (309)..(309): a, c, t, g, unknown or other
  modified_base (311)..(311): a, c, t, g, unknown or other
  modified_base (313)..(313): a, c, t, g, unknown or other
  modified_base (320)..(320): a, c, t, g, unknown or other
  modified_base (325)..(325): a, c, t, g, unknown or other
  modified_base (327)..(327): a, c, t, g, unknown or other
  modified_base (345)..(345): a, c, t, g, unknown or other
  modified_base (352)..(352): a, c, t, g, unknown or other
  modified_base (359)..(359): a, c, t, g, unknown or other
  modified_base (383)..(383): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaagccctgcagaccctctcgctcacctgtgccatctccggggacagatcgctagcgacagtgtgcttggcactgggtcaggcagtccccatcgagaggtctaggngngngnggacganatatnanatacaacagtagaataanaatatanacacatntgtagagagtacgactagaacaanaacaaacgtaacgaacaacgaacgtaacgaaacgaaaccgtaacgttaccttcccgtcgacacgtctacgtacctcgtcgtcgaccgtacccggacggtaacggtaacgggttacggttagttaacgttaacgtacggtaacggtaacggaccggaccccgtaaccgttaacgtaacg

SEQ ID NO: 429140 - DNA, 680 bp, Homo sapiens
  misc_feature: GZ8MTXP01DIS7K.19.71.G05.1.454.CMB.2.raw
  modified_base (242)..(242): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccaggggacatcgtgatgacccagtctccagactcctggctgtgtctcgtgggcgagcgggccacgatcaactgacaagtccagccaactaattcctttttaanactacgttaccaaactaatactaaaacttactagctaggaaccagacaagacgaccgaaggacacgccctacgtaggctcgtaccttactaacgtttacgcgggaacctaacgttacccggtaaaccccggggtaacggttccccgggggtaccctacggtaacccggtagttaccgaggtcgggaaccgtacgggtcgggtacgtaggggaactagtactttcactccacaccactcacgcacgcctacgcgacgacgtagaagagtagtaggtagttaagtttaattagttagtaactaaactaaattaattaattaattacgttacggttacggtaacggttacggttacggtaaacggaaacggtaacggtaaggttaagttacgttacgtaacgtaacgtaacgtaggtacggttacgtaacgaacgtaaccg

SEQ ID NO: 429141 - DNA, 514 bp, Homo sapiens
  misc_feature: GZ8MTXP01BQ6U0.19.71.G05.1.454.CMB.2.raw
  modified_base (385)..(385): a, c, t, g, unknown or other
  modified_base (456)..(456): a, c, t, g, unknown or other
  modified_base (486)..(486): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcagtccccatcgagaggtctagagtggctgggaagacatatttcatgtaccaacacgtaggaactaacaaattatgcaacccatctgtgagagtcgactgacaatcaacgtagacanatacgaagaacctagttctaccctgacacgctcgtacctcgtagtcgaccgtcccggaggactacggggtntatatactgtaggagacggcccatacgacnttcgccacctcgtctcgttgtgcgtaag

SEQ ID NO: 429142 - DNA, 546 bp, Homo sapiens
  misc_feature: GZ8MTXP01BYNP1.19.71.G05.1.454.CMB.2.raw
  modified_base (373)..(373): a, c, t, g, unknown or other
  modified_base (500)..(500): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatccgtccgggggacaggacgtcgctaggcgacgagtgttgcttggcacgtggtcaggcacgtccccatcgagaggtcagagtggcgtgggaagactatatttcaatcgtccaaacacgtaggaatacaaattnagcacatctgttgagagtcgactagaacaactacaaacgtaagaacactaatacgaaacgaacctagttcctcctagctacgctcgaccctctcgttcgaccgttccggaacggtacgacggggttnttagttaagttacgtggtaggacgaccggaaccccgttaagtaacg

SEQ ID NO: 429143 - DNA, 507 bp, Homo sapiens
  misc_feature: GZ8MTXP01BFRJF.19.71.G05.1.454.CMB.2.raw
  modified_base (218)..(218): a, c, t, g, unknown or other
  modified_base (231)..(231): a, c, t, g, unknown or other
  modified_base (235)..(235): a, c, t, g, unknown or other
  modified_base (239)..(239): a, c, t, g, unknown or other
  modified_base (248)..(248): a, c, t, g, unknown or other
  modified_base (250)..(250): a, c, t, g, unknown or other
  modified_base (252)..(252): a, c, t, g, unknown or other
  modified_base (259)..(259): a, c, t, g, unknown or other
  modified_base (265)..(265): a, c, t, g, unknown or other
  modified_base (267)..(267): a, c, t, g, unknown or other
  modified_base (271)..(271): a, c, t, g, unknown or other
  modified_base (277)..(277): a, c, t, g, unknown or other
  modified_base (279)..(279): a, c, t, g, unknown or other
  modified_base (281)..(281): a, c, t, g, unknown or other
  modified_base (283)..(283): a, c, t, g, unknown or other
  modified_base (285)..(287): a, c, t, g, unknown or other
  modified_base (289)..(289): a, c, t, g, unknown or other
  modified_base (293)..(293): a, c, t, g, unknown or other
  modified_base (295)..(295): a, c, t, g, unknown or other
  modified_base (297)..(297): a, c, t, g, unknown or other
  modified_base (311)..(311): a, c, t, g, unknown or other
  modified_base (314)..(314): a, c, t, g, unknown or other
  modified_base (316)..(316): a, c, t, g, unknown or other
  modified_base (319)..(319): a, c, t, g, unknown or other
  modified_base (321)..(321): a, c, t, g, unknown or other
  modified_base (323)..(323): a, c, t, g, unknown or other
  modified_base (325)..(325): a, c, t, g, unknown or other
  modified_base (340)..(340): a, c, t, g, unknown or other
  modified_base (344)..(344): a, c, t, g, unknown or other
  modified_base (350)..(350): a, c, t, g, unknown or other
  modified_base (361)..(361): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggctacggactacgacncactaagcagcanaatnttanacatacaanananaatatantgacananaganacaganancncngnnntntatngnancgacgacgcgtccnacntnagngngngngtgagagagtactcnctcncacacncacgacacgcngcgagacgagagtagtgggtagtagttattattatatactaataattattattattacttacgtaacggtacgttacggtacgaacggtaacggtaagttagttacgttacgtaacgtacgtaacgtacgtacgttacgtcgcgcg

SEQ ID NO: 429144 - DNA, 708 bp, Homo sapiens
  misc_feature: GZ8MTXP01BLCX5.19.71.G05.1.454.CMB.2.raw
  modified_base (230)..(230): a, c, t, g, unknown or other
  modified_base (241)..(241): a, c, t, g, unknown or other
  modified_base (251)..(251): a, c, t, g, unknown or other
  modified_base (255)..(255): a, c, t, g, unknown or other
  modified_base (261)..(261): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactcctggctgtgtctcgtgggcgagcggccacgatcaactgacaagtccagccaanaattctttaanactatacaanatanaaactntagctagacagacagacacgagacacgtcctacgagctgtctatagtttacgcggactacgtacccggtaaccgggtacgtcccggggtacccctacggtacgtacgtacgaggtacgggacgtcggggtcgggtacgtacgggaactagttacttccacctcgtaccaacctacgtacgacgacgtaccgtccgtacgacgacggtacgtaaggtaacgtaggttacggggttacggttacgtttaacgtttaagtttaacgttaacgttaaactaaacttaaactttaaacgtttaaactttaacgtttaaccgtttacggttaacgggttaaccggttaccgggtaaaccgggttaaacgggtaaacggtaacggttaacggttacgttaacgtaacgtaacggtaacggtaacggtacggttacggtaacgttaacgtaaccg

SEQ ID NO: 429145 - DNA, 649 bp, Homo sapiens
  misc_feature: GZ8MTXP01CHHU4.19.71.G05.1.454.CMB.2.raw
  modified_base (240)..(240): a, c, t, g, unknown or other
  modified_base (254)..(254): a, c, t, g, unknown or other
  modified_base (426)..(426): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccgatacaactgacaagtccagccacaattcttttaanactagttaccaaanaatataaactactagctagacagacagacgaccagacacgcctacgtagctgcttactatttacgtgggactacgttaccgtaacccgggaacgtcccggggtacctacggaccgtatcgaggtcggaacgtagggcgggtcgtacgggaactagtacttcactctacacancagcacgctgacgagactagaagtgtggtagggtacttaagtttattagttacgtaactaaattaatttaattaatttaacgttaacgttacggttaacgggtaaccggttaccgggttaaaccggtaaacgggttaaaccgtaaaggggttacggttaaacgttacgttaccggtaaggtaacgtaacgttcgggtacggttacgtaacgttaacgtaaccg

SEQ ID NO: 429146 - DNA, 611 bp, Homo sapiens
  misc_feature: GZ8MTXP01CHVPW.19.71.G05.1.454.CMB.2.raw
  modified_base (240)..(240): a, c, t, g, unknown or other
  modified_base (317)..(317): a, c, t, g, unknown or other
  modified_base (361)..(361): a, c, t, g, unknown or other
  modified_base (375)..(375): a, c, t, g, unknown or other
  modified_base (403)..(403): a, c, t, g, unknown or other
  modified_base (408)..(408): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcaagtccagccacaattcttttanacagttccaacaatagaaaactcttagcttaggaccagcagacgaccaggacagccctccaggctgctcatttacgnggctatccgtaacccggggatccccggggtccccctggaccgtnttcgaggtcggcgnggcgggtctggggacagtacttcactcncaccntcagcacgcctgcaggctaggaagtgtggggtcggtacttaagttttatagtttgaacctaataaatttattaattaattaccgtttcggtaaggttaaccggtttcgggaacccgttaaaggggtaacccgtaaagggggttgttagttaaacgtccgtaaaggtaaccggtaacgttggttccgggtaacttcggtaaccc

SEQ ID NO: 429147 - DNA, 656 bp, Homo sapiens
  misc_feature: GZ8MTXP01BX4WN.19.71.G05.1.454.CMB.2.raw
  modified_base (329)..(329): a, c, t, g, unknown or other
  modified_base (388)..(388): a, c, t, g, unknown or other
tcagtactctcgtgcacgaccggtgctcgatttagtgtcgtcgcaagagagaggggggggtacaacaggcaggcagtggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttttaatacacttaccaacaataacgtaaaactactagcttagtaccagacaagacgaccgaggacacgcctaccgtaggctgcttactatttacgnggacagttaccgtacccgggacgtcccggggtccccacggacgtatcgaggtcggacgngggtccgggtcgtagggactagttactttccacttcctacaccatacgacgcgacgtccgtagacgaggctaggaagtagtggggtacggtacgtttaagtttaatttagttacgtactaaacttaatttaatttaatttaacgttaccgtttcgggtaacggttaccggttacgggaaccgttaaacggggtaaccgtaaaggggttagttaacgttaacgtaacgaacggtaacggtaacgtcggttacggtaaccgttcgaaccc

SEQ ID NO: 429148 - DNA, 575 bp, Homo sapiens
  misc_feature: GZ8MTXP01DUQ0H.19.71.G05.1.454.CMB.2.raw
  modified_base (240)..(240): a, c, t, g, unknown or other
  modified_base (323)..(323): a, c, t, g, unknown or other
  modified_base (372)..(372): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgcaagtccagccaacaattcttttanacagttaccaaacaaatagaaaactacttagcttaggtaccagacaagagaccaggacagcctctaggctgctctatttacgnggcagtccgtaacccgggatccggggtccccctggaccgatcagtggcnggcgggtcgtgggacaggtatttcactctacaccagtcagcacgcctgcagggctagaagatggggtggtacttagtttaattattagtactaaactaaattatttaattattaccgttggtaagtacggttcggaccgttaaaggggacctaagggttggattacgcgtaagaaccgtaagtcggttggtaacttcgaaccg

SEQ ID NO: 429149 - DNA, 656 bp, Homo sapiens
  misc_feature: GZ8MTXP01CJFWH.19.71.G05.1.454.CMB.2.raw
  modified_base (224)..(224): a, c, t, g, unknown or other
  modified_base (253)..(253): a, c, t, g, unknown or other
  modified_base (343)..(343): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttctcttcttcctgccgtgctgggcctcccacaaggtgtcctgtcacaagtacagctgcagcagtcaggtccaggactgggtagaacgccctcgcacgacccctntcgctcacctgtcgccatcgtccgggganaggagtcgctagcgacagtgtgcttggcacgtgggtcaggcacgtcccagtcgagtggtctaggagtcggcgtagggaacgactatattnatacgtaccaacgacgtaagaaactaactaaagttcacgactactattcgtaggttagaagtacgtacgaacgtacgaaactaacgtaaccgtaaacggtacgaaaaccctaacgtaaacgtaaccggtaaaaccgtaaacccgttacgtttaccccgtccccgtaggaaccgtacgtaccgttaccgacctttcgtaacggtaccgaacccgttaccccgggaaggtaaacccggtggggttaacgttacgttacgttaacggtacgggtaacgggaaacggtcccggaacccctaagggttaacgaacccg

SEQ ID NO: 429150 - DNA, 570 bp, Homo sapiens
  misc_feature: GZ8MTXP01DSU0A.19.71.G05.1.454.CMB.2.raw
  modified_base (526)..(526): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcacgtccccatcgagaggtctaggagtggctaggggaagactattatttcattgtacccaaacgacgtaggaaataacaaaattatgaccaaacccatctgttgaagagtcgactgaacaatacaacgtagacacatacgaaacgaacctacgttcctaccctgacacgtctcgaccttcgtcgtcgaccgtcccggaggaacgtacgggttgtatacgttacgtggtaggaaagtaccggacccctaagtacgaaccngttccgccctacccgttcgtcttcgttgggttcgttcgtttaag

SEQ ID NO: 429151 - DNA, 595 bp, Homo sapiens
  misc_feature: GZ8MTXP01CO863.19.71.G05.1.454.CMB.2.raw
  modified_base (243)..(243): a, c, t, g, unknown or other
  modified_base (322)..(322): a, c, t, g, unknown or other
  modified_base (368)..(368): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgagcgggccacatcaactgacaagtccagccactaattctttanacattaccaaactaatagaaaactactagcttaggaccagacagagaccaggacagcctctaggctgctctatttacgngggctagtccgtaaccggggacgtcccggggtccccctggaccgtnttccgaggtcggccgaagggtccggggtctaggggacagtactttccactctcaccactcacgcgacgtccgtcgacgaggaccccgtagaagtagtgggtggtacgttagtttattattagtactaataattattaattattacgttcgtcggtacgttcggtacgaacgggtaacgtaggttagttagttagtaacgagtaacgtagtgttggtcgttcgtaacg

SEQ ID NO: 429152 - DNA, 567 bp, Homo sapiens
  misc_feature: GZ8MTXP01BNQMV.19.71.G05.1.454.CMB.2.raw
  modified_base (241)..(241): a, c, t, g, unknown or other
  modified_base (321)..(321): a, c, t, g, unknown or other
  modified_base (364)..(364): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagccgggccaccatcaactgcaagtccagccacaattcttttanacagttaccaaacaatagaaaactacttagcttaggtaccagcagacgaccaggacagcctcctaggctgctcatttacnggcatcgtaccgggatccggggtcccctgaccgatcagtggcnggcgggtctgggacagtattcactctcaccatcagcacgcctgccgaggctaggaagtagtggggtaggtacttaagtttaattagttacgtaacctaaataaattatttaattaattacgttcggtggtaaccgttcgggaccgttaaagggacctaagggttcggattataacgaagaacgtaacgtggacgtcgttgccg

SEQ ID NO: 429153 - DNA, 601 bp, Homo sapiens
  misc_feature: GZ8MTXP01AGTO9.19.71.G05.1.454.CMB.2.raw
  modified_base (242)..(242): a, c, t, g, unknown or other
  modified_base (251)..(251): a, c, t, g, unknown or other
  modified_base (255)..(255): a, c, t, g, unknown or other
  modified_base (261)..(261): a, c, t, g, unknown or other
  modified_base (310)..(310): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggggccacgatacgaactgacaagtccagccacaatctttaanacatacaanatanaaactntagctagacagcagacacgagacacgcctcgagctgctactatttacgnggactacgtaccgaaccgggtacgtcccggggtcccctacggacgtatcgagtacggcgcggcgggtcgtacggacgtagtacttactactctaccaccactacacgacgacgccgtcgacgacgacgtagagtagtaggggtggtacgttagtttattattagtactaactaattaattattattacgttcgttaacggtacggttacggtaccggttaacggtaacggtaacggttaggttacgttacgtaacgtacgtaacgtacgtaggttacggtcgttcgtaacg

SEQ ID NO: 429154 - DNA, 584 bp, Homo sapiens
  misc_feature: GZ8MTXP01CA7AV.19.71.G05.1.454.CMB.2.raw
  modified_base (241)..(241): a, c, t, g, unknown or other
  modified_base (322)..(322): a, c, t, g, unknown or other
  modified_base (535)..(535): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgacaagtccagccacaattcttttaanacagttacccaaacaatagaaaacttacttagctaggaccagcagagaccaggacagccctcctaggctgctcatttacgngggcatccgacccgggatcccggggtcctgaccgtattccgagtcggacaggcgggtctggggacagtacttcactctacaccatcagcagcctgcaggctagaagagtgtaggggcttaagttttatagttcaactaaataattaattattaacttacgttcgtgggtaaccgtttcggaccgtaaaggggaccgtaaagggtggaacgttnttacccgaaggtaaccgtaacgttggtacgggttcctcggccgtaaccg

SEQ ID NO: 429155 - DNA, 591 bp, Homo sapiens
  misc_feature: GZ8MTXP01BSAR9.19.71.G05.1.454.CMB.2.raw
  modified_base (237)..(237): a, c, t, g, unknown or other
  modified_base (375)..(375): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgcaagtccagccacaattcttttanacagttaccaaacaatacgaaaactcttagcttggaccagcagacaccaggacacgcctccaggctgctctatttacgtgggccagttccgtacccggggaatccccgggggtcccctggaccgtattcgagtggccnggcgggtctaggggacaggtactttcgactctcacatcagcagcctgcaggctaggaaagtgtggggtgtacgtagtttaattatacgtactaaataaattattaattacttacgttcggtaaggtacgtttaccgggaccgaaagggtaccaagggttcggttaattacgttaaccaaggtaaccggaaacgttggttacggtcgttcggaaccc

SEQ ID NO: 429156 - DNA, 593 bp, Homo sapiens
  misc_feature: GZ8MTXP01DB9JX.19.71.G05.1.454.CMB.2.raw
  modified_base (245)..(245): a, c, t, g, unknown or other
  modified_base (289)..(289): a, c, t, g, unknown or other
  modified_base (320)..(320): a, c, t, g, unknown or other
  modified_base (353)..(353): a, c, t, g, unknown or other
  modified_base (361)..(361): a, c, t, g, unknown or other
  modified_base (372)..(372): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatgacccagtctccagacctccctggctgtgtctcgtgggcgagccgggccacatcaactgacaagtccagccaactaattctttanacagttaccaacaatagaaaactctagcttaggaccagcaaganaccaggacagcctcaggctgctcatttacgnggcagtccgtaacccgggatcccggggtccccnggtaccgnttcgagtcgcnggcgggtacgtgggaacagtactttcacttctaccaccatcaagcgacgtccgtgaccaggactaggaaagtgtggggttggtacttaagttttaattattagtaccaaattaaattatttaatttactacgtttcggtaaggtaccgttacggacccaaaggggtaacctaaggttggattacgtaacgaagtaacgtaacgtggttacgtcttaagccc

SEQ ID NO: 429157 - DNA, 608 bp, Homo sapiens
  misc_feature: GZ8MTXP01CZK25.19.71.G05.1.454.CMB.2.raw
  modified_base (226)..(226): a, c, t, g, unknown or other
  modified_base (233)..(233): a, c, t, g, unknown or other
  modified_base (235)..(235): a, c, t, g, unknown or other
  modified_base (242)..(242): a, c, t, g, unknown or other
  modified_base (244)..(244): a, c, t, g, unknown or other
  modified_base (246)..(246): a, c, t, g, unknown or other
  modified_base (251)..(251): a, c, t, g, unknown or other
  modified_base (254)..(254): a, c, t, g, unknown or other
  modified_base (261)..(261): a, c, t, g, unknown or other
  modified_base (263)..(263): a, c, t, g, unknown or other
  modified_base (276)..(276): a, c, t, g, unknown or other
  modified_base (287)..(287): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccacgatacgactgacaagcagcanatcttananatacaanananaactntantagacananagagacagacacnctctacgctcnctactacttacgtcgcgtacgtaccgtaccggtaccgtccggtccgtcccgtacgtactcgtagtcggacgacggcgggtcggtacgggacgtacgtacttactactacctaccacctactacacgacgacgtacgtcgacgacggacgtagaagtagtaggtacggggtacgttagtttaagttaagttagtaactaaactaaattaattaattaattacgttacgtacggtaacggtacggttacggtaacggaacggtaaggtagttacgttacgttacgtaacgtaacgtaacgtagtagttacgtaacgcgtaacg

SEQ ID NO: 429158 - DNA, 542 bp, Homo sapiens
  misc_feature: GZ8MTXP01ADZ67.19.71.G05.1.454.CMB.2.raw
  modified_base (452)..(452): a, c, t, g, unknown or other
  modified_base (469)..(469): a, c, t, g, unknown or other
  modified_base (501)..(501): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcacgtgggtcaggcacgtccccagtcgagaggtctagagtggcgtgggaaggactatagtttcaattcgtccaaacgtacggtaggaaattaacgtaaattatacgacacctatctgttagagtagtacgactagacaatacaacgtagacgacatacgaacgaacctagttcnccctgcagctcgacctntcgttgacccttaccggaggtacgacgggttnttagtaattacgtaagtaggaacgcggaaccccaagtaacg

SEQ ID NO: 429159 - DNA, 628 bp, Homo sapiens
  misc_feature: GZ8MTXP01BOGDR.19.71.G05.1.454.CMB.2.raw
  modified_base (246)..(246): a, c, t, g, unknown or other
  modified_base (339)..(339): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccacgatacgaactgacaagtccagccataattcttttaanactacgttaccaaataataacgaaaactacttagcttaggaccagacaagacgaccgaggacacgtccctacgtaggctgctactatttacgnggacctacgttacccggtaacccggggtacgttccccggggtaccccctaggtaccgtattccgaggtcgggaccgtcgggtccgggtacgtaggggaactagttactttccactcctacaacctatacgacgacacgtcctgacgaggtcgagaagtagtgggtgtagttagtttattattagtactaataattattattatacgttgtaacggtacgttacggtacgaacggtacgtaaggttagttagttacgtaagtagtaacgtacgtagttcgtcgttcgtcg

SEQ ID NO: 429160 - DNA, 585 bp, Homo sapiens
  misc_feature: GZ8MTXP01CD3EX.19.71.G05.1.454.CMB.2.raw
  modified_base (241)..(241): a, c, t, g, unknown or other
  modified_base (250)..(250): a, c, t, g, unknown or other
  modified_base (253)..(253): a, c, t, g, unknown or other
  modified_base (255)..(255): a, c, t, g, unknown or other
  modified_base (362)..(362): a, c, t, g, unknown or other
  modified_base (410)..(410): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaaagtccagccacaatcttttaanacatacaanaananaaaactatagctagacagcagacgacagacagtcctcgagctgctctattacgtggacactacgtaccggacgtccggtccccgtacgacgtactactacgtagcgnggcgggtcgtaggacgagtacttctactctacacactacagacacgcncgcgacgacgagaagagtagggtaggtacgtagtttaatttaattagtaactaaactaaaattaaattaattaattaacttacgttaacggtacggttacggtaccggaaacggtaaacggtaacggttaggttagttacgtaataacgaacgaacgtagttacgtcgttcgtcg

SEQ ID NO: 429161 - DNA, 620 bp, Homo sapiens
  misc_feature: GZ8MTXP01EJUR1.19.71.G05.1.454.CMB.2.raw
  modified_base (244)..(244): a, c, t, g, unknown or other
  modified_base (332)..(332): a, c, t, g, unknown or other
  modified_base (374)..(374): a, c, t, g, unknown or other
  modified_base (388)..(388): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacgatcgaactgacaagtccagccacaattcttttaanactacttaccaaataataacgtaaaactacttagcttacggaaccagacagacgacaggacacgcctacgagctgctactatttacgnggactacgtaccgtaccggacgtcccgggtcccctaggactntcgaggtcggacgngggcgggtcgtacgggactagtacttcactctacacatcacgacacgcgtagacgagtactaaggaacgtagtggggtagtagttaagttttattacgttagtaactaaattaaagtttaattaattacgttacgtttggtaacggtaacggttacggaaccggttaaacgggtaacgtaagggttagttacttacgtaacgaagtaacgtaagtgttacggtcttcgaacg

SEQ ID NO: 429162 - DNA, 689 bp, Homo sapiens
  misc_feature: GZ8MTXP01DYZ85.19.71.G05.1.454.CMB.2.raw
  modified_base (246)..(246): a, c, t, g, unknown or other
  modified_base (258)..(258): a, c, t, g, unknown or other
  modified_base (263)..(263): a, c, t, g, unknown or other
  modified_base (272)..(272): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccatacgaactgacaagtccagccactaatcttttaanacactaccaaanaatanaaactatanctagacagacaagacgacgagacacgcctcgtagctacgtactactagtttacgcgggtactacgttacccggtaacccgggtaacgtccccggggtacctacggacccgtagttcgaggtcggaaccgtacgggtcggggtcgtacgggaactacgtactttacactcctaccaaccactacgacgtacgacgtacgtcgacgacggacgtagtaagtagttaggttacggggttacgttaagtttaagtttacgttacgtaactaaacttaaatttaaattttaatttaacgtttacgtttacggttacggttaaccggttaccggttacggtaaacggttaaacggtaacggtaggttaagttacgttacgtaacgtaacgtaacgtacgtcggttacgtcgttaacgtaaccg

SEQ ID NO: 429163 - DNA, 505 bp, Homo sapiens
  misc_feature: GZ8MTXP01BZEB8.19.71.G05.1.454.CMB.2.raw
  modified_base (282)..(282): a, c, t, g, unknown or other
  modified_base (319)..(319): a, c, t, g, unknown or other
  modified_base (335)..(335): a, c, t, g, unknown or other
tcagtactctcgtgcacgaccggtgctcgatttagtgtcgtcgcaagagagagggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgcccatctccggggacagagtcgctagcgacagtgttgcttggcacgtgggtcaggcagtccccatcgagnggtctagagtggctgggaagcatatttcatgtccaanacgtgaatacaaattngcaacatctgtgagagtcgactgacaatcaagtagacaacatacgaagaacagtctcctgacagctagacctctgtcgacgtcccgaggacacgggtgtatatacgtgtacggagacggcccctatacgaacgcttacgcccaccgttcgtctcgttggtcgccttaagg

SEQ ID NO: 429164 - DNA, 519 bp, Homo sapiens
  misc_feature: GZ8MTXP01ERPCO.19.71.G05.1.454.CMB.2.raw
  modified_base (233)..(233): a, c, t, g, unknown or other
  modified_base (302)..(302): a, c, t, g, unknown or other
  modified_base (408)..(408): a, c, t, g, unknown or other
  modified_base (493)..(493): a, c, t, g, unknown or other
  modified_base (510)..(510): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacatctttanacagttccaaacatagaaaactctagctgacagcagagaccaggacagcctctaggctgctcatttacngggcatcgtacccgggaatcccggggtcctagaccgtattcgagtcggcaggcgggtactggggacagtactttcactctcacatcagcagcctgctggctgaagntgtggggctagtttattattgtaccaaataattatttattatacgttcgtggtaacgttcgacgaaagggaccgaaaggtgattnttcgaagacgaattggngctcgctaa

SEQ ID NO: 429165 - DNA, 530 bp, Homo sapiens
  misc_feature: GZ8MTXP01EGZX5.19.71.G05.1.454.CMB.2.raw
  modified_base (230)..(230): a, c, t, g, unknown or other
  modified_base (238)..(238): a, c, t, g, unknown or other
  modified_base (307)..(307): a, c, t, g, unknown or other
  modified_base (414)..(414): a, c, t, g, unknown or other
  modified_base (422)..(422): a, c, t, g, unknown or other
  modified_base (431)..(431): a, c, t, g, unknown or other
  modified_base (442)..(442): a, c, t, g, unknown or other
  modified_base (493)..(493): a, c, t, g, unknown or other
tcagtactctcgtgcacgaccggtgctcgatttagtgtcgtcgcaagagagaggggggaggtacaacaggcaggcaggggcagcaagatggtgttgcagaccccaggtcttcatttctctgttgctctggatctctggtgcccacggggacatcgtgatgacccagtctccagactccctggctgtgtctcgtgggcgagcgggccaccatcaactgcaagtccagccanatctttanacagttccaacatgaaaactctagcttggaccagcagagacaggacagcctctaggctgctcatttacngggcatccgtaccgggatcccggggtcccctggaccgattcgagtcgcaaggcgggtctgggacagatttcacgtctcaccatcagcagtcctgcaggctagaaagntgggtggntagtttatntgacaataatnttatatacttcgaagtcgttacggacccttaaagggacctaagggttaggnttacaacgaggaactaactggttggtaacttgaaccc

SEQ ID NO: 429166 - DNA, 532 bp, Homo sapiens
  misc_feature: GZ8MTXP01E1DIM.19.71.G05.1.454.CMB.2.raw
  modified_base (228)..(228): a, c, t, g, unknown or other
  modified_base (238)..(238): a, c, t, g, unknown or other
  modified_base (312)..(312): a, c, t, g, unknown or other
  modified_base (365)..(365): a, c, t, g, unknown or other
  modified_base (371)..(371): a, c, t, g, unknown or other
  modified_base (405)..(405): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctggcgagcggggccaccgatcgaactgcaagtccagccanaatcttttanacagttccaacaatgaaaactacttagctggtaccagcagagaccaggacagcctcctaggctgctcatttacngggcatcctacccgggatccgggggtccctgaccgattcagtggcagcggtcngggacngatttcactctcaccatcagcagccctgcagcgngagagtgtggtcgtagtttattattcgtacaactaattaattaattattacgtcgtggtaacggtacggaccgaacggaacgaaggtagagttattacgaacgacgaacgtgtgttcgtcgcgaacg

SEQ ID NO: 429167 - DNA, 532 bp, Homo sapiens
  misc_feature: GZ8MTXP01AR22Z.19.71.G05.1.454.CMB.2.raw
  modified_base (225)..(225): a, c, t, g, unknown or other
  modified_base (235)..(235): a, c, t, g, unknown or other
  modified_base (262)..(262): a, c, t, g, unknown or other
  modified_base (308)..(308): a, c, t, g, unknown or other
  modified_base (416)..(416): a, c, t, g, unknown or other
  modified_base (526)..(526): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctggcgagcgggccaccatcaactgcaagtccagccanaatcttttanacagttaccaaacaatgaaaactctanctggaccagcagagaccaggacagcctcctaggctgctcatttacngggcatccgtaacccgggatcccggggtccctgacccgattcgagtggacaggcgggtctgggacagtatttcactctcaccatcagcagccctgccaggctagaagngtgtggggtactagttttatagttgtaccaaataattattattataccttgtggtaacgttcggacaagggccaaagggtgacttagttcaagtatcgaacgtgagtcgngtaacc

SEQ ID NO: 429168 - DNA, 560 bp, Homo sapiens
  misc_feature: GZ8MTXP01BZN9S.19.71.G05.1.454.CMB.2.raw
  modified_base (244)..(244): a, c, t, g, unknown or other
  modified_base (259)..(259): a, c, t, g, unknown or other
  modified_base (319)..(319): a, c, t, g, unknown or other
  modified_base (371)..(371): a, c, t, g, unknown or other
  modified_base (409)..(409): a, c, t, g, unknown or other
  modified_base (413)..(413): a, c, t, g, unknown or other
  modified_base (417)..(417): a, c, t, g, unknown or other
  modified_base (419)..(419): a, c, t, g, unknown or other
tcagtactctcgtgcacgaccggtgctcgatttagtgtcgtcgcaagagagaggggggagtacaacaggcaggcaggggcagcaagatggtgttgcagacccaggtcttcatttctctgttgctctggatctctggtcgcccgaggggacatcgtgatgacccagtctccagcctccctggctgtgtctcgtgggcgaggccggccaccatcaactgacaagtccagccaataattcttttaanactacgttaccaaanaatagaaaactctagcttagacagcagacaccagacagcctcagctgctactagtttcgnggcacgttaccgaccggacgtccgggtcccacggactagttcgaggtcggcngggcggtcgtagggactagtactttcactctacactancacncacncncgcgagagtagagtagtggtgtagttattattattataactaataattattattattacgttgtaacggtacgttacggtacgacggtaacgtaagttagttagttagtaagacgtaacgtagtagttacgtcgttcgtcg

SEQ ID NO: 429169 - DNA, 610 bp, Homo sapiens
  misc_feature: GZ8MTXP01EB8GE.19.71.G05.1.454.CMB.2.raw
  modified_base (316)..(316): a, c, t, g, unknown or other
  modified_base (384)..(384): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagagtcgctagcgacagtgttgcttggcacgtggtcaggcacgtccccatcgagaggtcagngtggcgtagggaaggactagtatttcaagttcgtaacccaaactacggtaggaaactaactaaaattntacgactactatcgtgttagagtagtcgactgaacaatacaaacgtacgaacgactaacgtacgaaacgtaaacctacgttacctaccctacgctaacggtccttcgtaacccttctcggttacgtacccgttacccggaagggtaaccggttacgggttcgttaagttaacgttaacgttcgggttacgggaaacggaccgggtaacccccttaagttaacccgg

SEQ ID NO: 429170 - DNA, 612 bp, Homo sapiens
  misc_feature: GZ8MTXP01C7996.19.71.G05.1.454.CMB.2.raw
  modified_base (240)..(240): a, c, t, g, unknown or other
  modified_base (298)..(298): a, c, t, g, unknown or other
  modified_base (385)..(385): a, c, t, g, unknown or other
  modified_base (421)..(421): a, c, t, g, unknown or other
tcagtactctcgtgcacgaccggtgctcgatttagtgtcgtcgcaagagagaggggggaggtacaacaggcaggcaggggcagtcaagatggtgttgcagacccaggtcttcatttctctgttgctctggatctctggtgcccacggggacatcgtgatgacccagtctccagacctccctggctgtgtctcgtgggcgagcgggccacatcaactgcaagtccagccaacaatctttanacagttaccaaacaatagaaaactattagcttaggtaccagacagagaccaggacacncctcctaggctgctcatttacgtgggctagtccgtaacccgggatcccggggtccccctaggaccgtatcaggtggcaaggcgggtntcgggaacagtattcactctcacatcagcagtccgngacgaggctagaagtagtgggtacgtattagtttaattagttagtaactaaactaaatttaatttaattaacttacgttacggttaacgggtaaccggttaccgggtaaccgaaacgggtaaccgtaagggttacggttaattaagtaacgaaggtaacgtaacggttacggttacgtcgttaacgtaacc

SEQ ID NO: 429171 - DNA, 680 bp, Homo sapiens
  misc_feature: GZ8MTXP01A85SW.19.71.G05.1.454.CMB.2.raw
  modified_base (269)..(269): a, c, t, g, unknown or other
  modified_base (616)..(616): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagagcgctagcgacngtgtcgcttggcacgtggtcaggcacgtccccagtccggaggtaggtctaggagtggacgtaggggaaggtactattatttcaaattcgtaaccaaacgacggtaggaaactaactaaagtttactacgactacctagttcgtaggttaggaaggtaacgtaccggtaattacggaaactaaacgtacgtaaaacgttaacgaaccgtaactaaacgttaaccgaaaacggtaaacccttaacggtttccccttacccgttacggacctaacggtccttaccgtaacccttcgttacggttacggtaacccgttaccccggggaaaggtaaccggttacgggggttnttaacgtttaacgttaccgtgggtaacgggaacggttacccggtaacccccgttaagtaaccgg

SEQ ID NO: 429172 - DNA, 624 bp, Homo sapiens
  misc_feature: GZ8MTXP01EERHB.19.71.G05.1.454.CMB.2.raw
  modified_base (242)..(242): a, c, t, g, unknown or other
  modified_base (329)..(329): a, c, t, g, unknown or other
  modified_base (392)..(392): a, c, t, g, unknown or other
  modified_base (428)..(428): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccacgatacgaactgacaagtccagccacaattcttttaanactacttaccaaataataacgaaactacttagacttacgaccagacagacgaccgagacacgcctcgtaggctgctactatttacgnggactacgtaccggtaacccgggacgtcccgggtacccctaggacgtagtcgaggtcggacgngggtcgggtcgagggactagtacttcactcacacancacgacacgcgtcgacgacgacgtagaagtagtcgggtagtagttagtttattattacgtactaaactaaattaattaattacttacgttacggttaacggtacggttaccggtacggttaaacggtaaacggtaacggttaggttagttacgtaacgtaacgtaacgtaacgtacggttacggtcgttcgtaacg

SEQ ID NO: 429173 - DNA, 637 bp, Homo sapiens
  misc_feature: GZ8MTXP01BRMFR.19.71.G05.1.454.CMB.2.raw
  modified_base (240)..(240): a, c, t, g, unknown or other
  modified_base (333)..(333): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgacaagtccagccataatcttttaanactacgttaccaaataatacgtaaaactactagcgttagaccagacagacgaccgaggacacgccctacgtaggctcgcttactagtttacgngggacctacgttacccgtaacccggggtacgttccccggggtccccctacggaccgtattccgaggtcggacgtgggtcgggtcgtacgggactagttactttccaccttctaccacctatcgacgcgacgcgtagacgaggactaggaagtagttggggtacggtacttaagttttattaagttacgtaactaaattaatttatttaatttacgttacgttcggtaagggttacgttacggaccggaaaggtacgtaagggttacgattacgaacgagaacgtacgtggttacgtcgttgccg

SEQ ID NO: 429174 - DNA, 624 bp, Homo sapiens
  misc_feature: GZ8MTXP01AFN0K.19.71.G05.1.454.CMB.2.raw
  modified_base (239)..(239): a, c, t, g, unknown or other
  modified_base (249)..(249): a, c, t, g, unknown or other
  modified_base (258)..(258): a, c, t, g, unknown or other
  modified_base (262)..(262): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtggggcgaggccggggcctacgactacgacgtgactaagccagccanaatctttaanacatacaanatanaactctagctagacagacagacgacgagacacgcctcagctgctactatttacgcggtactacgtaccgtaccggtacgtccgggtcccctagacgtagtcgaggtcggacgtcgggtccgggtacgacggacgtacgtacttactactactaccacctacacgacgacgacgtccgtacgacgacgtacgtagtaagtagtaggggtagtacgttagtttagttagttagtaactaaactaattaattaattacttacgttacggtaacggtacggttaccggtaccggaacggtaacggtaaggttaggttacgttacgtaacgtacgtaacgtacgtacggttacgtcgttcgtaaccg

SEQ ID NO: 429175 - DNA, 569 bp, Homo sapiens
  misc_feature: GZ8MTXP01A1AH9.19.71.G05.1.454.CMB.2.raw
  modified_base (361)..(361): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgacaagtccagccacaattcttttatacagttaccaaacaatagaaaactacttagcttggtaccagcagagaccaggacagcctctaggctgctcatttacgtggcatcctaccggggatccggggtcccctgacgattcagtggcnggcgggtctgggacagtcttcactctcacatcagcacgcctagccaggctaggaagtagtgggtcggattaagtttattacttgtactaaactaaatttatttaattattaccgtttggtaacgggtaacgtttcgggaacccgttaaagggtaaaccgtaaggttggttattagtaaccgagaacgaacttggcggtaacttcgaac

SEQ ID NO: 429176 - DNA, 626 bp, Homo sapiens
  misc_feature: GZ8MTXP01DPEDU.19.71.G05.1.454.CMB.2.raw
  modified_base (230)..(230): a, c, t, g, unknown or other
  modified_base (241)..(241): a, c, t, g, unknown or other
  modified_base (245)..(245): a, c, t, g, unknown or other
  modified_base (250)..(250): a, c, t, g, unknown or other
  modified_base (253)..(253): a, c, t, g, unknown or other
  modified_base (303)..(303): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgccacggggacatcgtgatgaccagtctccagactcctggctgtgtctcgtgggcgagcgggcacgatacgactgacaagtcagcacatctttanactactacaanatanaactntanctagacagcagacgacagacacgcctacgtagctcgactactagttacgnggactacgtaccgtaccggacgtcccggtactacgaccgtatcgaggtcgacgacggtcgggtcgtacgggaactacgtacttccactactacactatacgacgacgtacgtcgtacgacgacgacgtacgtaagtagtaggtacggggtacgttaagtttaattacgttacgtaactaaacgttaaatttaattaactttaacgttacgttacggtacggtaacggtacggttaacggtaaacggttaacggtaaacggtaagttacgttacgttacgtaacgtaacgtaacgtacgtacgttacgtaacgttaacgtaacg

SEQ ID NO: 429177 - DNA, 617 bp, Homo sapiens
  misc_feature: GZ8MTXP01CN3WH.19.71.G05.1.454.CMB.2.raw
  modified_base (243)..(243): a, c, t, g, unknown or other
  modified_base (252)..(252): a, c, t, g, unknown or other
  modified_base (257)..(257): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccacgatacgactgacaagtccagccacaatctttaanacatacaanaatanaaactctagtctagtacagcagacgacagacacgcctcgtagctgctactatttacgcggactacgtaccggtacccgggacgttcccccggggtacctacggaccgtactcgaaggtcggcgtacggtcgggtacgagggactaggtacttcactcacactatacacgacgacgtcgcgacgacgacgtacgtagtacggtacggtacggtacgttacgtttaacgttaagttacgtactaaactaaattaattaattaacttacgttaacggttacggttacggttacggttacgaaacggtaacgttacggttagttacgtaatacgtaacgtacgtacgttacgtcgttcgtaacg

SEQ ID NO: 429178 - DNA, 527 bp, Homo sapiens
  misc_feature: GZ8MTXP01B9O72.19.71.G05.1.454.CMB.2.raw
  modified_base (238)..(238): a, c, t, g, unknown or other
  modified_base (313)..(313): a, c, t, g, unknown or other
  modified_base (364)..(364): a, c, t, g, unknown or other
  modified_base (507)..(507): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttaccaacaatagaaaactactagcttggtaccagcagagaccaggacagcctctaggctgctcatttacngggcagtcctacccgggatcccggggtccccctggaccgattccagtggcnggcgggtcgtgggacagtactttcactctcaccatcagcagcctgcaggctagaagatggggtgtactagtttattattgtacaaactaattattaacttatacttggtaaggtacgttcggacagggacaggttgattagtnagcgactggttagcttgaac

SEQ ID NO: 429179 - DNA, 591 bp, Homo sapiens
  misc_feature: GZ8MTXP01CDTW3.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatccgtccggggacagagtcgctagcgacagtgttgcttggcacgtgggtcaggcacgtcccatcgagaggtctaggagtggcgtaggggaagactagttatttcatcgtaccaaacgtacgtaggaaactaacgtaaattagtcgacaaaccctaattcgtaggttacgagtagtaccgactagaactaatacaaacgtagaacaacagtacgaaacgaacctacgttacctaccctgacacgcgtacgtacctcgtacgtacgacccgtacccggacggtaaccgacgggttagtagttacgttacgtggtacggaacgacggccccgtaagtacgacgcttcgccacctcgtctcgttcggtcgttgttaacg

SEQ ID NO: 429180 - DNA, 626 bp, Homo sapiens
  misc_feature: GZ8MTXP01CVZ2E.19.71.G05.1.454.CMB.2.raw
  modified_base (246)..(246): a, c, t, g, unknown or other
  modified_base (334)..(334): a, c, t, g, unknown or other
  modified_base (388)..(388): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctcccgtggctgtgtctcgtgggcgaggccgggccacatcaactgacaagtccagccaactaattctttanactacgttaccaaactaatagaaaactactagcttaggaccagacagacgaccagacacgcctccgtaggctgactactagtttacgngggactagtacccgtaacccggggacgtccccgggggtcccccaggtaaccgtnttacccgaggttcgggaccgtaagggtccgggtcgtacggggactacggtactttccgactcctacacactcaagccagcccgtagccgaggcaggaaagtgtggggtacgtagtttaagtttattacgttagtaacctaaataatttattattaacgttaccgttggtaacggtacggttacggtacgaaggtaacgtaggttagattagaacgtaagcgtaagtgagtcttcgaac

SEQ ID NO: 429181 - DNA, 603 bp, Homo sapiens
  misc_feature: GZ8MTXP01BIZLK.19.71.G05.1.454.CMB.2.raw
  modified_base (243)..(243): a, c, t, g, unknown or other
  modified_base (255)..(255): a, c, t, g, unknown or other
  modified_base (260)..(260): a, c, t, g, unknown or other
  modified_base (320)..(320): a, c, t, g, unknown or other
  modified_base (380)..(380): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgagccgggccacgatcaactgacaagtccagccactaattctttanactactaccaanaatanaaactctagctacggacagcagacgaccgagacacgcctcgagctcactactatttacgnggactacgttccggaaccggtacgtcccggggtacccctcggacgtatcgagtacggcgnggtcgggtcgacgggactagtacttacactctacactagcacgcacgcctgacgaggctagaagtgtggggtacgtgttagtttattagttacgtaactaaattaattaatttaactttacgttaccgttggtaacggttaccggttacgggaaccgaaacgggtacgtaagggttagttacttagtaacgaggtaacgtacggtcgttacgtcgttcgtaac

SEQ ID NO: 429182 - DNA, 593 bp, Homo sapiens
  misc_feature: GZ8MTXP01CID3J.19.71.G05.1.454.CMB.2.raw
  modified_base (230)..(230): a, c, t, g, unknown or other
  modified_base (238)..(238): a, c, t, g, unknown or other
  modified_base (246)..(246): a, c, t, g, unknown or other
  modified_base (250)..(250): a, c, t, g, unknown or other
  modified_base (279)..(279): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccgacggggacatcgtgatgacccagtctccagactcctggctgtgtctcgtgggcgagcgggctacgatacgactgactaagccagccanatctttanacatacanatanaactctagctagacagcagacgacagacncgcctacgagctgctactacttacgtcgtactacgtacgtaccggtacgtccggtccccgtacgtacgtacgtcgacgtacgacgcggcggtcgtacggacgtacgtactactactactactacactacgacgacgacgactacgtcgacgtacgtagagtagtacgggtgtacgttagttacgttagttacgtactaactaattattattacgttacgttcgtaacggtacggttacggtacggaacggtaacggtaaggttagttacgttacgtaacgtacgtaacgtacgtacgttacgtcgttcgtaacg

SEQ ID NO: 429183 - DNA, 728 bp, Homo sapiens
  misc_feature: GZ8MTXP01A38PJ.19.71.G05.1.454.CMB.2.raw
  modified_base (246)..(246): a, c, t, g, unknown or other
  modified_base (257)..(257): a, c, t, g, unknown or other
  modified_base (323)..(323): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccgatacgaactgacaagtccagccactaattctttanacattaccaanatagaaactactagcttggaccagcagacgaccaggacagccctacgtaggctgctctatttacgngggactacgttaccgtaacccggggaatccccgggggtcccccctaggaccgtattcgaaggttcggccaagggtccggggtacgtacggggacctaagggttacttttaccaaccgttcctaccaaccgtacgtacaacggctaacggcccctggacccgaagggccttaagggaaagtacgttgggggtacgggtactttaaggtttttaacgttatttacggtaaaccttaaaacttaattttaaactttaagggtttaaacttaaaccgtttcgggtaacggggttaaaccggtttacccgggaaccccgaaaagggggtaccccgttaaaggggttacggttaattaacttaaccggaacggtaaacgtaaccggttgggttcggtaacgttctaacccg

SEQ ID NO: 429184 - DNA, 624 bp, Homo sapiens
  misc_feature: GZ8MTXP01B62DM.19.71.G05.1.454.CMB.2.raw
  modified_base (242)..(242): a, c, t, g, unknown or other
  modified_base (324)..(324): a, c, t, g, unknown or other
  modified_base (405)..(405): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgcaagtccagccactaattctttanacagttaccaaacaatagaaaactacttagcttaggtaccagacagagaccaggacacgccctcaggctgctctatttacgngggctacgtccgtaacccggggaacgtccccggggtcccccctaggaccgtattccgaggtcggcgaagggtccgggtcgnggggaacctaggtactttcaaccttctacacctatcacgcacgcctgacgaggctagaagtagtggggtggtagttagtttaattattcgtaacctaaataaatttatttaattaacttacgttcggtaacggtaccggtttcggaaccgaaaggggtaaccgtaagggttacggaacttagtaacgagtaaccgtaacgtggttacggcttcgaaccc

SEQ ID NO: 429185 - DNA, 586 bp, Homo sapiens
  misc_feature: GZ8MTXP01DBWFV.19.71.G05.1.454.CMB.2.raw
  modified_base (239)..(239): a, c, t, g, unknown or other
  modified_base (320)..(320): a, c, t, g, unknown or other
  modified_base (350)..(350): a, c, t, g, unknown or other
  modified_base (356)..(356): a, c, t, g, unknown or other
  modified_base (369)..(369): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagacctccctggctgtgtctcgtgggcgagcgggccacatcaactgcaagtccagccactaattctttanacagttaccaaacaatagaaaactacttagcttaggaccagacagacgaccagacagcctcctaggctgctctatttacgnggctatccgtaccggatcccggggtccccnggaccnttcgagtcgggcngggcggtcgtagggacagtactttcactctacaccatcagcacgcctgcgaggctaggaaagtgtggggtacggtacttaagttttattattacgtacaaattaaattatttaacttattaccgttggtaacggtaacgtttccgggaacgaaacggggtaaccagggttacggattacgtaacgaaagtccgtaagtggttacgggtcttcgaacc

SEQ ID NO: 429186 - DNA, 512 bp, Homo sapiens
  misc_feature: GZ8MTXP01AYP3U.19.71.G05.1.454.CMB.2.raw
  modified_base (478)..(478): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctgggaaggacatatttcatgtaccaacacgtaggaactacaaattatgacaaccatctgttgagagtcgactgaacatacaacgtagacacatacgaagaaccagttctcctgacagctgacctcgtgtacgcctccgaggacgtacggtgtatatcgtgtaggagacgccccgagtacgacnttcgcctaccgtcgtctcgttggtgttcgttaag

SEQ ID NO: 429187 - DNA, 612 bp, Homo sapiens
  misc_feature: GZ8MTXP01EQ1NF.19.71.G05.1.454.CMB.2.raw
  modified_base (247)..(247): a, c, t, g, unknown or other
  modified_base (329)..(329): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctcccgtggctgtgtctcgtgggcgaggccgggccacgatacaactgacaagtccagccacaattctttanactacttaccaataatagaaaactactagcttaggaccagacagacgaccgaggacagccctcgaggctgctctatttacgnggacacgttaccggacccgggtacgtcccggggtcccctaggacctattcgaggtcggacaagggtcgggtacgtagggaactaggtactttccactcctacaacctaactcaacgcaacggcctgacgagactaggaatgtacggggtggtattagtttatagttataacaattaattattaagttatacgttcggaaggtaccgttacgggaccgaaaggggtaccaagggttgacttagtaacgagtaaccgtaagtcggttacggtcttaacggaaccc

SEQ ID NO: 429188 - DNA, 573 bp, Homo sapiens
  misc_feature: GZ8MTXP01C7YSG.19.71.G05.1.454.CMB.2.raw
  modified_base (240)..(240): a, c, t, g, unknown or other
  modified_base (322)..(322): a, c, t, g, unknown or other
  modified_base (384)..(384): a, c, t, g, unknown or other
  modified_base (537)..(537): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgcaagtccagccaacaattcttttanacagttacccaaacaatagaaaactacttagctggtaccagcaagagaccaggacagcctcctaggctgctactatttacgngggcacgtccgaaccccgggtatcccggggtcctgacccgtattcgagtggacaggcgggtntgggactagtactttcactctacacatcagcacgcctgcgtaggctagaagtacgtggttaggggcttaaggtttattagttagtacaaataattattattattacgttcgtggtaaccgttcggaccgtaaagggccgtaaagggtgaattnttacgaagacgtaactggtcggactcgaactaaccg

SEQ ID NO: 429189 - DNA, 570 bp, Homo sapiens
  misc_feature: GZ8MTXP01EGAIY.19.71.G05.1.454.CMB.2.raw
  modified_base (231)..(231): a, c, t, g, unknown or other
  modified_base (242)..(242): a, c, t, g, unknown or other
  modified_base (251)..(251): a, c, t, g, unknown or other
  modified_base (261)..(261): a, c, t, g, unknown or other
  modified_base (311)..(311): a, c, t, g, unknown or other
  modified_base (354)..(354): a, c, t, g, unknown or other
  modified_base (368)..(368): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatacgaactgacaagtccagccanaattctttaanacatacaanatagaaactntagcttagacagacagacgacagacacgcctcagctgctactatttacgnggactagtccgtaaccggacgtcccgggtcccctacggacctnttcgaggtcggacncgggtcggtacgtacgggactagtacttcacttcacaccagtacacgacgacgtcgtcgacgacgacgtagagtagtagggtgtagttagtttagttattagtactaactaattattattattacttcgtcgtacgttacggtacgacggtacgtaaggttagttattacgtaagacgaacgtacgtagttacgtcgcgtcg

SEQ ID NO: 429190 - DNA, 528 bp, Homo sapiens
  misc_feature: GZ8MTXP01B4WLC.19.71.G05.1.454.CMB.2.raw
  modified_base (240)..(240): a, c, t, g, unknown or other
  modified_base (314)..(314): a, c, t, g, unknown or other
  modified_base (347)..(347): a, c, t, g, unknown or other
  modified_base (355)..(355): a, c, t, g, unknown or other
  modified_base (363)..(363): a, c, t, g, unknown or other
  modified_base (409)..(409): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgaggcgggccaccatcgaactgcaagtccagccacaatctttanacagttccaaacaatgaaaactcttagcttggaccagcagagaccaggacagcctcctaggctgctcatttacnggcatccgtaccggatcccggggtcccctgacntcagtgcngcgggtcngggacagtatttcactctcaccatcagcagcctgcaggctgaaagngtggggtgctagtttattactgtacaaatattattaattatacttcggtaaggtacgttcggacaaaggggacctaagggttggattagtcaaggaaccgtaagtgttcggcttgaacc

SEQ ID NO: 429191 - DNA, 520 bp, Homo sapiens
  misc_feature: GZ8MTXP01D19NH.19.71.G05.1.454.CMB.2.raw
  modified_base (220)..(220): a, c, t, g, unknown or other
tcagtactctcgtgcacgaccggtgctcgatttagtgtcgtcgcaagagagaggggagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaacgccctcgcagaccctntcgctcacctgtcgcccatcgtccggggacagagtcgctagcgacagtgttgcttggcacgtgggtcaggcacgtccccatcgagaggtctagagtggctgggaacgacatatttcatcgtaccaacacgtggaaatacaaattatgacaccatctgttgagagtacgactgacaatacaacgtagacacgatacgaaagaacctagttcctccctgcacgtctgacctctgtcgactcccggaggtacgacgggttgttattacttaacgtgtcggaagcggcccctaagttaacgaac

SEQ ID NO: 429192 - DNA, 648 bp, Homo sapiens
  misc_feature: GZ8MTXP01CBJSU.19.71.G05.1.454.CMB.2.raw
  modified_base (232)..(232): a, c, t, g, unknown or other
  modified_base (244)..(244): a, c, t, g, unknown or other
  modified_base (259)..(259): a, c, t, g, unknown or other
  modified_base (332)..(332): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccaccgatacgaactgacaagtccagccanaattcttttaanactacgttaccaaanaatacgaaaacttactagctacggacagacaagacgaccaggacacgcctcgtaggctgctatacgtttacgngggactacgtccgtaaccgggtacgtcccggggtcctacggaccgtatcgaggtcggaacgtacgggtcgggtcgtaggggactacgtactttaccgaccttcctaccaacctacgtacgacgaccacgtcctacgacgacgacgtacgtaagtagtaggtacggggtacgttaagtttaagtttaagttacgtaactaaactaattaattaacttattacgttacgtacggtaacggtacggttacggtaacggaacggtaaggtagttagttacgttacgtaagtacgtaacgtagtcggttcgtcgcgtaacg

SEQ ID NO: 429193 - DNA, 651 bp, Homo sapiens
  misc_feature: GZ8MTXP01CJCSA.19.71.G05.1.454.CMB.2.raw
  modified_base (401)..(401): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccacgatacaactgacaagtccagccacaattactttatactacgttacaaacaatagaaaactacttagcttaggtaccagacagagaccaggacagcctcctaggctagctactatttacgtgggctactaccgtaacccggggaacgttccgggggtcccccccttggaaccgtatttcgaacggttcgggacnggggcgggttcgtacggggactacgatttcactcctacacctactcgacgcacgtctgacgagtacgtaagaagtagttcggggtacggttactttaagttttattaacgttagtaactaaacttaaatttaagtttaactttaacgttacgtttcgggtaacggttacggttaccggtaaaccggaaagggtacggtaaggttagattacgtaacgaagaacgtaacgtggttaggtccgttgtaaccg

SEQ ID NO: 429194 - DNA, 628 bp, Homo sapiens
  misc_feature: GZ8MTXP01ASB39.19.71.G05.1.454.CMB.2.raw
  modified_base (245)..(245): a, c, t, g, unknown or other
  modified_base (330)..(330): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccgacggggacatcgtgatgacccagtcctccagactccctggctgtgtctcgtgggcgagcgggccaccatcaactgacaagtccagcccaactaattcttttaanacagttacccaaacaatacgaaaactacttagctaggtaccagcagacgaccgaggacagcctcctaggctgctactatttacgngggctacgtccgtaaccccgggaagtcccgggggtccctacggaccgtattccgaggtcggacagggtccggggtactaggggactaggtactttccactcctaccacatcagccagccctgcaggctagaagtgttggtggggacttaaggttttattagtttacgtaacctaaattaatttaatttaattacgttaccgtttcggttggtaaccggtttacggaccgaaaggggttaccgtaaagggtcgttattagttacgaagtacgtaacttggacgttcgtgaaccctaacg

SEQ ID NO: 429195 - DNA, 570 bp, Homo sapiens
  misc_feature: GZ8MTXP01BOKH4.19.71.G05.1.454.CMB.2.raw
  modified_base (243)..(243): a, c, t, g, unknown or other
  modified_base (269)..(269): a, c, t, g, unknown or other
  modified_base (324)..(324): a, c, t, g, unknown or other
  modified_base (443)..(443): a, c, t, g, unknown or other
  modified_base (451)..(451): a, c, t, g, unknown or other
  modified_base (538)..(538): a, c, t, g, unknown or other
  modified_base (557)..(557): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccgacggggacatcgtgatcgacccagtctccagactccctggctgtgtctcgtgggcgagcgggccacgatcaactgacaagtccagccaactaattcttttaanacagttaccaaacaatacgaaaactntagctaggacagcagacgaccaggacagccctcgtaggctagctactatttacgngggacacgtcccgtaccgggaatcccggggtcctacgaccgtattcgaggtcggaacgtaggtcgggtactcggggaactagttactttccacttcctacacctaatcagcagtcccgngacgaggnagagtagtgtaggtattagtttatatataactaatattattattatacgttcggacgtaacggtcgaacggaaacggacgtaaggtnagttgttagaagtagtcgngtgttgtcttcgc

SEQ ID NO: 429196 - DNA, 557 bp, Homo sapiens
  misc_feature: GZ8MTXP01EWKC0.19.71.G05.1.454.CMB.2.raw
  modified_base (284)..(286): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctcgtcgccacgtccgtaccggacgacgacgtcgcgtacgacgacgtagtgtnnncgtcgtcgtcgtacgtcggtacgtaccgaccgtaccgtaccgtacgtacggtacggtacggtacgtacggtacggtacggtacggtacggtacgtacggtacgttacgttacgtacgtaccgtaaccgtaaccgtaacggtaaacgtaaacgtaaacgtaaactaacgtacgtaaccgtaacgttacgttacgttacgtacggtacggttacgttacgttacgtaacgtaacgtaacgtaacgtaacgttaacgtaaccgttaacgtaacg

SEQ ID NO: 429197 - DNA, 584 bp, Homo sapiens
  misc_feature: GZ8MTXP01BW5PP.19.71.G05.1.454.CMB.2.raw
  modified_base (244)..(244): a, c, t, g, unknown or other
  modified_base (330)..(330): a, c, t, g, unknown or other
  modified_base (467)..(467): a, c, t, g, unknown or other
  modified_base (507)..(507): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctcgtggggcgagcgggccacgatacgaactgacaagtccagccactaattctttanacagttaccaacaatagaaaactactagcttaggtaccagacagagaccgaggacacgccctacgtaggctgccttctatttacgngggacacgtaccgtacccggggtaacgtccccccggggtcctaggacccgtattccgaaggttcggcagggcgggtcgtaggggacagtactttccacttctaccaccatccgagacacgcctagcaggctagaagngtgtggtctagtttatattgtactaaatattattattatntcggtgttacggttcgacgaaggggaccttaagggttcgttaataacgtacgaagtaccgtacgttggtcggctccg

SEQ ID NO: 429198 - DNA, 572 bp, Homo sapiens
  misc_feature: GZ8MTXP01DGR3T.19.71.G05.1.454.CMB.2.raw
  modified_base (242)..(242): a, c, t, g, unknown or other
  modified_base (321)..(321): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctggggcgagccgggccacatcaactgcaagtccagccaacaattcttttaanactattaccaaataatacaaactactagctagacagacagacgaccgagacacgcctcgtagctcgctactatttacgnggctacgtaccgtaaccggggacgtcccgggtccccctagacgtacttcgaggtcggcgcgggtccgggtcgagggactagtactttcactctacacatcagcacgcctgcgagcagaagtagtggtggtacttagtttatagttatactaaactaattattattacttacgttgttggtacgttcggacgaaggtaaccgtaaggttacgattacgtaagaagtaacgtaagtgttacggtcgttcgaac

SEQ ID NO: 429199 - DNA, 616 bp, Homo sapiens
  misc_feature: GZ8MTXP01DMDY9.19.71.G05.1.454.CMB.2.raw
  modified_base (231)..(231): a, c, t, g, unknown or other
  modified_base (243)..(243): a, c, t, g, unknown or other
  modified_base (255)..(255): a, c, t, g, unknown or other
  modified_base (330)..(330): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccacgatcaactgacaagtccagccanaattcttttaanactagtacaaanaatagaaactactagcttagaccagacagacgaccgaggacacgtccctacgtagctgactacttacgtttacgnggactacgtacccggtaacccggggtacgttccccggggtcccccaggtaccgtagtcgaggtcggacgtgggccgggtcgtagggactagtacttcactcacacatcagcacgctcgcgacgcgtagaagtagtgggtgtacgtagtttagttattagtactaaactaaattaattaattaacttacgttcgttaacggtacggttaccggtacggaacggtaacggtaaggttagttacgttacgtaacgtacgaacgtaacgtacgttacgtcgttcgtaacg

SEQ ID NO: 429200 - DNA, 715 bp, Homo sapiens
  misc_feature: GZ8MTXP01BLHCE.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtgccatcgtcgggacagagtcgctagcgacagtgtgcttggcacgtggtcaggcacgtccccagtccggagacggtctaggaggtggcgtagggggaaacggtactaagttactttacgaagttcgtaaccctaaacgtaaccgggttagggaaaactttaaaccgtaaaagtttactacgaccctaacctaactttaccgttagggtttacggaaggttaacggttacggtaaccgttacggaaacctaaaacgttaccgtaaaacggttaacggaaaccgtaaacctaaacgttaaccggaaaacggtaaacccttacgtttaccccttacccgtacgtaccgaacgtccgttacgtaccccttaacgttcggttaccgacccgttacccgggaacgggtaacggttaccggggttgttaattaacgttacgtaagggttacgggaacggttacccggaaccccgttaagtaaccgg

SEQ ID NO: 429201 - DNA, 607 bp, Homo sapiens
  misc_feature: GZ8MTXP01DBASZ.19.71.G05.1.454.CMB.2.raw
  modified_base (241)..(241): a, c, t, g, unknown or other
  modified_base (325)..(325): a, c, t, g, unknown or other
  modified_base (379)..(379): a, c, t, g, unknown or other
  modified_base (438)..(438): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgcaagtccagccacaattctttanacagttaccaaacaatagaaaactacttagcttaggaccagcaagacgaccaggacagccctacctaggctgctctatttacgnggctagtccgtacccggggatcccggggtccccctggacgtattcgagtcggcnggcgggtctgggacagtactttcactctcacatcagcagcctgaccgaggctagaaagngttaggggtaggtacttaaggtttttaattacttacgtaactaaacttaaattaatttatttaattacgtttcggtaacggttacgtttcgggacccgttaaaggggtaaccgtaagggttaacgttattacgtaaccgaagaacgtaactggttggtaaccttgaacc

SEQ ID NO: 429202 - DNA, 591 bp, Homo sapiens
  misc_feature: GZ8MTXP01DTPMY.19.71.G05.1.454.CMB.2.raw
  modified_base (531)..(531): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaagccctcgcacgaccctctcgctcacctgtcgccatcgtccggggacagagtcgctagcgacaggtgttgcttggctacgtgggtcacggcacgtccccagtcgagaggtctaggagtggcgtaggggaaggacattattcaattcgtaaccaaacgacggtaggaaataactaaattatcgacaacctatctgttagagtagtacgaactgaacaaatcaaacgtacgacaacaagtacgaaacgaacctacgttcctacccgtagctaacgtctacgaccttcgtcgttcgacccgttaccggaacggtacgttaacggggttnttaagttaacgttacgtcgggttaagggaacggttacccgggaaccccttaagtaaaccg

SEQ ID NO: 429203 - DNA, 646 bp, Homo sapiens
  misc_feature: GZ8MTXP01DYWB9.19.71.G05.1.454.CMB.2.raw
  modified_base (225)..(225): a, c, t, g, unknown or other
  modified_base (235)..(235): a, c, t, g, unknown or other
  modified_base (244)..(244): a, c, t, g, unknown or other
  modified_base (248)..(248): a, c, t, g, unknown or other
  modified_base (304)..(304): a, c, t, g, unknown or other
tcagtactctcgtgcacgaccggtgctcgatttagtgtcgtcgcaagagagagggggacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgcaagtccagccanaatcttttanacatacaanatanaaactctagctagacagcagacgacagacacgcctcgtagctgctactatttacgnggctacgtaccgtacccgggagtcccggggtacctacgaccgtattcgaggtcggacagggtcgggtcgtagggaactagtactttcacttcctaccacctatacgacgaccacgtccgtgacgacggtactagaagtagtggtacggggtacgtttaagttttaatttacgttacgtaactaaacttaatttaagtttatttaacttacgtttacggtacgggttaaccggtttccgggaaccggtaaacgggttaaccgtaaagggttacggttaaacgttacgttaccgtaacggtaacgtaacgttacggtacggttacgtaacgttaaccgtaaccg

SEQ ID NO: 429204 - DNA, 547 bp, Homo sapiens
  misc_feature: GZ8MTXP01BLP2O.19.71.G05.1.454.CMB.2.raw
  modified_base (418)..(418): a, c, t, g, unknown or other
  modified_base (542)..(547): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatagaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcctagtttatattgtacaaaacaataattattatacttcgtggtacgttcggaccaaaggggtaccaaagggttggaattaanacgaagaacgtaactgtcgtctgacactacgtcttcgttcttactactccttcccgtcctactctcgtacgacgagaagtacgttggacggcgggtcggtcggacgacggacgaacgagtaagnnnnnn

SEQ ID NO: 429205 - DNA, 586 bp, Homo sapiens
  misc_feature: GZ8MTXP01D1FYC.19.71.G05.1.454.CMB.2.raw
  modified_base (236)..(236): a, c, t, g, unknown or other
  modified_base (323)..(323): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcagcgcgccacatcaactgcaagtccagccactaattctttanacagttaccaaacaatagaaaactacttagcttaggtaccagacaagacgaaccaggacagccctcctaggctgctactatttacgngggcataccgtacccgggatcccggggtccccagacgtattcaggtggcaagggcggtgtagggactagtactttcgactctacaccatcagcacgcctgccaggctagaagtagtggggtaggtactagtttattagttgtacaaataaattatttaattattacgttggtaaggtaccgttcggacccgaaagggtaaccgtaagggttggttattagtaacgaaaggtaacggtaaacgtggttacggtcgttcgtaacc

SEQ ID NO: 429206 - DNA, 628 bp, Homo sapiens
  misc_feature: GZ8MTXP01EJ70N.19.71.G05.1.454.CMB.2.raw
  modified_base (237)..(237): a, c, t, g, unknown or other
  modified_base (261)..(261): a, c, t, g, unknown or other
  modified_base (283)..(283): a, c, t, g, unknown or other
  modified_base (299)..(299): a, c, t, g, unknown or other
  modified_base (619)..(619): a, c, t, g, unknown or other
  modified_base (621)..(621): a, c, t, g, unknown or other
  modified_base (623)..(624): a, c, t, g, unknown or other
  modified_base (626)..(626): a, c, t, g, unknown or other
  modified_base (628)..(628): a, c, t, g, unknown or other
tcagtactctcgtgcacgaccggtgctcgatttagtgtcgtcgcaagagagaggggcacttctccctctaacactctccccagtctccagactccctggctgtgtctctgggcgagccgggccaccgatacgaactgacaagtccagccacaatcttttatacagttccaacaatgaaaactacttagcttggtaccagcagagaccaggacagcctcctaggctgctcatttacgnggcatcgtaccggatccgggtccngacgatgagtgcaggcggtcgnggacagtattcactcncacatcgagcagcctgacaggctagaagtgtggtgtacttagtttattagttagtaacctaaaaattaaatttaagtttaactttaagttaccgtttacgggtagggtaccggttacgggaaccgaaaggggtaaccgtaagggttaggaattagtacgaacgtaacgtaacgtagtacggtacgtacgtacgtacctacgttcgttcgttaccttacttaccttcccttcccgtacctactacgtacgtaacgtacgaacgtaacgtacgttacggtacggacgggtacggtacggacggacggacggaacgagtaagngngnngngn

SEQ ID NO: 429207 - DNA, 561 bp, Homo sapiens
  misc_feature: GZ8MTXP01AMKD3.19.71.G05.1.454.CMB.2.raw
  modified_base (242)..(242): a, c, t, g, unknown or other
  modified_base (321)..(321): a, c, t, g, unknown or other
  modified_base (373)..(373): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgccccacggggacatcgtgatgacccagtctccagactccctggctgtgtctcgtgggcgagcgggccaccatcaactgcaagtccagccactaatcttttaanacagttaccaaacaatagaaaactacttagcttggtaccagcagagaccaggacagcctcctaggctgctcatttacgngggcatccgtacccggggaatcccgggggtccccctggacgattcagtggcnggcgggtctgggacagtattcactctcaccatcagcacgcctgcgaggctagagatgggtggctagtttattattgactaaactaaattaattattaagttacttcggtaacggtacgttacggacccaaaggggtaccaaagggttggattacaacgaggaacgtaacgtggttcggcttggaaccc

SEQ ID NO: 429208 - DNA, 765 bp, Homo sapiens
  misc_feature: GZ8MTXP01DIQTV.19.71.G05.1.454.CMB.2.raw
  modified_base (241)..(241): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccacatcaactgcaagtccagccactaattcttttanacagttaccaaacaatagaaaactacttagcttaggtaccagcagacgaccaggacacgcctctaggctgctctatttacgtgggactagtccgtaaccccggggaattccccgggggttccccccaggtaaccgtagtttacccgaagggttcgggacgtaacgggccggggttacgttacgggggaaacctagggtaactttttccaaccttccttaccaaccctattaccgaacgccgaaacggtaccccttggacccgaaaggggccttaaagggaaaacggtacgttaggggggttaccggggtacttttaaacgggtttttaaactttacgtttaaggttaaaccctaaaactttaaaatttaacttttaaagtttaacttaaaccgttttccggggttaagggtaacccggttttaccggggaaccgttaaaacgggggtaacccgtaaagggtttacggaattaacgtaaccgaaagtaacccgtaaacgttggttagggtccttaacggaacccg

SEQ ID NO: 429209 - DNA, 504 bp, Homo sapiens
  misc_feature: GZ8MTXP01DEWIB.19.71.G05.1.454.CMB.2.raw
  modified_base (320)..(320): a, c, t, g, unknown or other
  modified_base (336)..(336): a, c, t, g, unknown or other
  modified_base (379)..(379): a, c, t, g, unknown or other
  modified_base (418)..(418): a, c, t, g, unknown or other
  modified_base (467)..(467): a, c, t, g, unknown or other
  modified_base (496)..(496): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctgggaagcatatttcatgtaccaanacgtgaatacaaattntgacaaccatctgttgagagtcatgacaatcaacgtagacaanatacgaaagaacctagttcctaccctgacagctgacctngtgacctccgagacacggtgtatattctgtagagacggccccatcgacnttacgccctaccgtcgtctcgttgggtcncgtttaag

SEQ ID NO: 429210 - DNA, 560 bp, Homo sapiens
  misc_feature: GZ8MTXP01CZSS0.19.71.G05.1.454.CMB.2.raw
  modified_base (226)..(226): a, c, t, g, unknown or other
  modified_base (235)..(235): a, c, t, g, unknown or other
  modified_base (246)..(246): a, c, t, g, unknown or other
  modified_base (312)..(312): a, c, t, g, unknown or other
  modified_base (377)..(377): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccanaatctttanacattccaaanaatgaaaactcttagctggtaccagcagagaccaggacagccctccgtaggctgctctatttacgngggacatccgtaccccgggaatcccgggggtccctcgacccgtattcgagtggacaggcgggttntggggacaggtactttcactctcacatcagcagcctgcaggctgaagatggtggatagtttaattagttgactaaatatttaattattattacgttacgtgggtaactttcggacgtaaacgggccgtaaagggtggttaattgttacgaaggaacgtaacgtgtggttcttgaacctaaccg

SEQ ID NO: 429211 - DNA, 519 bp, Homo sapiens
  misc_feature: GZ8MTXP01CEXOQ.19.71.G05.1.454.CMB.2.raw
  modified_base (333)..(333): a, c, t, g, unknown or other
  modified_base (368)..(368): a, c, t, g, unknown or other
  modified_base (449)..(449): a, c, t, g, unknown or other
  modified_base (455)..(455): a, c, t, g, unknown or other
  modified_base (487)..(487): a, c, t, g, unknown or other
  modified_base (508)..(508): a, c, t, g, unknown or other
  modified_base (511)..(511): a, c, t, g, unknown or other
  modified_base (513)..(517): a, c, t, g, unknown or other
  modified_base (519)..(519): a, c, t, g, unknown or other
tcagtactctcgtgcacgaccggtgctcgatttagtgtcgtcgcaagagagagggggcacttctccctctaacactctcccagtctccagactccctggctgtgtctctgggcgagcgggccaccatcaactgcaagtccagccacaattcttttatacagttccaacaatagaaaactacttagcttggtaccagcagagaccaggacagcctctaggctgctcatttactgggcatcgtacccggggaatccgggggtccctgaccgattcagtggcaggcgggtctgggacagatttcactctcaccatcagcagcctgcaggctgaagntgtggacctagtttatattgtacaaaaactaattnttacttagtaactttcggtaggacgttcggaccaaagggacctaaaggtgatatcaagacaatgtggctagcacagtcttntctacncgtcctccgactatctgacagagtaagtacgnggacgcggtgtgcgacgacgnagngnnnnngn

SEQ ID NO: 429212 - DNA, 565 bp, Homo sapiens
  misc_feature: GZ8MTXP01BFGWG.19.71.G05.1.454.CMB.2.raw
  modified_base (235)..(235): a, c, t, g, unknown or other
  modified_base (312)..(312): a, c, t, g, unknown or other
  modified_base (339)..(339): a, c, t, g, unknown or other
  modified_base (354)..(354): a, c, t, g, unknown or other
  modified_base (447)..(447): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatctttanacagttaccaaacaatagaaaactacttagcttaggtaccagcagagaccagacagcctcaggctgctcatttacgnggcatccgaccgggatccggggtcccngacgtatcgagtgcnggcggtcgtgggacagtattcactctcacatcagcacgctgcaggctagaagtgtgggtggtacttaagtttattatcgtacaaattaaattnttaattactacgtttcggtggtaacgttccgggaaaccttaaggggtaaacctaaggggttaggttattaacgtaacgaacgggtaacgtaacgtggttcgggtaacttcggtaaccc

SEQ ID NO: 429213 - DNA, 679 bp, Homo sapiens
  misc_feature: GZ8MTXP01ELBAG.19.71.G05.1.454.CMB.2.raw
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactgggtgaacgcccctcgcacgacccctctcgctcacctgtcgcccagtcgtccggggacagagtcgctagcgacagtgttgcttggcacgtgggtcaggcacgtccccagtcgagaggtctagagtggcgtaggggaacgactatatttacgattacgtacccaacgtacggtaggaaacttaactaaaagtttactacgacctaacctaattcgttaggttagaaggtaggtaccggtaactaggaacctaaagtaccgtaaacgttaagaaaccaacggtaacgttaaccggaaaacgtaaacccgtaacgtttcccctaccccgttaggaccgtacgtaccgtaccggtaacccttcggttcggttaccggaacccgttaccccgggaacgggtaaccggtaacgggggttagttaagtttacgtttaacggtggttaacgggaacggacccgggttaccccaaggttaacgtaaccg

SEQ ID NO: 429214 - DNA, 609 bp, Homo sapiens
  misc_feature: GZ8MTXP01CV3QG.19.71.G05.1.454.CMB.2.raw
  modified_base (242)..(242): a, c, t, g, unknown or other
  modified_base (320)..(320): a, c, t, g, unknown or other
  modified_base (362)..(362): a, c, t, g, unknown or other
  modified_base (376)..(376): a, c, t, g, unknown or other
  modified_base (443)..(443): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatcgacccagtctccagacctccctggctgtgtctcgtgggcgagccgggccaccatcaactgacaagtccagccataattctttanacagttaccaaacatagaaaactctagcttaggaccagacagacgaccaggacagcctcctaggctgctcatttacgnggactatccgtaacccgggatccccggggtcccctcggacgnttccgaggtcggcnggtccgggtcgtagggactagtactttcactctacactatcagtcagtccctagcgagctagaaagngtggggtcggtacttaagtttacttattgtaactaaactaaattacttaattacttaacgtttcggtaacgggttaccgttccgggtaaccgaaaggggtaaaccgtaagggttacggttattaccgtaagaacggtaaccgtaagtcggttaggtcttcgtaacc

SEQ ID NO: 429215 - DNA, 588 bp, Homo sapiens
  misc_feature: GZ8MTXP01EBR7O.19.71.G05.1.454.CMB.2.raw
  modified_base (239)..(239): a, c, t, g, unknown or other
  modified_base (253)..(253): a, c, t, g, unknown or other
  modified_base (459)..(459): a, c, t, g, unknown or other
  modified_base (472)..(472): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacatcaactgacaagtccagccataattctttanacagttacccaaanaatagaaaactcttagctggaccagcagagaccaggacagcctcgtaggctgcctatatttacgtgggactagtccgtaaccccgggaatccccggggtccctaggaccgtattcgaggtcggcacgggcggggtctaggggactagtatttccgaactctaccactatcaagcacgcctgcgagctagaagtagtggtaggggtnttagtttattatntacctaaataattaattataacttcgttacgtggtaaccgttcggaccgaaagggaaccgtaagggttggacttattacgaacgtaacgtaagtggtacggcgttcgccgtaaccg

SEQ ID NO: 429216 - DNA, 583 bp, Homo sapiens
  misc_feature: GZ8MTXP01CFPYF.19.71.G05.1.454.CMB.2.raw
  modified_base (221)..(221): a, c, t, g, unknown or other
  modified_base (343)..(343): a, c, t, g, unknown or other
  modified_base (363)..(363): a, c, t, g, unknown or other
tcagtactctcgtgcacgaccggtgctcgatttagtgtcgtcgcaagagagagggggcagagtctgctgaattctggctgaccagggcagtcaccagagctccagacaatgtctgtctccttctcttcttcctgcccgtgctgggcctcccacaaggtgtcctgtcacaagtacagctgcagcagtcaggtccaggactggtgaagccctgcacgaccctntcgctcacctgtgccatcgtccggggacagagcgctagcgacagtgtgcttggcacgtggtcaggcagtccccatcgagaggtctagagtggctagggaagacagtattcaatcgtccaaancgtaggaaataacaaattanacgacactatcgtagtagagtagtacgactagaactaataacgaaacgtagaacgaactagtaacgaaacgtaaccgtacgttacctacccgtagaccgtacgtacctaccgtaccgttcgtacgttaccgtaacccgttaccggaacggtaacgttacgggttattaacgttaacgttacgtaacggtaacggaacgacccgtaacccgttaagtaacg

SEQ ID NO: 429217 - DNA, 572 bp, Homo sapiens
  misc_feature: GZ8MTXP01AEE8F.19.71.G05.1.454.CMB.2.raw
  modified_base (448)..(448): a, c, t, g, unknown or other
  modified_base (470)..(470): a, c, t, g, unknown or other
  modified_base (490)..(490): a, c, t, g, unknown or other
  modified_base (523)..(523): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcagaccctctcgctcacctgcgcccagtccgtccgggggacaggacgtcgctagcgacaggtgttgcttggctacgtggtcaggccacgtccccagtcgagtaggtctagagtggcgtagggaaggactattattcaattcgtccaaagtacgtaggaaacttaacaaatttactacgaccaacctattcgtaggttagagtacgtacgactagaacagtacaaacgtagacanagtacgaaacgaacctgttccnccctagcctagcctgacctntcgttgacccttccggaggtaacgttcgggttnttagttaattcgtaaggtacgggaacgttaccggtaaccccaagtaacg

SEQ ID NO: 429218 - DNA, 540 bp, Homo sapiens
  misc_feature: GZ8MTXP01B4ACL.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcacgtccccatcgagaggtcgtagagtggcgtggggaacggactattatttcatcgtaccaacgacgtaggaaatacaaattatgacacctatctgttgagagtacgactgaacaatacaaacgtagaacacatacgaaagaaccagttcctccctgaccagtctcgacctctgtcgaccgtcccgaggaccgtacgggttgttattacgttaacgtggtaaggaacgacggacccctaagttaacgaac

SEQ ID NO: 429219 - DNA, 554 bp, Homo sapiens
  misc_feature: GZ8MTXP01ACM0D.19.71.G05.1.454.CMB.2.raw
  modified_base (224)..(224): a, c, t, g, unknown or other
  modified_base (356)..(356): a, c, t, g, unknown or other
  modified_base (375)..(375): a, c, t, g, unknown or other
  modified_base (512)..(512): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcagacccctntcgctcacctgtcgcccagtcgtccggggacagagtcgctagcgacagtgtgcttggcacgtggtcaggcacgtccccagtcgagaggtctagagtggcgtaggggaaggacatatttcaaatcgtccaaanacgtaggaatacgaaattntagcacatctgttagagagtcgactagaacaatacgaaacgtagaacgacagtaccgaaacgaaccctagttccacccgttagaccaagccttcgacccttcgtcgttcgaccgttccggaaggacgttacgggttnttattaagttacgtggtacggaagaccggccccaagtaaccg

SEQ ID NO: 429220 - DNA, 552 bp, Homo sapiens
  misc_feature: GZ8MTXP01DTW0N.19.71.G05.1.454.CMB.2.raw
  modified_base (238)..(238): a, c, t, g, unknown or other
  modified_base (316)..(316): a, c, t, g, unknown or other
  modified_base (346)..(346): a, c, t, g, unknown or other
  modified_base (364)..(364): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttaccaaacaatagaaaactacttagcttggtaccagcagagaccaggacagcctcctaggctgctcatttacngggcatcctaccgggatcccggggtccccnggaccgattcagtcggcnggcgggtctggggacagtatttcactctcaccatcagcagcctgcaggctgaagatggggtggctaagtttattattgtacaaataaattattaattatacgttcgtaaggtacgtttcgggacccgttaaaggggaccctaaggggttgattatcgaaagaaccgtaagtggttaggtcttggaacc

SEQ ID NO: 429221 - DNA, 546 bp, Homo sapiens
  misc_feature: GZ8MTXP01BHV53.19.71.G05.1.454.CMB.2.raw
  modified_base (221)..(221): a, c, t, g, unknown or other
  modified_base (230)..(230): a, c, t, g, unknown or other
  modified_base (313)..(313): a, c, t, g, unknown or other
  modified_base (393)..(393): a, c, t, g, unknown or other
tcagtactctcgtgcacgaccggtgctcgatttagtgtcgtcgcaagagagagggggacaacaggcaggcaggggcagcaagatggtgttgcagacccaggtcttcatttctctgttgctctggatctctggtgcccacggggacatcgtgatgacccagtctccagactccctggctgtgtctctggcgagcggccaccatcaactgcaagtccagccanaatctttanacagttacccaaacaatagaaaactacttagctggtaccagcaagacgaccaggacagccctctaggctgctactatttacgngggacatccgtacccgggaatcccgggggtccctgaccgtattcgagtcggacaggcgggtctgggacagtattcactcncacatcagcagccctgcgaggctagaagagtcgtggggtactaggtttaattattgtacaaactaattaattattattacgttcgtggtaacgtcggacgaaacgggcgtaaaggtgattattcgaagtacgaactggcgttctcgctaaccg

SEQ ID NO: 429222 - DNA, 626 bp, Homo sapiens
  misc_feature: GZ8MTXP01BIOO3.19.71.G05.1.454.CMB.2.raw
  modified_base (246)..(246): a, c, t, g, unknown or other
  modified_base (323)..(323): a, c, t, g, unknown or other
  modified_base (396)..(396): a, c, t, g, unknown or other
  modified_base (405)..(405): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccgatcgaactgacaagtccagccaactaattcttttaanacagttaccaaacaatagaaaactctagcttaggtaccagcagagaccaggacagcctctaggctgctcatttacgngggacatccgtacccggggaatccccccgggggtccctaggacccgtattcgaaagtgggcagggccggggtntaggggacnggtacttttcacttctacaccatcagacacgcctcgcgacggacgtagaagtaaggtagtgggtacgttaagttttaagtttagtttagttacctaaacttaaattaatttaatttaatttaacctttcggttagggttacggttacggttaccgtaaacgggtaaccggaaacggttaggttaagtaacttacgaagtaacgaacgttagtggttcgtcg

SEQ ID NO: 429223 - DNA, 540 bp, Homo sapiens
  misc_feature: GZ8MTXP01AN7HW.19.71.G05.1.454.CMB.2.raw
  modified_base (238)..(238): a, c, t, g, unknown or other
  modified_base (249)..(249): a, c, t, g, unknown or other
  modified_base (314)..(314): a, c, t, g, unknown or other
  modified_base (362)..(362): a, c, t, g, unknown or other
  modified_base (448)..(448): a, c, t, g, unknown or other
  modified_base (506)..(506): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaanaatagaaaactactagcttaggtaccagcagagaccaggacagcctctaggctgctcatttacgnggcatcgtacccgggatccggggtcccctgaccgtattccagtcggcnggcgggtctgggactagatttcactctcaccatcagcagcctgcaggctagaagtatgggtggtactagtttattattgtactaanaaattattaattacttactcggtggtaacgttcggaccttaagggacctaaggttggnttagtcgagaacgtaacgtgttcggtcaagaacc

SEQ ID NO: 429224 - DNA, 634 bp, Homo sapiens
  misc_feature: GZ8MTXP01CRTQR.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatctccgggggacaggagtcgctagcgactagtgtgcttggcacgtgggtcaggcacgtccccagtcgagaggtctaggagtggcgtaggggaaggactagtatttcgaattacgtcccaaacgtacggtagggaaataccgaaaattatacgactaccaatcgtgttagagagtacgactgacaatacaacgtagacacaacgtacgaaacgaacctacgtttcctacccgttcgcctaacggtcctacggtaaccctcgttacggttaccggacccgttaccccgggaaacggggtacccgttaacgggggtttacgtttaacgttaacgttttaaccggttgggtaacggggtaaaccgggttaccgggtaaccccccttaaggtaaaccgg

SEQ ID NO: 429225 - DNA, 660 bp, Homo sapiens
  misc_feature: GZ8MTXP01CL68D.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccatccgtccggggacagacgtcgctagcgacagtgtgcttggcacgtgggtcaggcacggtccccagtcgagacggtctaggagtggcgtaggggaaggactagttatttcaagttcgtaacccaaagtaccggtagggtaaactaactaaaagtttacacgtacctaacccgtattaccgttaggtttacggaaggtaacgttaccggtaacttacggaaactaaagttaaccgaaacgttaacgaaccgaactaaacgttaccgaaaacggtaacccttacgtttaccctaccccgttagaccgtaacgtccttacggaacccctttcgtcggttaccgtaacccgttcccggaaacggtacgttacgggttagttacttaacgttagtcggtaggacgaccggccccttaagtaaccg

SEQ ID NO: 429226 - DNA, 612 bp, Homo sapiens
  misc_feature: GZ8MTXP01BA4O9.19.71.G05.1.454.CMB.2.raw
  modified_base (231)..(231): a, c, t, g, unknown or other
  modified_base (239)..(239): a, c, t, g, unknown or other
  modified_base (248)..(248): a, c, t, g, unknown or other
  modified_base (250)..(250): a, c, t, g, unknown or other
  modified_base (252)..(252): a, c, t, g, unknown or other
  modified_base (258)..(258): a, c, t, g, unknown or other
  modified_base (261)..(261): a, c, t, g, unknown or other
  modified_base (309)..(309): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggcacgatacgactgacaagtcagccanaatcttanacatacaanananaaactntanctagacagacagacacagacacgcctcgtagctgactatactttacgnggactacgtaccgtaacccgggtacgtcccggggtccccctaggacgtagttacgaggtacggacgcggtcgggtacgggtacgggtacgtagtacttactactcctacctaccactacgacgacgacgtcgtcgacgacgacgtagaagtagtgggtgtagttagtttattattagtactaataattattattacttacgttacgttaacggtacggttacggtacggaacggtaacgtaacggttacggttacgttacgtaacgtaacgtaacgtacgtacggttacggtcgttcgtaacg

SEQ ID NO: 429227 - DNA, 544 bp, Homo sapiens
  misc_feature: GZ8MTXP01DYC94.19.71.G05.1.454.CMB.2.raw
  modified_base (222)..(222): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttctcctgccgtgctgggcctcccacaaggtgtcctgtcacaagtacagctgcagcagtcaggtccaggactggtgaacgccctcgcagaccctntcgctcacctgtcgccatctccggagacagagtcgctagcgactagtgttgcttggcacgtgggtcaggcacgtccccatcgagaggtctaggagtggccgtaggggaagactattagttcatcgtaccaaagacgtaggaaatacgaaattatgacactatctgttagagagtcactgacaatacaagtagacactagtacgaaagtaacctgttacctacccgtgacctagtctacgtaacctcgttgtacgacctccggaagggacgttcgggttattaagttaacgttcggtaggacggaacgtccggaacccctaag

SEQ ID NO: 429228 - DNA, 517 bp, Homo sapiens
  misc_feature: GZ8MTXP01B3Y5C.19.71.G05.1.454.CMB.2.raw
  modified_base (339)..(339): a, c, t, g, unknown or other
  modified_base (405)..(405): a, c, t, g, unknown or other
  modified_base (453)..(453): a, c, t, g, unknown or other
  modified_base (502)..(502): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgtgcttggcactggtcaggcagtccccatcgagaggtctagagtggctgggaaggacattatttcatgtaccaacacgtggaaactacaaattngacaaccatcgtgttgagagtcgactggacaatcaacgtagacacagtacgaaagaaccagttccncctagcaagctacggacctcgtgtcgacctcccggaaggacgacggtntatacttacgtgtaggagaccgccccatacgacattcgccacctcgtcngttcggtgccttaag

SEQ ID NO: 429229 - DNA, 635 bp, Homo sapiens
  misc_feature: GZ8MTXP01EB28U.19.71.G05.1.454.CMB.2.raw
  modified_base (239)..(239): a, c, t, g, unknown or other
  modified_base (248)..(248): a, c, t, g, unknown or other
  modified_base (257)..(257): a, c, t, g, unknown or other
  modified_base (261)..(261): a, c, t, g, unknown or other
  modified_base (270)..(270): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgcccacggggacatcgtgatgacccagtctccagactccctggctgtgtctcgtggggcgaggccggggcctacgactacggaccgtcgactaaggtccagccanaatctttanacatacaanatanaactactanctgtacagacagacgacagacacgcctctacgctcgtctctacttacgtggcgtacgtacgtaccggtacggtccggtccgtccgtaccgtacgtacgtacgtacggacgacggtcgggtcggtacgggtacgtacgtacgttactactctacctacctactacgacgacgacgaccgtcgacgacgacgtagtagtagtaggtacgggtacgttagtttattagttagtactaactaattaatttactttattacgttacgttcggttaacggttacggttaccggtaacgggttaacggtaacggtacgttagttacgttacgtaacgtaacgtaacgtaggtcggttacgtcgttcgtaacg

SEQ ID NO: 429230 - DNA, 664 bp, Homo sapiens
  misc_feature: GZ8MTXP01AC381.19.71.G05.1.454.CMB.2.raw
  modified_base (242)..(242): a, c, t, g, unknown or other
  modified_base (251)..(251): a, c, t, g, unknown or other
tcagtactctcgtgcacgaccggtgctcgatttagtgtcgtcgcaagagagaggggaggtacaacaggcaggcaggggcagcaagatggtgttgcagacccaggtcttcatttctctgttgctctggatctctggtgcccacggggacatcgtgatgacccagtctccagactccctggctgtgtctctggggcgagcggggcacgatacgaactgactaagtccagccacaatcttttaanacagtcaanatagaaactctagctagacagcagacgacagacagtcctctagctgctactatttacgtggactacgtaccgtaacccgggaacgtcccggggtacccctaggaccgtagttccgaggtcgggaccaacgggtccggggtacgtacggggaacctaggttactttaccgaccttcctaccgaacctaacgtacgacgacgacgtaccgtacgtacgacggtacgtacggtaacgtaagtacggggtacggtacgttaagtttaagtttagttagtacgtaaactaaacttaatttaattaacttacgttacgttaacggtacggttacggtaccggttaaacgggtaaacggtaacggttaggttagttacgtaacgtacgaacgtaacgtacggttacggtcgttcgtaacg

SEQ ID NO: 429231 - DNA, 616 bp, Homo sapiens
  misc_feature: GZ8MTXP01AC062.19.71.G05.1.454.CMB.2.raw
  modified_base (328)..(328): a, c, t, g, unknown or other
  modified_base (438)..(438): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtggcgagccgggccacatcaactgacaagtccagccactaattctttatactacgttaccaaacaatacgaaaacttactagctacggtaccagcaagacgaccaggacacgcctccgtaggctgctactagtttacgngggacctacgtccggtaacccgggtacgtccccgggggtacctcggaccgtattcgaggtcggacgagggtcgggtcgtaggggaactagtactttcacttctaccaccntacgagccaggccctagccgaggtctagaaagtgtggtagggtacttagtttatagttagtaacaaatatttaattattacgttacgttcgtcgggtaacgttcggacggtaaagggttaccgtaaagggtgacgttacttacgaacggtacgtaacgtggacgttcgtcgctaaccg

SEQ ID NO: 429232 - DNA, 590 bp, Homo sapiens
  misc_feature: GZ8MTXP01CTHQ2.19.71.G05.1.454.CMB.2.raw
  modified_base (242)..(242): a, c, t, g, unknown or other
  modified_base (323)..(323): a, c, t, g, unknown or other
  modified_base (381)..(381): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccacatcaactgacaagtccagccactaattctttanacagttaccaaacaatagaaaactacttagcttaggaccagcaagagaccaggacagccctcgtaggctgctcatttacgngggctagtccgtaacccggggatcccgggggtccccctggacctattcgagtcgggcnggcgggtactggggacagtactttcactcctacaccatcacgcacgcctgacgaggctaggaaagtgtggggtggtactagtttattatcgtacaaattaattatttaattacttacgttggtaacggtaacgttccggaacgaaacggggtaacctaagggttgttaattacgtaacaaggtaacgaacgttggacggtcttgaaccc

SEQ ID NO: 429233 - DNA, 576 bp, Homo sapiens
  misc_feature: GZ8MTXP01AQ8IJ.19.71.G05.1.454.CMB.2.raw
  modified_base (243)..(243): a, c, t, g, unknown or other
  modified_base (255)..(255): a, c, t, g, unknown or other
  modified_base (318)..(318): a, c, t, g, unknown or other
  modified_base (350)..(350): a, c, t, g, unknown or other
  modified_base (418)..(418): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccacgatcaactgacaagtccagccacaattcttttanacagttaccaanaatagaaaactacttagcttggtaccagcagagaccagacagcctctaggctgctcatttacnggctagtccgaacccgggatcccggggtcccnggaccattcgagtgcctgcgggtctgggactagactttcaactctcaccatcagcagcctgccagggngagagtagtaggtgtagttagttagttagttagtactaactaattaattaattacttacgttacgttaacggtacggttacggtaccggaacggtaacgtaaggttaggttacgttagtaacgtaacgtaacgtaacgtacgttacggtcgttcgtcg

SEQ ID NO: 429234 - DNA, 643 bp, Homo sapiens
  misc_feature: GZ8MTXP01CVA47.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccatccgtccggggacagagtcgctagcgacagtgttgcttggcacgtgggtcaggcacgtccccagtcgagaggtctaggagtggcgtagggaagactattatttcattcgtaccaaacgacgtaggaaactaactaaattgtacgaccaaacctattcgttaggttagaaggtacgtaccgaactacgaaactaaacgtacaaacgtaacgaacaacaagtaacgaaacgtaaacctacgttaccctaccgtgacgacgtcgtacgtacccgttcgtacgtacgtacccgtacccggaggtaaccggtacgggttagttaattacgttacgtaaggtaacgggaacggtaccgaccccgtaaagtacgaacgttcgttaccgtccctacccgttcgttcgttcgttcggttcgttaacgttaacgg

SEQ ID NO: 429235 - DNA, 614 bp, Homo sapiens
  misc_feature: GZ8MTXP01EXRJ4.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatccgtccggggacagagtcgctagcgacagtgttgcttggcacgtggtcaggcacgtccccagtccgagtaggtctagagtggcgtaggggaaggacagtctttcaaattcgtaaccaaacgacggtaggaaacttaacgtaaattatacgacctaacctattactgttacgagtacgtcgaactgaacaataccgaaacgtacgaacgaactacgtaacggaaacgtaacccgtacgtttaccctccctaggcctaaggtccttacgtaccctcgttcgttaccggtaccttccccgggtaaggacccgttacgggggttcttaagtaacttacggttggacgggtaacggaccggccccttaagtaaccgg

SEQ ID NO: 429236 - DNA, 563 bp, Homo sapiens
  misc_feature: GZ8MTXP01AK70Z.19.71.G05.1.454.CMB.2.raw
  modified_base (238)..(238): a, c, t, g, unknown or other
  modified_base (313)..(313): a, c, t, g, unknown or other
  modified_base (340)..(340): a, c, t, g, unknown or other
  modified_base (346)..(346): a, c, t, g, unknown or other
  modified_base (352)..(352): a, c, t, g, unknown or other
  modified_base (360)..(360): a, c, t, g, unknown or other
  modified_base (367)..(367): a, c, t, g, unknown or other
  modified_base (394)..(394): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgacaagtccagccacaatctttanacagttccaacaatagaaaactctagcttaggtaccagcagagaccaggacagcctctaggctgctcatttacgnggcatccgaccggacgtccgggtcccngacgtntcaggngcgggggntcgggtntgggactagtacttccactctacacancagcacgctgacgagtcagaagagtgggtgtattagtttattattgtaactaaataaattatttaattacttacgttcggtaacggtaccgttcggaaccgaaagggtaaccgtaaggttagttattacgtaacgaacggtaacgtaacgtgttacggtcgttcgaacc

SEQ ID NO: 429237 - DNA, 663 bp, Homo sapiens
  misc_feature: GZ8MTXP01AM9QY.19.71.G05.1.454.CMB.2.raw
  modified_base (235)..(235): a, c, t, g, unknown or other
  modified_base (248)..(248): a, c, t, g, unknown or other
  modified_base (315)..(315): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcaactgcaagtccagccacaatcttttaanacagttaccaaanaatagaaaactactagctagaccagacagacgaccaggacacgcctcgtagctgctactatttacgnggcacgtccgtaacccgggagtcccggggtcctcggaccgtattcgaggtcggacgagggtccgggtcgtaggggactagttactttccacttcctaccaacctactacgacgccacgtccgtagacgacgggactaggaaagtagttggtacggggtacgttaaggttttattaacgtttacgtaactaaacttaaatttaacgtttaatttaacgttaccgtttacgggttacgggtaaccggtttaccgggaaaccggtaaacggggaaccgtaaagggttaggttaacgttacgttaccgaagtaacggtaacgttgggtacggttacctcgaacccgtaaccg

SEQ ID NO: 429238 - DNA, 517 bp, Homo sapiens
  misc_feature: GZ8MTXP01EEZJ0.19.71.G05.1.454.CMB.2.raw
  modified_base (458)..(458): a, c, t, g, unknown or other
  modified_base (485)..(485): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaagccctcgcagaccctctcgctcacctgtcgccatctccggggacagagtcgctagcgacagtgttgcttggcacgtgggtcaggcacgtccccatcgagaggtctagagtggcgtgggaaggacagtatttcaatgtccaacacgtagaatacaaattatgacactatctgttagagtagtcgactagaactaatacaaacgtagacgaacaatacgaaacgaacctagttcctccctagcagctcgacctntcgttgaccttccgaggacacgggttnttataatacgtgtggagacgtcccaagtaacg

SEQ ID NO: 429239 - DNA, 578 bp, Homo sapiens
  misc_feature: GZ8MTXP01ELDXM.19.71.G05.1.454.CMB.2.raw
  modified_base (241)..(241): a, c, t, g, unknown or other
  modified_base (327)..(327): a, c, t, g, unknown or other
  modified_base (473)..(473): a, c, t, g, unknown or other
  modified_base (517)..(517): a, c, t, g, unknown or other
  modified_base (566)..(566): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccaccatcaactgacaagtccagccataattctttaanacagttacccaaataatagaaaactcttagctaggaccaggcaaggacgaccaggacacgccctacgtaggctgctatatttacgngggtactacgtccgtaacccgggaacgttcccggggtaccctggacccgtattcgaggtcggaaccgagggtcgggtctagggacagtactttcaactctacaccatcagcagtcctgacctaggctagaagtatgggtaggggtnttaagtttatagttagtaacaaattatattattatacgttcggnggtaacgtcgacgaaaggttacgaggtgattgttacaagacgtaagtgnggttactgcaac

SEQ ID NO: 429240 - DNA, 593 bp, Homo sapiens
  misc_feature: GZ8MTXP01BUBSG.19.71.G05.1.454.CMB.2.raw
  modified_base (247)..(247): a, c, t, g, unknown or other
  modified_base (265)..(265): a, c, t, g, unknown or other
  modified_base (323)..(323): a, c, t, g, unknown or other
  modified_base (422)..(422): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccacgatacgaactgacaagtccagccactaattctttaanactacgtaccaataatanaaactactagctagacagacagacgaccagacacgcctacgagctgctatagttacgnggactacgtaccgtaccggacgtcccgggtcccctacggacgtattcgaggtcggacgcggtccgggtcgtagggactagtacttcactcacacatcanacacgcgcgacgacgagtagagtagtagggtagtagttagttattattagtactaataattattattacttacgttcggtaacggtacggttacggtacggttaacggtaacggtaaggttaggttagttacgtaacgtacgtaacgtacgtagttacgtcgttcgtaacg

SEQ ID NO: 429241 - DNA, 577 bp, Homo sapiens
  misc_feature: GZ8MTXP01DJM87.19.71.G05.1.454.CMB.2.raw
  modified_base (309)..(309): a, c, t, g, unknown or other
  modified_base (524)..(524): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagagtcgctagcgacagtgttgcttggcacgtggtcaggcacgtccccatcgagnggtctagagtggcgtaggggaaggactattatttcaattcgtccaaacgtacggtaggaaactaacgtaaattatcgacacctattcgtgttagaagtagtcgaactagaacaatacgaaacgtacgaacaacagtacgaaacgtaacctacgttcctcccgtagcacgtctcgacctctcgttcgaccgttcccggaaggtaacgacggggttnttaacgttaagttacgtggtacggaacggttaccgaaccccgttaagtaaccg

SEQ ID NO: 429242 - DNA, 569 bp, Homo sapiens
  misc_feature: GZ8MTXP01D0H1G.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccggactggtgaacgccctgcagaccctctcgctcacctgtcgcccagtcgtccggggacagagtcgctagcgacagtgttgcttggcacgtggggtcaggcacgtccccagtcgagaggtctagagtggctgggaacgacagttatttcatacgtaccaacgtacgtaggaaacttaacaaatttactgacacctatcgtagttagagagtacgactagaacaatacaaacgtagacactaacgtacgaaacgaacctagttcctccctgactacgtctcgaccttgtcgtcgaccgtccgaggtaacgtacggggttattacgttaacgttaacgtaggtaacgggaacgaccggacccctaagttaacgtaac

SEQ ID NO: 429243 - DNA, 513 bp, Homo sapiens
  misc_feature: GZ8MTXP01CF5LA.19.71.G05.1.454.CMB.2.raw
  modified_base (329)..(329): a, c, t, g, unknown or other
  modified_base (345)..(345): a, c, t, g, unknown or other
  modified_base (468)..(468): a, c, t, g, unknown or other
  modified_base (503)..(503): a, c, t, g, unknown or other
  modified_base (508)..(513): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtacaagcagagaccaggacagcctcctaggctgctcatttactgggcatcgtacccgggatccggggtccctgaccgattcagtggcaggcggtctgggacagatttcactctcaccatcagcagcctgcaggctgaagntgtggctagtttattntgtcaaaatattaattattatacgttcgtggtacgttcggacgaagggaccaaggttgatatacgagacgactggtagctgcacctgtctgtccttcacttccttcccgcctatctgacacgngtaagtcttggcgcgggtactgggccaggggcaanagtgnnnnnn

SEQ ID NO: 429244 - DNA, 606 bp, Homo sapiens
  misc_feature: GZ8MTXP01AU208.19.71.G05.1.454.CMB.2.raw
  modified_base (226)..(226): a, c, t, g, unknown or other
  modified_base (235)..(235): a, c, t, g, unknown or other
  modified_base (244)..(244): a, c, t, g, unknown or other
  modified_base (248)..(248): a, c, t, g, unknown or other
  modified_base (254)..(254): a, c, t, g, unknown or other
  modified_base (257)..(257): a, c, t, g, unknown or other
  modified_base (265)..(265): a, c, t, g, unknown or other
  modified_base (303)..(303): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccaggggacatcgtgatgacccagtctccagactccctggctgtgtctctgggcagcgggccacgatcgaactgcaagtccagccanaatctttanacatacaanatanaaactntanctagacancagagacagacacgcctacgtagctgctctatttacgnggctacgtaccgtaaccgggtacgtcccggggtccctcggacgtattcgaggtcggacgcggtcgggtacgtagggactagttactttcaccttcctacacctagtacgacgacgacgtccgtcgacgacggacgtagaagtagtagggtacggtacgttagtttaagtttagttagtactaaactaaattaattaattaacttacgttacggttaacggtacggttacggtaccggaacggtaacggtaacggttaggttagttagtaacgacgtaacgtacgtacgttacgtcgttcgtcg

SEQ ID NO: 429245 - DNA, 525 bp, Homo sapiens
  misc_feature: GZ8MTXP01AORI4.19.71.G05.1.454.CMB.2.raw
  modified_base (228)..(228): a, c, t, g, unknown or other
  modified_base (238)..(238): a, c, t, g, unknown or other
  modified_base (311)..(311): a, c, t, g, unknown or other
  modified_base (354)..(354): a, c, t, g, unknown or other
  modified_base (406)..(406): a, c, t, g, unknown or other
  modified_base (415)..(415): a, c, t, g, unknown or other
tcagtactctcgtgcacgaccggtgctcgatttagtgtcgtcgcaagagagagggggaggtacaacaggcaggcaggggcagcaagatggtgttgcagaccccaggtcttcatttctctgttgctctggatctctggtgcccacggggacatcgtgatgacccagtctccagactccctggctgtgtctctgggcgagcgggccaccatcaactgcaagtccagccanaatcttttanacagttccaacaatgaaaactcttagcttggtaccagcagagaccaggacagcctctaggctgctcatttacnggcatctacccggatccggggtccccctgacgattcagtggcngcgggtctggggacagtatttcactctcacatcagcagcctgcaggctgaantggtcggtntagtttatatgtactaataattattacgttattacgttcgtggtacgttacggacgaaacgggtactaaggttgattagtaacagtaacgtactggttacgtcgttgtcg

SEQ ID NO: 429246 - DNA, 533 bp, Homo sapiens
  misc_feature: GZ8MTXP01BE664.19.71.G05.1.454.CMB.2.raw
  modified_base (306)..(306): a, c, t, g, unknown or other
  modified_base (347)..(347): a, c, t, g, unknown or other
  modified_base (367)..(367): a, c, t, g, unknown or other
  modified_base (489)..(489): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatcgtccggggacagacgtcgctagcgacagtgtgcttggcacgtggggtcaggcacgtccccagtcgagnggtcaggagtggcgtgggaagactatattcatcgtaccaanacgtaggaaataacaaattnacgacaccatctgttagagtagtcgactagaacaatacaaacgtaagactacgaatacgaaacaacctacgtactcctgaccagtctcgacctctcgtgaccgtcccgagtacgacgggttnttattagttctaggtggaacgacgacccctaagttaacgtaacc

SEQ ID NO: 429247 - DNA, 570 bp, Homo sapiens
  misc_feature: GZ8MTXP01CNHAS.19.71.G05.1.454.CMB.2.raw
  modified_base (357)..(357): a, c, t, g, unknown or other
  modified_base (483)..(483): a, c, t, g, unknown or other
  modified_base (527)..(527): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactggtgaagccctcgcagacccctctcgctcacctgtgccatccgtccggggacagagtcgctagcgacagtgttgcttgggcacgtgggtcagggcacgtccccatcggagaggtctagagtggcgtggggaagcattatttcattgtaccaaacgacggtaggaaactaacaaaattntacgacaaacccattctgttgaagtagtcgactgaacaatacaaacgtagacaacaatacgaaacgaaacctagttcctccctgacagctacgacctctgtcgaccgtcccgaggaccgacgggtntatacttacgtaaggtaggaacggtacggccccaagtacgaacncttacgccctacccgttcgtacttcgttgggttcgcgtttaag

SEQ ID NO: 429248 - DNA, 550 bp, Homo sapiens
  misc_feature: GZ8MTXP01AF8XB.19.71.G05.1.454.CMB.2.raw
  modified_base (240)..(240): a, c, t, g, unknown or other
  modified_base (316)..(316): a, c, t, g, unknown or other
  modified_base (376)..(376): a, c, t, g, unknown or other
  modified_base (435)..(435): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaattcttttanacagttaccaaacaatagaaaactcttagcttggaccagcagacgaccaggacagccctcaggctgctcatttacngggcagtccgtaacccggggaatcccgggggtaccccctggaccgtattccgagtcggcnggcgggtcgtgggactgtactttcactctacaccatcagcacgcctgcaggctagaagntgggtggctagtttatattgtacaactaattattattatacgttgtaaggtacgttcggacgaaagggtacctaagggttgattactaacgagaacgtaactgttggcttgaacc

SEQ ID NO: 429249 - DNA, 529 bp, Homo sapiens
  misc_feature: GZ8MTXP01E3BZK.19.71.G05.1.454.CMB.2.raw
  modified_base (311)..(311): a, c, t, g, unknown or other
  modified_base (447)..(447): a, c, t, g, unknown or other
  modified_base (469)..(469): a, c, t, g, unknown or other
  modified_base (519)..(519): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaatcttttatacagttaccaaacaatagaaaactactagctggaccagcagagaccaggacagcctcctaggctgctcatttacngggcagtccgtaacccgggaagtcccgggggtccctcggaccgtattcaggtggaccgagcgggtctggggacagtacttcactctcaccatcagcagcctgcaggctagaagatgtggggctagtttatatgtanaactaatattacttatacttgnggtaacgttcggacaaagggacaaggtgattattcgaagacgtaacgtgngctgctaacg

SEQ ID NO: 429250 - DNA, 666 bp, Homo sapiens
  misc_feature: GZ8MTXP01CG4YU.19.71.G05.1.454.CMB.2.raw
  modified_base (317)..(317): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggccctcccacaaggtgtcctgtcaacaagtacagctgcagcagtcaggtccaggactggtgaacgccctcgcacgaccctctcgctcacctgtcgccatccgtccggggacagagtcgctagcgaactgtgttgcgttggctacgtcggcaggcacgtccccagtcgaggngtctagagtggcgtacggggaagactattatttacaagttacgtccaaaacgtagggttaaagggaaaacttaaacgtaaaattttacacgtacctaaccgtacgttacgttagttagtacgtaacgtacgtaacgtaacgaaactaactaacgtaaacgtaacgaacgtaacgtaaacgtaaaccgaaaccgtaaccgtaccgtttacccgtaccgtacgtacgtacgtaccgtacgtaccttcgtacgttacgtaacccgttaccggaacggtaacggttacgggttacgttaacgttaagttacgtaacggtaacggtaacggttaccgtaacccgttaagtaacg

SEQ ID NO: 429251 - DNA, 531 bp, Homo sapiens
  misc_feature: GZ8MTXP01BRC7V.19.71.G05.1.454.CMB.2.raw
  modified_base (342)..(342): a, c, t, g, unknown or other
  modified_base (496)..(496): a, c, t, g, unknown or other
tcagtactctcgtggcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcacgtccccagtcgagaggtctagagtggcgtggggaagcatatttcatgaccaacacgtagaactacaaattngcaaccatctgttgagtagtcgactgacaatacaacgtagacacaatacgaaacgaacctacgttcctcctcgacacgctcgtacctctagtcgaccgtccggacggacgacgggtgtatagttcgtggtaggaacgacggccccagtacgacnttcgccctactcgtctcgttggtcgttcgttaacg

SEQ ID NO: 429252 - DNA, 592 bp, Homo sapiens
  misc_feature: GZ8MTXP01CGCBN.19.71.G05.1.454.CMB.2.raw
  modified_base (232)..(232): a, c, t, g, unknown or other
  modified_base (242)..(242): a, c, t, g, unknown or other
  modified_base (255)..(255): a, c, t, g, unknown or other
  modified_base (322)..(322): a, c, t, g, unknown or other
  modified_base (385)..(385): a, c, t, g, unknown or other
  modified_base (443)..(443): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccacatcaactgacaagtccagccaanaattctttanacagttaccaaanaatagaaaactcttagcttaggaccagacagacaccaggacagcctctaggctgactctatttacgnggactacgtcgtaaccccggggatccccgggggtaccccctaggaccgtattccgagtcgccnggcgggtctagggacaagtctttcacttcacacatcagcagcctgcgaggctagaagntgggaggtattagtttatattgaacaaattaattgttaattactacgttcgtggtaaccgtttcggacccgaaagggaaccctaagggttagggttacttaattaaccgaaaggtaaccgtaaacgtgggttacggtccttggaacccc

SEQ ID NO: 429253 - DNA, 573 bp, Homo sapiens
  misc_feature: GZ8MTXP01EMOSR.19.71.G05.1.454.CMB.2.raw
  modified_base (526)..(526): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgaccctctcgctcacctgtcgccatccgtccggggacagacgtcgctagcgacagtgttgcttggcacgtgggtcaggcacgtccccagtcgagaggtctaggagtggcgtaggggaaggactatatttacaagttcgtaacccaaacgacgtaggaaataacgtaaattatagacactatcgtagttgagtagtacgactagacaatacgaaacgtagaacgacaagtacgaaacgtaacctacgttacctcccgtagctagtctcgaccttctgttcgaccgttaccggacggtacgttacgggttnttacgttaattacgtggtacggaacgaccggaaccccttaagtaacg

SEQ ID NO: 429254 - DNA, 613 bp, Homo sapiens
  misc_feature: GZ8MTXP01D5MKY.19.71.G05.1.454.CMB.2.raw
  modified_base (247)..(247): a, c, t, g, unknown or other
  modified_base (259)..(259): a, c, t, g, unknown or other
  modified_base (329)..(329): a, c, t, g, unknown or other
  modified_base (366)..(366): a, c, t, g, unknown or other
  modified_base (397)..(397): a, c, t, g, unknown or other
  modified_base (425)..(425): a, c, t, g, unknown or other
  modified_base (438)..(438): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgaggccgggccacgatacgaactgacaagtccagccaatattctttanacattaccaaanaatagaaaactcttagcttaggaaccagacagacgaccaggacacgcctcctaggctgctctatttacgnggacagtccgtaacccggggactcccggggtcccccnggaccgtgttccgagtcggctgggcggtcgngggactaggtacttcacttccacaaccntacgagcgacgcngacgagcgtagaagtgtggggtagtactttaagttattagtacgtaactaaattaattactttagttaacttcgttcggtaacggttacggttaccgggaaacgaaagggtaacgtaaggttacgttacttacgtaacgaacgtaacgtacgtggttacggtcgttaacgaaccg

SEQ ID NO: 429255 - DNA, 723 bp, Homo sapiens
  misc_feature: GZ8MTXP01DWE5V.19.71.G05.1.454.CMB.2.raw
  modified_base (247)..(247): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccacgatacaactgacaagtccagccaactaattcttttaanactacttaccaaataataacgtaaaactacttagcttacggaccagacaagacgaccaggacacgcctacgtagctgtctactagtttacgcggactacgttacccggtaaccggggtacgttccccggggtacccctacggaccgtagtcgaggtcgggacgtcggggtccgggtacgtacggggaactaggttactttaccaccttcctacctaacctacgtaccgaacgccgtacgtccgtaggaccggacggtcgtaaggaagtagttcgggggttacggttacgtttaagtttttattaacgtttacgtaaacttaaattaaagtttaattttaacgtttacgtttaccgtttcgggtaacgggttaaccggttaccgggaaaccggttaaacggggtaaaccgttaagggttacggttaacttacgtaacggtaacggtaacgtacgtgggttacgtcgttaacgtaacc

SEQ ID NO: 429256 - DNA, 717 bp, Homo sapiens
  misc_feature: GZ8MTXP01B6Q83.19.71.G05.1.454.CMB.2.raw
  modified_base (222)..(222): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctntcgctcacctgtcgccatcgtccggggacagagtcgctagcgacagtgttgcgttggcacgtcgggtcacggcacgtccccagtcgagaggtctagagtggcgtggggaagacagttatttcgaatcgtccaaacgtacggtaggtaaacttaacgtaaattagtacgacctaacgtaattcgtaggttaggacggtaacggttacgaacgttaggaacctaaagtaccgtaaacggttaacgaaccgtaaccgtaagttaacccggaaaacgtaaacccgtaaccggttttacccctaccccgttacggaccaccggtaccgttaccgtaaccccgttccgttaacggttccgggtaaaccccggtttaccccgggaaacggggttaacccggttaacgggggtttacgttaaacggtttaacgtttaaccggttcgggttaaacggggaaaccgggttaccccgggtaaccccccttaaaggtttaaacccgg

SEQ ID NO: 429257 - DNA, 657 bp, Homo sapiens
  misc_feature: GZ8MTXP01CHHEX.19.71.G05.1.454.CMB.2.raw
  modified_base (232)..(232): a, c, t, g, unknown or other
  modified_base (242)..(242): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgagcgggccacgatacgactgactaagccagccanaatctttaanactatacaatatagaaactctagctacgacagacgagacgacgagacacgtcctacgtagctcgtactactacgttacgtacggacgtacgtaccgtaccggtaccggtaccggtacccccgtacgtacgtacgtacgtacggtacggacgcggtacgggtacggtacggtacgtacgtacgttactacctacctactacctactacgacgacgacgtacgtacgacgacgacgtagaagtagtagggtagtagttaagttaagttagttagtaactaaacttaaattaattaattaacgttacgttacgtaacggtacggttacggtaaccggttaaacggtaaacggtaacggttacgttagttaacgtaacgtaacgtaacgtaacgtacgttacgtaacgttaacgtaacg

SEQ ID NO: 429258 - DNA, 551 bp, Homo sapiens
  misc_feature: GZ8MTXP01A1QM2.19.71.G05.1.454.CMB.2.raw
  modified_base (239)..(239): a, c, t, g, unknown or other
  modified_base (367)..(367): a, c, t, g, unknown or other
  modified_base (423)..(423): a, c, t, g, unknown or other
  modified_base (429)..(429): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaatcttttanactagttaccaaacaatagaaaactacttagcttggtaccagcagagaccaggacagcctctaggctgctctatttactggcatccgtaccgggtatcccggggtccccctgaccgattcgagtcgcnggcgggtctggggactagtactttcactctcaccatcagcagcctgcaggctaganagtggnggctagtttacttatgtacaataattatttattaattacttcggtgtaacggttcggacccgaaagggaacctaagggttgattacgtcgagaacgtaacgtgggttacgtcgttcgaaccc

SEQ ID NO: 429259 - DNA, 541 bp, Homo sapiens
  misc_feature: GZ8MTXP01EUYFI.19.71.G05.1.454.CMB.2.raw
  modified_base (500)..(500): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgtgcttggcacgtggtcaggcagtccccatcgagaggtctagagtggctgggaaggactagtatttccaaattcgtccaaacgtacgtagggaaattaacgaaatttatcgacaaccattcgtgttgagtagtcgactgaacaatacaacgtagacgactagtacgaagaaccagttcctccctagctacgctcgacctcgtgttcgaaccttccgaaggtacgacgggttnttattaattacgtgtaggacgacggaaccccttaagtaacg

SEQ ID NO: 429260 - DNA, 570 bp, Homo sapiens
  misc_feature: GZ8MTXP01ELBCA.19.71.G05.1.454.CMB.2.raw
  modified_base (247)..(247): a, c, t, g, unknown or other
  modified_base (260)..(260): a, c, t, g, unknown or other
  modified_base (328)..(328): a, c, t, g, unknown or other
  modified_base (379)..(379): a, c, t, g, unknown or other
  modified_base (410)..(410): a, c, t, g, unknown or other
  modified_base (437)..(437): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgagccgggccaccatcaactgacaagtccagccaactaattctttaanacagttaccaaanaatagaaaactactagcttaggaccagacagacgaccaggacagccctctaggctgctctatttacgnggcagtccgtacccgggatcccggggtccccctagacctatcgagtcggcnggtcgggtctagggactagtactttcactcncacatcagcagcctgccaggcagaagntgggtagtcttaagtttatatctataaataaattattaatttatacgttcggtaaggtacgttacgggaccttaaaggggaccaaaggggttgattacaacgaagtaacgtacgtggttacggtcttcgaacc

SEQ ID NO: 429261 - DNA, 617 bp, Homo sapiens
  misc_feature: GZ8MTXP01ARE2B.19.71.G05.1.454.CMB.2.raw
  modified_base (231)..(231): a, c, t, g, unknown or other
  modified_base (241)..(241): a, c, t, g, unknown or other
  modified_base (250)..(250): a, c, t, g, unknown or other
  modified_base (254)..(254): a, c, t, g, unknown or other
  modified_base (263)..(263): a, c, t, g, unknown or other
  modified_base (412)..(412): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacgatacgaactgacaagtccagccanaatctttaanacatacaanatanaaactctanctagacagcagacgacagacacgcctacgtagctcgctactatttacgcggactacgtaccgtaccgggacgtcccgggtacctacgaccgtatcgacggtcgaacgagggtcgggtcgagggtactagtacttcacttccacacctanacgacgacgacgacgtcgacgacgacgtagaagtagtagtacgggtacgttagtttagttagttacgtactaactaattaattaattaacgttacgttacggttacggtaacggttacggttacggtaacggttaacggtaacggtaaggttagttacgttacgtaacgtacgtaacgtacggtcggttacgtcgaacgtaaccg

SEQ ID NO: 429262 - DNA, 612 bp, Homo sapiens
  misc_feature: GZ8MTXP01ARBGS.19.71.G05.1.454.CMB.2.raw
  modified_base (321)..(321): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagagtcgctagcgacagtgttgcttggcacgtgggtcacggcacgtccccagtcgagaggtctaggngtggacgtaggggaagactagttattcgaattcgtaaccaaacgtacgtaggaaactaactaaattatcgacacctatcttgttagagtagtacgatgaacaatacgaaacgtagaacgaactaactaaccgaaacgaaccgtaacgttccctaccgtcgcgtaacgtctccgaacccttcgtacggttacgtaacccgttcccggaaacgggtaccgttaccgggttgttaacgttaacgtttaccgtgggttaacggaaccggaccgggtaacccccttaagtaacccg

SEQ ID NO: 429263 - DNA, 582 bp, Homo sapiens
  misc_feature: GZ8MTXP01D5DBY.19.71.G05.1.454.CMB.2.raw
  modified_base (244)..(244): a, c, t, g, unknown or other
  modified_base (257)..(257): a, c, t, g, unknown or other
  modified_base (324)..(324): a, c, t, g, unknown or other
  modified_base (353)..(353): a, c, t, g, unknown or other
  modified_base (359)..(359): a, c, t, g, unknown or other
  modified_base (369)..(369): a, c, t, g, unknown or other
  modified_base (377)..(377): a, c, t, g, unknown or other
  modified_base (406)..(406): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgcaagtccagccaactaattcttttaanacagttaccaaanaatagaaaactacttagcttaggtaccagcaagacgaccaggacagcctacaggctgctcatttacnggcatccgtaccggagtccggggtccccngacctntcgagtcgcnggcgggtntgggacagtactttcactctcaccatcancacgcctgcgaggctaggaaagtgtggggtgactttaagtttattattgtaactaaataaatttatttaatttaacttacgttcggtaaggttaacgttcgtaacccgaaagggtaaccgtaagggttaggttacttaagtcaacggaaccgtaagtggttcggtaacttgaaccc

SEQ ID NO: 429264 - DNA, 544 bp, Homo sapiens
  misc_feature: GZ8MTXP01DSFRT.19.71.G05.1.454.CMB.2.raw
  modified_base (231)..(231): a, c, t, g, unknown or other
  modified_base (240)..(240): a, c, t, g, unknown or other
  modified_base (316)..(316): a, c, t, g, unknown or other
  modified_base (348)..(348): a, c, t, g, unknown or other
  modified_base (365)..(365): a, c, t, g, unknown or other
  modified_base (421)..(421): a, c, t, g, unknown or other
  modified_base (426)..(426): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgcaagtccagccanaatctttanacagttccaacaatagaaaactacttagcttggtaccagcagagaccaggacagcctcctaggctgctcatttacngggcatccgtacccgggaatccggggtccccngaccgattcgagtggcngtcgggtctagggactaggatttcactcacaccatcagcacgcctgcagcagaagntgggngtctagtttatatgtacaataatattattactacgttcgtaaggtacgttcggacgttaaagggtacgaaagggttggaattagtaacaggtaacgtaacgttggcgtcgttaacgcc

SEQ ID NO: 429265 - DNA, 651 bp, Homo sapiens
  misc_feature: GZ8MTXP01AVC95.19.71.G05.1.454.CMB.2.raw
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgccgtgctgggcctccacaaggtgtcctgtcacaagtacagctgcagcagtcaggtccaggactggtgaacgccctgcacgacccctctcgctcacctgtcgccagtccggtccggggacaggacgtcgctagcgacgtagtgttgcgttggctacgtgggtcaggccacgtccccagtcggagtaggtcgtagaggtggcgtaggggaacgactagttatttcagtacgaccaacgtacgtaggaaataacgtaaattacgacgactactagtcgtagtagagtagtacgacgtagaacaagtacaaacggtacaaccacgtaagtaaccgaaacgtaaacccgtcgttacccaccgttagaccgtacgtaccgtacgtaacccgttggtaacggtaacggaccccgtaaccccgggttaaggtaaccgggtaccggggtttattaacgttacggtttaacggtcgggttaacgggaaaccgggtccccgggaaccctaaggttaaccggaacccg

SEQ ID NO: 429266 - DNA, 647 bp, Homo sapiens
  misc_feature: GZ8MTXP01AGQLZ.19.71.G05.1.454.CMB.2.raw
  modified_base (231)..(231): a, c, t, g, unknown or other
  modified_base (241)..(241): a, c, t, g, unknown or other
  modified_base (253)..(253): a, c, t, g, unknown or other
  modified_base (315)..(315): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatacgaactgacaagtccagccanaattctttanacagttaccaanaatgaaaactcttagctaggaccagcagacgaccaggacagcctctaggctgctcatttcgngctacgtcgtaccggacgtccgggtcctcgacctgtcgagtcggacgacgggtcggtacgtacgggaactacgttacttacgacttaccctaccactactcacgacgacgtacgtacgacgacgacgtagtaagtagtaggtacggggttacgtttaacgtttacgtttacgtttacgttaactaaacttaatttaatttaacgtttacgttacgttacggttacggtaaccggttaccggttaccggtaaacgggaaacggtaacggtaggttacgttacgttacgtaacgtaacgtaacgtacggtacggttacgtaacgaacgtaaccg

SEQ ID NO: 429267 - DNA, 756 bp, Homo sapiens
  misc_feature: GZ8MTXP01CABXU.19.71.G05.1.454.CMB.2.raw
  modified_base (243)..(243): a, c, t, g, unknown or other
  modified_base (323)..(323): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagccggccaccatcaactgacaagtccagccactaattctttanacacgttaccaacaatagaaactacttagcttaggtaccagcagacaccaggacacgcctctaggctgctctatttacgnggctagtccgtaaccgggactcccggggtccccctaggaccgattccgaggtcgggccgaagggtccgggtacgtcggggaacctaggtactttccgacctttcctaccaaaccctacgtaccgaacgaccgtaaccggtcccgttacggacccgaagggttcccgaaggtaaaacggtcgtttacggggggttacggttaccgtttaaaggtttttaatttaacgttacggttaaaccctaaaacgtttaaacttttaatttttaaacgtttaacgtttacccggttttaacgggttaacggggtaacccggttttaccggggaaaccccggttaaagggggtaaacccggtaaagggttagggttaaacttacgttaacccggaaggtaaaccggttaacgttgggaccggttaaccgttaacgtaacccg

SEQ ID NO: 429268 - DNA, 638 bp, Homo sapiens
  misc_feature: GZ8MTXP01BALBE.19.71.G05.1.454.CMB.2.raw
  modified_base (248)..(248): a, c, t, g, unknown or other
  modified_base (337)..(337): a, c, t, g, unknown or other
  modified_base (386)..(386): a, c, t, g, unknown or other
  modified_base (401)..(401): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggccgggccacatacaactgacaagtccagccaactaattcttttaanactacttaccaaataataacgtaaaactacttagcgttacggaccagacagacgaccgagacacgcctcgagctgctacctatttacgnggactacgtaccgtaaccggggacgtcccgggtaccccctaggaccgtnttacgaggtcggcgngggtcgggtcgtagggactagtacttcactctacactatcagcacgctagacgaggctagaagtagtggggtaggtattaagtttattatacgtaactaaattaatttaattaagttaacttaccgttcggtaacgggttaaccggttaccgggaaccggttaaacgggtaaccgtaaggggttagttaacttacgtaacgaacggtaacgtaacgtcgggacgtccgttaacgaac

SEQ ID NO: 429269 - DNA, 963 bp, Homo sapiens
  misc_feature: GZ8MTXP01EW4A2.19.71.G05.1.454.CMB.2.raw
  modified_base (238)..(238): a, c, t, g, unknown or other
  modified_base (322)..(322): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgcaagtccagccacaattctttanacattaccaacaatagaaaactcttagcttagacagcagagaccaggacacgcctccgtaggctgtacttctaagttttaccgngggacctaacgttcccgtaaaccccggggaacgttccccgggggttacccccctacggaacccgtagtttaccgacgggttcggggaccgtaacggggtccgggggtttacgtacggggggtaaaccctaacgggtttacgtttttacccgaaacctttcccgttaacccgaaaccccgttaaacttccgtaaaccgggtacccgtaaaacccggtcccccggtttaggaccccgggtaaaggggtaccccgttaaaggggaaaaacgggtaacggttttacggggggtttagggggttaaccctttttaaaggggttttttaaactttttaaaggtttttaaccgggtaaaaccccgtttaaaaaaacgttaaaacgtttttaaacgtttttaaaacgtttttaaacttttaaacccgggtttttacccggggtttaaacgggggttttaaaccccgggttttttaaccccgggttaaacccccggggaaaaaggggggttaaaaccccgttaaaaaggggggtttacgggttaaaacggtttaaaacggtttaaaccccggggaaacggggttaaaccgggttaaaaccgggtttaccggggtttacgggggtaaaccggttttcccgggtaaaccccg

SEQ ID NO: 429270 - DNA, 647 bp, Homo sapiens
  misc_feature: GZ8MTXP01D67N7.19.71.G05.1.454.CMB.2.raw
  modified_base (230)..(230): a, c, t, g, unknown or other
  modified_base (293)..(293): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtagaacgccctcgcacgaccctctcgctcacctgtgccatcgtccggganagagtcgctagcgactagtgttgcgttggcacgtggcaggcacgtcccatcggagagtctagngtggcgtagggaagactattatttcatcgtaccaaacgtacggtagtaaacctaactaaattacgtcgacctaacctatcgtgtagagtacgtacgactagaactaatacgaaacgtagaacactaacgtacggaaactaaccgtacgttccctacccagacgtacgtaccttacggaacccttcgtacggttaccgacccgttaccccgggaaggtaacccggtagggttagtaattacgttacggtaagggtaacggaacggaacccggttacccctaaaggtacaaccttcgttacccggtaacccctacccgttcgttccgtcgttacggttccgttaagtttaaccggg

SEQ ID NO: 429271 - DNA, 526 bp, Homo sapiens
  misc_feature: GZ8MTXP01BCT88.19.71.G05.1.454.CMB.2.raw
  modified_base (224)..(224): a, c, t, g, unknown or other
  modified_base (233)..(233): a, c, t, g, unknown or other
  modified_base (245)..(245): a, c, t, g, unknown or other
  modified_base (303)..(303): a, c, t, g, unknown or other
  modified_base (353)..(353): a, c, t, g, unknown or other
  modified_base (399)..(399): a, c, t, g, unknown or other
  modified_base (402)..(402): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatctttanacagttccaaanatgaaaactctagctggaccagcagagaccaggacagcctctaggctgctcatttacngggcatctacccgggaatccggggtcctgaccgattcagtgcagcggtcngggacagatttcactctcaccatcagcagcctgcaggctagaaagntgnggggctagtttatattgtacaaatattattattatacttcgtggaacgttcggaccgaaggggacctaaagggtgaattcgttacgaaggacgaaacgtttggaggttacctggaacctaaccg

SEQ ID NO: 429272 - DNA, 616 bp, Homo sapiens
  misc_feature: GZ8MTXP01A66S5.19.71.G05.1.454.CMB.2.raw
  modified_base (236)..(236): a, c, t, g, unknown or other
  modified_base (249)..(249): a, c, t, g, unknown or other
  modified_base (315)..(315): a, c, t, g, unknown or other
  modified_base (370)..(370): a, c, t, g, unknown or other
  modified_base (385)..(385): a, c, t, g, unknown or other
tcagtactctcgtgcacgaccggtgctcgatttagtgtcgtcgcaagagagaggaggtacaacaggcaggcaggggcagcaagatggtgttgcagaccccaggtcttcatttctctgttgctctggatctctggtgcccacggggacatcgtgatgacccagtctccagactccctggctgtgtctctgggcgagccgggccacatcaactgcaagtccagccactaattctttanacagttaccaaanaatagaaaactattagcttggtaccagcagacaccaggacagcctactaggctgctctatttacgnggctatccgtaacccggggatcccggggtccccctggaccgtattcgagtcggcnggcgggtctgggacngtacttccactcctacaccatcacgcagcctgccgaggtcagaagtgtggggtagtcgttaagttttactaagttcgtaactaaactaagtttaatttaatttaacgttaacgtttccggtaagggttaccgtttaccgggaaccgaaacggggtaaccgtaaggggttaggttacttaacgtaaccgaaaggtaaccgtaaacgtgggttacgaaccggttcgtaacccg

SEQ ID NO: 429273 - DNA, 608 bp, Homo sapiens
  misc_feature: GZ8MTXP01DA7DY.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcactcgcacgaccctctcgctcacctgtcgccatcgtccggggacaggagtcgctagcgacgagtgttgcttggctacgtgggtcaggcacgtccccagtcgagtagtcgtagaggtggccgtaggggaaagactattacgtttacaagttcgtacccaaacgtacggtagaaaacttaactaaattactacgactaacctatcgtgttagagtacgtacgactagaacaatactaaacggtacgaacaacgtaataaccgaaacgtaaccctacgttacctaccgtcgtaccgagtacctcggtaacccctgttcggttacgaccgtacccggacggttaaccgttagggttacttaagttagttaacgtagggtacggaacggtccgaaccccgtaag

SEQ ID NO: 429274 - DNA, 642 bp, Homo sapiens
  misc_feature: GZ8MTXP01AGGDE.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacagagtcgctagcgacagtgttgcgttggcacgtgggtcaggcacgtccccagtcgagaggtctagagtggcgtagggaaggacagtactttcaattcgtcccaaacgtacggtagggaaataacgtaaattacgtacgacctaacctaattccttaggtttacggaaggtaacgttccggaacttaggaaacctaaacgtacgaaacggttaacgaaacctaacgtaagttaaccgaaaacgtaaccctaacgtttcctacccgtagacctacggtctacgtacccttctcggttacgacccgttacccggaggaaccgttacggggttacttagttaacgtttaccgtggttacgggaacggaccggtaaccccttaagtaaccgg

SEQ ID NO: 429275 - DNA, 532 bp, Homo sapiens
  misc_feature: GZ8MTXP01AY804.19.71.G05.1.454.CMB.2.raw
  modified_base (228)..(228): a, c, t, g, unknown or other
  modified_base (237)..(237): a, c, t, g, unknown or other
  modified_base (313)..(313): a, c, t, g, unknown or other
  modified_base (361)..(361): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatctttanacagttaccaacaatagaaaactcttagcttggtaccagcagagaccaggacagcctctaggctgctcatttacgngggcatccgtaacccgggatccggggtccccctgacctatcagtggcnggcgggtctgggacagtatttcactctcaccatcagcagcctgccaggctagaagatgggtggtactagtttattatgtacaaataatattaattatacgttcgtaaggtacgttcggaccgaagggtaccaaggttgattacgtcagaacgaagtgttacgcgttgaacc

SEQ ID NO: 429276 - DNA, 579 bp, Homo sapiens
  misc_feature: GZ8MTXP01D3D7Y.19.71.G05.1.454.CMB.2.raw
  modified_base (432)..(432): a, c, t, g, unknown or other
  modified_base (463)..(463): a, c, t, g, unknown or other
  modified_base (484)..(484): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccatcgtccggggacaggagtcgctagcgacagtgttgcttggcacgtggggtcaggcacgtccccagtcgagaggtctaggagtggcgtaggggaaggactagttatttcattcgtaccaacgtacggtaggaaaataacaaattatgacacgtatcgtgtagagtagtacgactgaacaatacgaacgtaanaccaagaactacggaaacaaccgtagttccnccctgacagtctacgtacctntcgtcgaccgtcccggaaggtaccgtaagggggttgttaacttaagttaacgtggtaacgggaacggacccggcccctaaagttaacggtaaccg

SEQ ID NO: 429277 - DNA, 592 bp, Homo sapiens
  misc_feature: GZ8MTXP01CMV5H.19.71.G05.1.454.CMB.2.raw
  modified_base (239)..(239): a, c, t, g, unknown or other
  modified_base (317)..(317): a, c, t, g, unknown or other
  modified_base (377)..(377): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacatcaactgacaagtccagccacaatctttanacagttccaaacaatagaaaactacttagcttaggtaccagcagagaccaggacagcctctaggctgctcatttacgngggcagtccgtaacccgggagtccgggggtcccccctaggaccgtattcgaggtcgggcnggtcgggtctggggactagtactttcactctcaccatcagcacgcctgcgaggctaggaacgtatggggtaggtacttagtttattattacgtacaaactaattatttaattacttacgttcggtaaggtaaccgttcggaaccgaaaggggtaacctaaggggttagttattacgtaacgaacggtaacgaacgttggttgtccgttcgtaacc

SEQ ID NO: 429278 - DNA, 580 bp, Homo sapiens
  misc_feature: GZ8MTXP01EOV09.19.71.G05.1.454.CMB.2.raw
  modified_base (528)..(528): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcagaccctctcgctcacctgtcgccatcgtccggggacagacgtcgctagcgacagtgttgcttggcacgtgggtcaggcacgtccccagtcggagaggtctagaggtggcgtaggggaaggactatatttcaattcgtccaaacgtacggtaggaaataacgaaaattatcgactaaccattctgttagagtagtcgactgaactaatacgaaacgtagaacgaactaagtacgaaacgaacctacgttacctccgtagctaagtctcgtacctcgtcgttacgaccgttcccggaggtacgttacggggttnttaagttaacttacgtggtacgggaacggaccggtaaccccttaagtaaccg

SEQ ID NO: 429279 - DNA, 649 bp, Homo sapiens
  misc_feature: GZ8MTXP01AQXAI.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccagtcgagagtctaggagtggcgtaggggaaaggactagttatttcatcgtaccaaacgtacggtaggaaacttaacgtaaattatcgacctaaacctattcgtgttacgaagtacgtcgaactagaacaatacgaaacgtagaacaacgaagtaccggaaacgaaccctaggttaccctcccgtagacctaggtccgtacgtaacccgttcgtacggtaccgtaaccccgtacccgggaagggtaacccgtacggggttagttaacgttacgtttacgtgggtaacgggaaacggtacccgggacccctaaagtacgacttcgttccgaacccttaccgtccgttcctcggttaggttcgttaacgttaagg

SEQ ID NO: 429280 - DNA, 600 bp, Homo sapiens
  misc_feature: GZ8MTXP01BTMS6.19.71.G05.1.454.CMB.2.raw
  modified_base (247)..(247): a, c, t, g, unknown or other
  modified_base (273)..(273): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtggggcgagcgggccaccgatacgaactgacaagtccagccataattcttttaanactacttaccaaataataagaaactnttagcttagaccagcagacgaccgagacacgccctacgtaggctgtacttactaacgtttacgcggacctacgttacccggtaacccgggacgttcccggggtacccctacggaccgtagttcgaggtcggacgtcgggtccgggtacgtacgggactagttactttccactactacacactacacgcgacgctagcgagacgtagagtgtagggtgtattatttattatagtactaattaattattattattacgttcggtaacgtacgttcggacgttaacggacgtaaggttagattacgaagagaacgtagtgttcgtcgcgc

SEQ ID NO: 429281 - DNA, 675 bp, Homo sapiens
  misc_feature: GZ8MTXP01DIP3F.19.71.G05.1.454.CMB.2.raw
  modified_base (249)..(249): a, c, t, g, unknown or other
  modified_base (385)..(385): a, c, t, g, unknown or other
  modified_base (409)..(409): a, c, t, g, unknown or other
  modified_base (455)..(455): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctccctggctgtgtctcgtgggcgaggccggccacatacaacgtgacaagtccagactaactattactttanactacgttaccaaactaatagtaaaacttcttagcttacggtaaccagacagaacgaccgaaggaccacgtcctccgtaggctcgctctatttacgcggactacgtccgtaacccggggactcccggggtaccccnggaccgtagttccgaggtcgggcncgggccgggtcgtagggacgtagtactttcacctctaccactaacncacgcacgtcgtagacgaggactaaggtaagtagttggggtacgttatttaagtttagttacttaacgtaaactaaattaaatttaatttaactttaacgttacgttcggttaacgggttaccggttaccggaaaccggttaaacgggtaaccgtaaggttaacgttacttacgtaacgaaacggtaacgtaacggttcggttacgtccgttcgtaaccg

SEQ ID NO: 429282 - DNA, 617 bp, Homo sapiens
  misc_feature: GZ8MTXP01BUH3W.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccatcgtccggggacagagtcgctagcgacagtgttgcttggcacgtgggtacaggcagtccccagtcgagagtctagagtggactgggaagacattattcaatcgtccaaacgacggtaggaaataactaaagttatcgacactatcgtagttagaagtagtaccgaactagaacaaactactaaacgtaagaaccgaatacgttaaccgaaacgtaaaccgtaacgttccttaccctaggtccaacggtcctacgaccttaacgttacggttcgtaaacccgttcccggaaacgggtaccgttaaccgggggttcttaagttaacgttaaccgtggttagggaaacgggttaccgggaacccccttaagttaaacccgg

SEQ ID NO: 429283 - DNA, 557 bp, Homo sapiens
  misc_feature: GZ8MTXP01BOTLD.19.71.G05.1.454.CMB.2.raw
  modified_base (240)..(240): a, c, t, g, unknown or other
  modified_base (318)..(318): a, c, t, g, unknown or other
  modified_base (436)..(436): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaattcttttanacagttaccaacaatagaaaactacttagcttaggaccagcagacgaccaggacagcctcaggctgctctatttacgnggcatccgtacccgggatcccggggtccccctggaccgattcgagtcgggcgaaggcgggtccgtggggacctaggtactttcactcctcaccatcagcacgcctgcaggctagaagntggggtgcttagtttattatgtactaaataattattaattattacgttgtaagggtaccgttcggacgaagggacctaagggttggattatcgagtaacgacgtgttaggtccttcgaacc

SEQ ID NO: 429284 - DNA, 618 bp, Homo sapiens
  misc_feature: GZ8MTXP01CD4RF.19.71.G05.1.454.CMB.2.raw
  modified_base (160)..(160): a, c, t, g, unknown or other
  modified_base (236)..(236): a, c, t, g, unknown or other
  modified_base (270)..(270): a, c, t, g, unknown or other
  modified_base (274)..(274): a, c, t, g, unknown or other
  modified_base (279)..(279): a, c, t, g, unknown or other
  modified_base (313)..(313): a, c, t, g, unknown or other
  modified_base (610)..(611): a, c, t, g, unknown or other
  modified_base (613)..(614): a, c, t, g, unknown or other
  modified_base (616)..(616): a, c, t, g, unknown or other
  modified_base (618)..(618): a, c, t, g, unknown or other
tcagtactctcgtgcacgaccggtgctcgatttagtgtcgtcgcaagagagagggggcacttctccctctaacactctccccagtctccagactccctggctgtgtctctggggcgagcgggccacgatacgactgacaagtccagccacaatcttttanacagttccaacaatgaaaactacttagcttggtaccagcagagaccaggacagcctcctaggctgctcatttacgnggcactccgtaccggagtcccgggtcctgacgtntcgngtgcnggcggtgtggacagtacttcactctacacatcancagctgcaggctagaagtgtggtgtacttagtttattagttacgtactaaaaattaagtttaatttaactttaacgtttacgtttcggtacgggtaccgggttacgggaaccgtaaaggggtaccgtaagggtaggtaatactacgaaggtacgtacgtggtcggctacggtacctaaccgtcgtttcgtcgtttcctttaccgtaccttccccgttccccgaccgtactcgtacgtacgtacgaaggtaacgtacgttacggcgggcgggtcggtcggacggacggcgcgagaagnngnngngn

SEQ ID NO: 429285 - DNA, 611 bp, Homo sapiens
  misc_feature: GZ8MTXP01CA3PU.19.71.G05.1.454.CMB.2.raw
  modified_base (239)..(239): a, c, t, g, unknown or other
  modified_base (249)..(249): a, c, t, g, unknown or other
  modified_base (254)..(254): a, c, t, g, unknown or other
  modified_base (315)..(315): a, c, t, g, unknown or other
  modified_base (381)..(381): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagccgggccacatcaactgcaagtccagccacaatctttaanacactacaanaatanaaactactagctagacagacagacgaccgagacacgcctcgtagctcgctactatttacgnggactacgtaccggtaacccgggacgttccccggggtccccctaggacgtattcgaggtcggacgngggtcgggtacgtgggacagtacttcactctacacatcagcacgccgtagacgaggtacgtagaagtagtcggggtacgtacttaagttttaacttattacgtaactaaattaaattatttaattacttacgttcggtaacggttacggttcggtaaccgaaacgggtaaccgtaaggttagttacttacgtaacgaacgtaacgtaagttggttacgtcgttcgaaccg

SEQ ID NO: 429286 - DNA, 530 bp, Homo sapiens
  misc_feature: GZ8MTXP01ECFKC.19.71.G05.1.454.CMB.2.raw
  modified_base (325)..(325): a, c, t, g, unknown or other
  modified_base (345)..(345): a, c, t, g, unknown or other
  modified_base (452)..(452): a, c, t, g, unknown or other
tcagtactctcgtggcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcacgtgggtcaggcagtccccatcgagaggtctagagtggctagggaagacattatttcatgtaccaanacgtggaaactacaaattangacaaccatctgttgagtagtcgactgaacatcaacgtagacacatacgaagaaccagttctccctgacagcgtcgacctctgtcgacctcccgaggacgtcgggtntattatacgtggtggaacgtaccggccccaagtacgacacttacccaacctcgtctcgtggttctcgttaagtaacgg

SEQ ID NO: 429287 - DNA, 615 bp, Homo sapiens
  misc_feature: GZ8MTXP01EVIMG.19.71.G05.1.454.CMB.2.raw
  modified_base (238)..(238): a, c, t, g, unknown or other
  modified_base (250)..(250): a, c, t, g, unknown or other
  modified_base (304)..(304): a, c, t, g, unknown or other
  modified_base (312)..(312): a, c, t, g, unknown or other
  modified_base (338)..(338): a, c, t, g, unknown or other
  modified_base (344)..(344): a, c, t, g, unknown or other
  modified_base (393)..(393): a, c, t, g, unknown or other
  modified_base (407)..(407): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacgatcgaactgacaagtccagccactaatctttanacattaccaaanaatagaaaactcttagcttaggaccagcagacacaggacagcctcaggctgctnatttacgnggcatccgaccggacgtccggtcccngacgtntcgaggtcgacgcgggtcggtgtacggactagtacttcacctcacacanacagacgacgtcgngacgacggactaagaaagtgttaggggtacggttacgttaagttttaattagttacgtaaacttaaagttaaatttaatttaacttaacgttacggttacggttaacggttaaccggttaccgggaaaccggttaaagggaaccggtaagggttagttaacttacgtaacgtaacggaacgttaacggtggttacgtcgttcgtaacc

SEQ ID NO: 429288 - DNA, 636 bp, Homo sapiens
  misc_feature: GZ8MTXP01B66RO.19.71.G05.1.454.CMB.2.raw
  modified_base (358)..(358): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtgccatcgtccggggacagagtcgctagcgacagtgttgcttggcacgtgggtcaggcacgtccccatcggagaggtctagagtggcgtagggaagactattatttcattcgtaccaaacgacggtaggaaactaacaaatttancgactaaacctattcgtagttagagtacgtacgtactagaactaactacgaaacgtacgacaactaacgtaacgaaacgtaaccgtacgttaccctaccgtcgacgtacgtacgtacgtaccgttcgttacgtaccgtacccgtacccggaaggtaccggtacgggttagttaacgttacgttacgtaagggtaacgggaacgtacccgacccgtaaagtacgacgttcgttaccgtaaccctaccgttcgtcgtcgttcggtaacgttaacgttaag

SEQ ID NO: 429289 - DNA, 589 bp, Homo sapiens
  misc_feature: GZ8MTXP01EUSAX.19.71.G05.1.454.CMB.2.raw
  modified_base (231)..(231): a, c, t, g, unknown or other
  modified_base (239)..(239): a, c, t, g, unknown or other
  modified_base (241)..(241): a, c, t, g, unknown or other
  modified_base (248)..(248): a, c, t, g, unknown or other
  modified_base (250)..(250): a, c, t, g, unknown or other
  modified_base (252)..(252): a, c, t, g, unknown or other
  modified_base (260)..(260): a, c, t, g, unknown or other
  modified_base (269)..(269): a, c, t, g, unknown or other
  modified_base (307)..(307): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccacgatacgactcgactaagtccagccanatctttananatacaanananaactatantagacaganagacgacagacacgcctcgagctcgactactattacgnggactacgtaccgtaccggacgtcccgggtcctcgaccgtatcgagtcggacgaggtcggtacgagggacagtacttcactctacaccatacacgacgacgacgtcgcgacgacgagagtagtagtacgggtacgttagtttattagttacgtaactaaactaaattaatttaacttacttacgttacgtcggtaacgtacggttacggtaacggttaacgtaacggtagttagttacgttacgtaacgtacgtaacgtagtacgttacgtcgttcgtaacg

SEQ ID NO: 429290 - DNA, 534 bp, Homo sapiens
  misc_feature: GZ8MTXP01EQ7TY.19.71.G05.1.454.CMB.2.raw
  modified_base (318)..(318): a, c, t, g, unknown or other
  modified_base (335)..(335): a, c, t, g, unknown or other
  modified_base (450)..(450): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtggtcaggcagtccccatcgagaggtcagagtggctgggaagcatatttcatgtccaanacgtgaactacaaattntgtaccaatctgttgagtagtcgactgacaatcaacgtagacacatacgaaacgaactagttcctacctgacaagcctacggacctcgtgtacgacctcccgaggacgacgggtntaatattacgtgtggaacgacggaccccagtacgaacagttcgaccctaacctcgtcctcgtggttcgtcgttaagttaacggg

SEQ ID NO: 429291 - DNA, 596 bp, Homo sapiens
  misc_feature: GZ8MTXP01CK44E.19.71.G05.1.454.CMB.2.raw
  modified_base (286)..(286): a, c, t, g, unknown or other
  modified_base (553)..(553): a, c, t, g, unknown or other
  modified_base (587)..(587): a, c, t, g, unknown or other
  modified_base (592)..(596): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcggaccaccatcaactgcaagtccagccacaatcttttatacagttccaacaatgaaaactacttagcttggtaccagcagagaccaggacagcctcctaggctgctcattactgggcatcgtacccgggaatccgggggtccctgaccgattcagtggcaggcgggtntgggacagatttcactctcaccatcagcagcctgcaggctagaagatgtggcctagttttattatttgtactaaaaactaatttaatttaatttaattactttcggtagggtaaccgtttcgggaccctaaagggggtaccctaaaggggttggaattaagtccgaaaggtaaccggtaacttgggtaggccttggacctaacctagttcttggttcccttacactttcccgttccccgctattctacggactacggagaagttacngggacggccggggtactgggaccgaagggccaanagtgnnnnn

SEQ ID NO: 429292 - DNA, 637 bp, Homo sapiens
  misc_feature: GZ8MTXP01DJK8S.19.71.G05.1.454.CMB.2.raw
  modified_base (230)..(230): a, c, t, g, unknown or other
  modified_base (239)..(239): a, c, t, g, unknown or other
  modified_base (248)..(248): a, c, t, g, unknown or other
  modified_base (252)..(252): a, c, t, g, unknown or other
  modified_base (258)..(258): a, c, t, g, unknown or other
  modified_base (261)..(261): a, c, t, g, unknown or other
  modified_base (311)..(311): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctggggcgagcgggccaccgatacgaactgacaagtccagccanatctttaanacatacaanatanaaactntanctgacagcagacaccagacacgtcctacgagctgtcttactatttaccgnggacctacgtaccgtaacccgggacgttcccggggtacctacggacctattccgaggtcggacacgggtcgggtacgtagggaactaacgtactttaccgacttacctaccaacctagacgacgaccgacgaccgtacgacgacggacgtacgaagtagtagtacgggtacgttaagtttaattagttacgtaactaactaattaatttaattacttacgttacgttacggtaacgttacggttacggtaaacggaacggtaaacggtaagttagttacgttacgtaacgtaacgtaacgtacggtacgttacgtcgaacgtaacg

SEQ ID NO: 429293 - DNA, 592 bp, Homo sapiens
  misc_feature: GZ8MTXP01EZDR0.19.71.G05.1.454.CMB.2.raw
  modified_base (378)..(378): a, c, t, g, unknown or other
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgcccctcgcacgacccctctcgctcacctgtcgccatccgtccggggacagagtcgctagcgacagtgtgcttggcacgtgggtcaggcacgtccccatcgagaggtctagagtggcgtaggggaacgactatatttcatacgtaccaacgacgtaggaaataacaaattangacaccatctgttagagagtacgactagaacaaatacaaacgtaagaacaacgaagtaacgaaacgaaaccctagttcctcccgtagaccagtcctacgacccttcgtcggtacgacccgtccccggaaagggtaaccgtaacggggttagttaacttaagtttaacgtagggtaacgggaaacggaccgggaccccctaagttaacggaaccg

SEQ ID NO: 429294 - DNA, 549 bp, Homo sapiens
  misc_feature: GZ8MTXP01AVUKK.19.71.G05.1.454.CMB.2.raw
  modified_base (228)..(228): a, c, t, g, unknown or other
  modified_base (238)..(238): a, c, t, g, unknown or other
  modified_base (314)..(314): a, c, t, g, unknown or other
  modified_base (354)..(354): a, c, t, g, unknown or other
  modified_base (363)..(363): a, c, t, g, unknown or other
  modified_base (422)..(422): a, c, t, g, unknown or other
  modified_base (518)..(518): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatcttttanacagttccaaacaatagaaaactacttagcttggaccagcagagaccaggacagcctcctaggctgctcatttacngggcatcctacccgggaatcccggggtcccctggaccgtnttcagtgcnggcgggtctggggacaggtatttcactctcaccatcagcagcctgcgaggctagaaagngtgggtggactaagtttattattgtactaaataattattattataccttgtcgggtaacttcgggaccttaaagggacctaagggttggattacgngaacgaacgtaacttggacggcttcggaacc

SEQ ID NO: 429295 - DNA, 593 bp, Homo sapiens
  misc_feature: GZ8MTXP01EHHSN.19.71.G05.1.454.CMB.2.raw
  modified_base (364)..(364): a, c, t, g, unknown or other
  modified_base (426)..(426): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactggtgaagccctgcacgaccctctcgctcacctgtgccatcgtaccggggacagagtcgctagcgacagtgttgcttggcacgtgggtcaggcacgtccccatcgagaggtctaggagtggcgtagggggaaagactagttattttcagttcgtaccaaacgacggtaggaaataacctaaaattntgacccaaacctattcgtagtttaggagtacgtccgtaactgaaaccaatacgaaacggtanaacacaagtaacgaaacgtaacctacgtcctcccagacacgctacgtcctactgtacgaccgtccggaaggtaccgaggggttataacttacgttagtggtaacggaacggaccggaccccaagtacgacgattcgcctacctcgttctcgttgggtcttcgttaag

SEQ ID NO: 429296 - DNA, 589 bp, Homo sapiens
  misc_feature: GZ8MTXP01DOTUB.19.71.G05.1.454.CMB.2.raw
  modified_base (236)..(236): a, c, t, g, unknown or other
  modified_base (324)..(324): a, c, t, g, unknown or other
  modified_base (359)..(359): a, c, t, g, unknown or other
  modified_base (427)..(427): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccgacggggacatcgtgatgacccagtctccagactcctggctgtgtctcgtgggcgaggcggccacatcaactgcaagtccagccataattcttttaanactacgttaccaaactaataacgtaaaactactagcttacggacagacagacgacgagacacgcctacgaggctgctactatttacgnggctacgtccgtaccggggacgtcccgggtacccncggacgtatcgaggtcggcgcgggtcgggtcgtacgggactagtcttcactcacacatcagcacgcgngcgagctagaagtgtgggtacgtatttaagtttattagttacgtaactaaattaatttatttattacgttacgtttcggtaacggtacgttacggaacgaaacgggtaacgtaagggttacgattacgtaacgaacgtaacgtagtggttacgtcgcgtaac

SEQ ID NO: 429297 - DNA, 639 bp, Homo sapiens
  misc_feature: GZ8MTXP01EA65A.19.71.G05.1.454.CMB.2.raw
  modified_base (235)..(235): a, c, t, g, unknown or other
  modified_base (313)..(313): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttaccaaacaatagaaaactacttagctggtaccagcagagaccaggacagcctcctaggctgctcatttacgnggcagtccgtaccggacgtcccgggtcctcgaccgtattcgaggtcggacgagggcggggtcgtaggggactagtactttcacttcctaccactactacacgacgacgtaccgtacgacgacgacgtagaagtagtaggtacggggtacgttaagtttaagtttaagttacgtaacgtaaactaaattaaatttaatttaatttacgtttacggttacggttaacggttaccggttaccggtaaacgggttaaaccggtaaacgggtaaggttagttacgttacgtaacgtaacgtaacgtacggtacggttacgtcgcgtaaccg

SEQ ID NO: 429298 - DNA, 531 bp, Homo sapiens
  misc_feature: GZ8MTXP01CVFH6.19.71.G05.1.454.CMB.2.raw
  modified_base (304)..(304): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtggtcaggcagtccccatcgagnggtctagagtggctggggaaggacatatttcaatgtcccaaacacgtaggaaatacaaattatgacactatctgttagagagtcgactagacaatacgaaacgtagaacaacatacgaaacgaacctacgttcctaccctgcctagtcctcgacctcgtgttcgaccgttccgaggtacacggggttgttataattacgtggtaggacgttacggccccaagtaacg

SEQ ID NO: 429299 - DNA, 616 bp, Homo sapiens
  misc_feature: GZ8MTXP01A2B4Z.19.71.G05.1.454.CMB.2.raw
  modified_base (235)..(235): a, c, t, g, unknown or other
  modified_base (245)..(245): a, c, t, g, unknown or other
  modified_base (258)..(258): a, c, t, g, unknown or other
  modified_base (325)..(325): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgccccgacggggacatcgtgatcgacccagtctccagacctccctggctgtgtctcgtgggcgagccggccaccatcaactgacaagtccagccaanaattctttanacagttaccaaanaatagaaaactattagcttaggaccagcagacgaccaggacagccctcaggctgctactatttacgngggacacgttccgaacccggggtagtccccggggtccccctaggaccgtagttccgaggtcgggcctaagggccgggtacgtagggactagtactttccaccttcctacaaccatcgagcacgcctgccgaggctagaaagtgttggggtacggtattaagtttaacttagttacgtaaccaaataatttattaattattacgttggtaacggtaccgttcgggaaccgaaagggtaaccgtaaggggttgacttacgtaaccgagaacgtacgtggttacgcttcgaacc

SEQ ID NO: 429300 - DNA, 547 bp, Homo sapiens
  misc_feature: GZ8MTXP01AEUSX.19.71.G05.1.454.CMB.2.raw
  modified_base (239)..(239): a, c, t, g, unknown or other
  modified_base (313)..(313): a, c, t, g, unknown or other
  modified_base (366)..(366): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatagaaaactactagcttggtaccagcagagaccaggacagcctctaggctgctcatttacnggcatctaccgggatccccggggtcctgaccgattcaagtcggcaggcgggtntggggacagtactttcactctcacatcagcagcctgcaggctagaagtagtggtggtactagtttattagttgtactaaataaattatttattacttacgttcggtggttacgtttcggaccgtaaaggggtaaccttaagggttgataagtacgaagaccgtaattggtaacggctaacg

SEQ ID NO: 429301 - DNA, 596 bp, Homo sapiens
  misc_feature: GZ8MTXP01DYVO8.19.71.G05.1.454.CMB.2.raw
  modified_base (241)..(241): a, c, t, g, unknown or other
  modified_base (325)..(325): a, c, t, g, unknown or other
  modified_base (387)..(387): a, c, t, g, unknown or other
  modified_base (427)..(427): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcggccacatcaactgcaagtccagccaactaattcttttaanactagttaccaaataatagaaaactacttagcttaggtaccagacagacgaaccaggacagcctctaggctgctctatttacgnggactagtccgtaacccgggacgtcccggggtccccctacggacgtagttccgaggtcgcgngggcgggtcgtagggactagtactttcactctacaacctntacgacgcacgtccagacgagtacgtagaagtgtggggtacgtatttagtttatatacgaactaaattaattattattattacgttggtaacgtacggttacggaaccggttaaggtaacgtagggttagttattacgtaacaggtaacgtagtggttacgtcgttcgc

SEQ ID NO: 429302 - DNA, 587 bp, Homo sapiens
  misc_feature: GZ8MTXP01DWFBP.19.71.G05.1.454.CMB.2.raw
  modified_base (318)..(318): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagagtcgctagcgacagtgttgcttggcacgtgggtcaggcacgtccccatcgagaggtctagnggtggcgtagggaaggactattatttcaaattcgtccaaactacggtaggaaataacgaaattatacgaccactatcgtgttagagtagtcgactagaacaatacgaaagtacgaacactagtacgaaacgtaacctacgttcctacccgtagcaacgtcctcgacctcgtcgttcgtaccgttaccggaacggtaccgttaggggttcttaagtttaacgttacgtaaggtacggggtaaacgaccggtaacccccttaaagtaaccg

SEQ ID NO: 429303 - DNA, 615 bp, Homo sapiens
  misc_feature: GZ8MTXP01AWX35.19.71.G05.1.454.CMB.2.raw
  modified_base (246)..(246): a, c, t, g, unknown or other
  modified_base (325)..(325): a, c, t, g, unknown or other
  modified_base (379)..(379): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccacgatacgaactgacaagtccagccactaattctttanacagttaccaacaatagaaaactctagcttaggtaccagcagacgaccaggacacgcctcctaggctgctcatttacgnggactagtcgtacccgggatcccgggggtccccctaggaccattcgagtcggcnggcgggtcgtagggactagtactttcactctacacatcagcagcctgaccgaggctagaaagtgtaggggtggacttagtttattatcgtaactaaataatttaatttattaacttaccgtttagggtcggttaacggttaccgggaaccgttaaaggggtaacccgtaaagggttcgggttattaacgtaacccgaaggtaaccgtaacgtgggttagggtaaccttggtaaccc

SEQ ID NO: 429304 - DNA, 641 bp, Homo sapiens
  misc_feature: GZ8MTXP01AT8IV.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactgctgaacgccctcgcacgaccctctcgctcacctgtcgcctacgtcgtccggggacaggacgtcgctagcgacagtgtgcttggcacgtggcaggcacgtccccagtcgagacgtcgtagaggtggccgtagggaaggactattagtttacagttcgtacccgaaacgtaccggttaggtaaactaacgtaaaatttacgagacctaactattcgttaggttagagtacgtacgaactagaacctaatacgaaacgtaacggaactaactaacgtacggaaacgtaacccgtacgtttccctacccgtgtaccacgtccgtcgtaacccgtcgttcggtaccgttacccggttacccggaagggttaaccgttcgggggttattaacgttacgttaacggtacgggtacggaaaccgggtaacccgttaaccccgtaaag

SEQ ID NO: 429305 - DNA, 577 bp, Homo sapiens
  misc_feature: GZ8MTXP01CWA2C.19.71.G05.1.454.CMB.2.raw
  modified_base (244)..(244): a, c, t, g, unknown or other
  modified_base (248)..(248): a, c, t, g, unknown or other
  modified_base (257)..(257): a, c, t, g, unknown or other
  modified_base (304)..(304): a, c, t, g, unknown or other
  modified_base (360)..(360): a, c, t, g, unknown or other
  modified_base (372)..(372): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccaggggacatcgtgatgaccccagtctccagactccctgggctgtgtctctgggcgagcgggccacgatcgaactgcaagtccagccacatctttaacatcaanatanaaactatancttagacagcagacacagacacgcctcgaggctgctactatttacgnggcacgtaccgtacccgggagtcccggggtcccctacgaccgtatcgaggtcggcngggtcgggtacngggactagtactttcgactctacaccatacagcgacgtcctgacgaggtactagaagtgtggggtaggtacttaagtttacttagttacgtaactaaataaattatttaattacttacgttcggtaaggtaccgttcggacgttaaagggtaaccgtaaggttacgttattacgaagaagtaacgtacgtgttagtcttcgaacc

SEQ ID NO: 429306 - DNA, 698 bp, Homo sapiens
  misc_feature: GZ8MTXP01CZYN5.19.71.G05.1.454.CMB.2.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgagccgggccacatcaactgcaagtccagccactaattctttatactagttaccaaacaatagaaaactacttagcttaggaccagcagagaccaggacagcctctaggctgctctatttacgtgggctacgttaccgtaacccggggtaacgtccccgggggtcccccctggtaaccgtagtttacccgaggttccgggcgtaacgggtccggggtccgtacgggggaactaggttaactttccaaaccttcctaccaacccaattccgaacgaccgaacggtccctggaccgagggactaggaaaggtagtttgggggtagtacgttaaagttttatttaagttcgtaaactaaactaaatttaatttaaattacgttaaccgttttcgggtaacgggttaaccggtttacggggtaacccggaaaagggggtaacccgtaaagggttggaattacgtaacgaaggtaacgtaaacgtggttacggtcgttcggtaacc

SEQ ID NO: 429307 - DNA, 557 bp, Homo sapiens
  misc_feature: GZ8MTXP01EZ66X.19.71.G05.1.454.CMB.2.raw
  modified_base (314)..(314): a, c, t, g, unknown or other
  modified_base (506)..(506): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtggtcaggcacgtccccatcgagaggtctagngtggcgtagggaagacagtatttcaattgtccaaacgtacgtaggaaatacaaattatcgacacatctagttgagtagtacgactgaacaatacaaacgtacgaacaacgaacgtacgaaacgaacctagttcctccgtgacctagctcgacctcgtcgttcgaccgttacccgaggtaacgttacgggttnttaagttaagttacgtcggtagggaacgttaccggaaccccttaagtaacg

SEQ ID NO: 429308 - DNA, 560 bp, Homo sapiens
  misc_feature: GZ8MTXP01AC1IH.19.71.G05.1.454.CMB.2.raw
  modified_base (375)..(375): a, c, t, g, unknown or other
  modified_base (422)..(422): a, c, t, g, unknown or other
  modified_base (507)..(507): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccatcgagaggtctagagtggcgtagggaacgacagtatttcatacgtaccaacgacggtaggaaataacgaaatttangaccacctatcgtgttagagagtcgactagaacaatacaaacggtanaacacagtacgaaacgaacctagttcctccctgaccagtcctacgtacctgtcgtcgacccgtccggaaggaccgtacggggttnttacttacgttaacgtggtaacggaacgtaccggacccctaagttaacgaacg

SEQ ID NO: 429309 - DNA, 632 bp, Homo sapiens
  misc_feature: GZ8MTXP01AUN4M.19.71.G05.1.454.CMB.2.raw
  modified_base (241)..(241): a, c, t, g, unknown or other
  modified_base (309)..(309): a, c, t, g, unknown or other
  modified_base (318)..(318): a, c, t, g, unknown or other
  modified_base (372)..(372): a, c, t, g, unknown or other
  modified_base (411)..(411): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcggccacgatcaactgacaacgtccagccactaattctttanacagttaccaacaatagaaactcttagcttagaccagcagacaccaggacagcctacgtaggctgctntatttacgngggactagtccgtacccgggatccccggggtcccaggaccgattcgagtcggcnggcgggtcgtagggactagtactttcactctcacatcancacgctgaccgtaggctaagaagtagtggggtacggtacttaagtttattagttacgtacctaaaattaatttaatttaatttaacgttaccgttacgggttaacggttaccgggtttaccgggaacccggttaaagggggaacccgtaaaggggttcggttaaattacggtaaccgaagggtaacccgtaacggttggttacggtccttaacggtaaccc

SEQ ID NO: 429310 - DNA, 647 bp, Homo sapiens
  misc_feature: GZ8MTXP01CFQR2.19.71.G05.1.454.CMB.2.raw
  modified_base (237)..(237): a, c, t, g, unknown or other
  modified_base (247)..(247): a, c, t, g, unknown or other
  modified_base (260)..(260): a, c, t, g, unknown or other
  modified_base (335)..(335): a, c, t, g, unknown or other
  modified_base (382)..(382): a, c, t, g, unknown or other
  modified_base (394)..(394): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggccgggccacgatacgaactgacaagtccagccaanaattctttanacagttaccaaanaatagaaaactcttagcttaggaccagcagacgaccaggacagcctacctaggctagctactagttttacccggnggtactacgtaccggtaccgggtacgtcccgggtccccacgtacgtntcgaggtcgcgngggtcggtacgacgggactagtacttcactacctacacacgtacgacgacgacgtccgtcgcgacgtacgtagagtagtaggggtacgttacgtttaatttaactttaactttaactaaattaatttaattattaacgttacgttcggttacggtaacggttacggaacggtaaacgggttaacgtaagggtacgttagttacgttacgtaacggtaacgtaacggtggtacgttacgtcgttaacgtaaccg

SEQ ID NO: 429311 - DNA, 580 bp, Homo sapiens
  misc_feature: GZ8MTXP01DP697.19.71.G05.1.454.CMB.2.raw
  modified_base (324)..(324): a, c, t, g, unknown or other
  modified_base (344)..(344): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctaggggaagacatatttcatgtaccaaanacgtggaaactacaaattangcaaccatcgtgttgagagtcgactgaacaatacaaacgtagacacatacgaaagaaccagttctccctgcagctcgtaccttctcgtcgacctcccgaggaccgtacgggttgtacgttagttaccgtaaggttacgggaaacggaccggttacccccgtaaagtacggaaccgttacttccggaacccctaacccgttccgttccgttccgttgggttaacgttccgtttaagg

SEQ ID NO: 429312 - DNA, 600 bp, Homo sapiens
  misc_feature: GZ8MTXP01A4LJG.19.71.G05.1.454.CMB.2.raw
  modified_base (236)..(236): a, c, t, g, unknown or other
  modified_base (247)..(247): a, c, t, g, unknown or other
  modified_base (325)..(325): a, c, t, g, unknown or other
  modified_base (375)..(375): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccgatacgaactgacaagtccagccanaattcttttanacagttaccaaataatagaaaactcttagcttaggaccagcagacaccaggacagcctctaggctgctcatttaccgnggactacgtaccgacggacgtccggtcccacgacgtatcgaggtacgcgnggtcggtcgacggactagtacttcactctacacactcgagcgacgcgtgacgagcgtagaagtgtggggtcgtattaagtttattagttacgtaactaaacgttaatttatttaacgttacgttacgttggtaacgggttaaccggttacgggaaccgaaagggtaaccgtaagggttacgttattacgaacgtacggaacgtacgtggttacgtcgttcgaacc

SEQ ID NO: 429313 - DNA, 707 bp, Homo sapiens
  misc_feature: GZ8MTXP01DIP2B.19.71.G05.1.454.CMB.2.raw
  modified_base (244)..(244): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccgacggggacatcgtgatgacccagtctccagactccctggctgtgtctcgtgggcgagccgggccaccatcaactgacaagtccagccaataattcttttaanactacgttaccaaacaataacgtaaaacttacttagtcgtacggaccagacagacgaccgaggacacgccctacgtacggctcgtaccttacgttaacgtttacgtcgggacctaaccgttacccggtaacccgggggtaaccgttccccggggtacccctaccggaccgtacgttcggaggtcgggaacgacgggtccggggtacgtacggggactacgtactttacaccttcctaccactactcgacgccacgtccgtacgacgaggtcgtagaagtgttaggtacgggtactttaagttttaatacgtttacgaactaaacttaatttaatttaattacgttacgttcggtagggtaaccggttccgggaacgggtaaacgggttaacgtaaagggtgttaaacttacggttaacgtaacggtaaacgtaacgttggtcggttctaacgaaccgtaaccg

SEQ ID NO: 429314 - DNA, 560 bp, Homo sapiens
  misc_feature: GZ8MTXP01AXT1B.19.71.G05.1.454.CMB.2.raw
  modified_base (514)..(514): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccatccgtccggggacaggagtcgctagcgacagtgttgcttggcacgtgggtcaggcacgtccccagtcgagaggtctaggagtggcgtagggaaggactatattcaattcgtccaaacgtacgtaggaaatacgtaaattatgacacctatctagttagagtagtcgactgaacaatacaacgtacgacacaagtacgaagtaacctagttcctacccgtagcaacggctacgacctctacgttcgaccgttccggaggacgttacgggttnttacgttaagttacgtggtagggaacgaccggtccccaagtaaccg

SEQ ID NO: 429315 - DNA, 593 bp, Homo sapiens
  misc_feature: GZ8MTXP01DKH02.19.71.G05.1.454.CMB.2.raw
  modified_base (234)..(234): a, c, t, g, unknown or other
  modified_base (244)..(244): a, c, t, g, unknown or other
  modified_base (255)..(255): a, c, t, g, unknown or other
  modified_base (265)..(265): a, c, t, g, unknown or other
  modified_base (316)..(316): a, c, t, g, unknown or other
  modified_base (378)..(378): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagccgggccacgatcgaactgacaagtccagccanaattctttanacactaccaanatagaaactntagctagacagacagacgacagacacgcctcgtagctgctactatttacgnggactacgtaccgtaacccgggacgtccccggggtccccacggacgtatcgaggtcggacgngggcgggtacgtagggactagtactttcactctacaccatcagcgacgcctgacgagactagaagtgtggggtcgtacttaagtttattagtacgtaactaaattaaattattattaacgttacgttcggtaacggtacggttacggaacgaaacgggtaacgtaagggttagttattacgtaacgaagtaacgtagtggttacgtcgttcgaac

SEQ ID NO: 429316 - DNA, 598 bp, Homo sapiens
  misc_feature: GZ8MTXP01DB103.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcctccggggacagagtcgctagcgacagtgttgcttggcagtggtcaggcagtccccatcgagaggtctagagtggctgggaagactattatttcatgtaccaaacgacgtaggaaactaacaaattatgaccaaccatctgttagaagagtcgactgaacaatcaaacgtagacacatacgaaacgaacctagttcctccctgacacgctacgacccttcgtacggtacacccgtcccggaagaaccgtacggggttagttaattaactttaccgtgggtaacgggaaacggaccgggaccccctaaagtaacggaccacgttaccggaaccctaacccttccggttccttccggttaggggttcgttaacgtttaacgg

SEQ ID NO: 429317 - DNA, 582 bp, Homo sapiens
  misc_feature: GZ8MTXP01E1FAI.19.71.G05.1.454.CMB.2.raw
  modified_base (239)..(239): a, c, t, g, unknown or other
  modified_base (316)..(316): a, c, t, g, unknown or other
  modified_base (346)..(346): a, c, t, g, unknown or other
  modified_base (362)..(362): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcaagtccagccacaatcttttanacagttaccaacaatagaaaactacttagcttggtaccagcagagaccaggacagcctctaggctgctcatttacgnggcatccgtaccgggatccggggtcccccngaccgattcagtggcnggcgggtctggggacagtactttcactctacaccatcagcacgcctgcaggctagaagatggggtggtatagtttattagttgtactaaataattattaatttactaacgttcggtaaggttaccggtttaccgggaccgaaacggggaaccgtaagggttggaacgtttaacgaacgtaacggtaaccgtacgttcggttcggtaaccgttcgtaaccc

SEQ ID NO: 429318 - DNA, 593 bp, Homo sapiens
  misc_feature: GZ8MTXP01D6UK3.19.71.G05.1.454.CMB.2.raw
  modified_base (243)..(243): a, c, t, g, unknown or other
  modified_base (331)..(331): a, c, t, g, unknown or other
  modified_base (429)..(429): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactcctggctgtgtctcgtgggcgagccgggccacgatacgactgacaagtccagccactaattctttaanactactacaataataacgtaaactactagcgttacggacagacaagacgaccgagacacgtccctacgagctacgctactagttacgnggactacgtaccgtaccggtacgtccccggtccctacggacgtagtcgaggtcgacgcgggtcgggtacgtacgggactagtacttcactcacactanacagacgacgcgcgacgacgacgagagtagtgggtagtagttagttattattagtactaataattattattacttacgttcgtaacggtacgttacggtacgaacggtaacgtaagttagttagttacgtaagacgtaacgtagtagttacgtcgttcgtaacg

SEQ ID NO: 429319 - DNA, 703 bp, Homo sapiens
  misc_feature: GZ8MTXP01DXMHC.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttctcttctctgccgtgctgggcctccacaaggtgtcctgtcacaagtacagctgcagcagtcaggtccaggactggtgaacgccctcgcacgacccctctcgctcacctgtcgcccagtccgtccggggacaggacgtcgctagcgactagtgttgcttggcacgtggggtcaggcacgtccccatcggagaggtctaggaggtggcgtaggggaaacggactagttactttcagttacgtaacccaacgtaacggtagggaaaactaactaaaatttacgacgacctaacctagttacgttaggttacggaagtacggttaccgtaacttaggaactaaacttacgaaacgttaacgaaacaacgtaaacgttaaccggaaaaccggtaaacccttaaccggtttccctacccgttacgaccgttaacgtccgttaccggtacccttcgtaacgggttaccgttaacccgttacccgggaaacgggtaaccggtaaccgggggttacttaaacgtttaacgtttaaccggtagggttaacgggaaaccggtaccgggaccccctaagttaacggtaaacccg

SEQ ID NO: 429320 - DNA, 635 bp, Homo sapiens
  misc_feature: GZ8MTXP01BOKI3.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggactggtgaacgcccctcgcacgacccctctcgctcacctgtcgccatcgtccggggacagagtcgctagcgacagtgttgcttggcacgtgggtcaggcacgtccccagtcgagaggtctagagtggcgtagggaacgactagtatttcagtacgtaccaacgtacgtaggaaacttaactaaattactacgacctaaccctagttccgttaggttacggaggtacgttacgaacgttacgtaaacctaaacgttaccgaaaccggttaaagaaccctaaacgtaaacgttaaaccggaaaaccgtaaacccgttaaacgtttcccctacccgttagaccgtaacgtccgtacgtacccttcgtaacgtacgaccgtaccgaggacgtacggttgttattacgttcgtaggtaaggacgacggaccctaagttcgaac

SEQ ID NO: 429321 - DNA, 679 bp, Homo sapiens
  misc_feature: GZ8MTXP01A6342.19.71.G05.1.454.CMB.2.raw
  modified_base (620)..(620): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgtgcttggcacgtgggtcagggcacgtcccccagtccgagaggtctaggagttggcgtggggaaggactatatttcaattcgtcccaaacgtaccgtagggtaaattaccaaaatttactacgacctaaacccgattaccgtaggtttaggaaggtaacggttaccggtaacctttaggaaacctaaaactttaccgaaaaccggttaacggaaccgaaactaaacgttaaccgaaaacgtaaaacccgtaacggtttaccctaaccccgttgggacccaaggtcccttacggaacccttcgtacggttaccgtaacccgcccgggaaacggtaaccgttaacgggggttnttaacgtaagttaccgtttggacgggtaacggaccgggtaaccccccaagttaacccgg

SEQ ID NO: 429322 - DNA, 581 bp, Homo sapiens
  misc_feature: GZ8MTXP01AI00T.19.71.G05.1.454.CMB.2.raw
  modified_base (238)..(238): a, c, t, g, unknown or other
  modified_base (283)..(283): a, c, t, g, unknown or other
  modified_base (315)..(315): a, c, t, g, unknown or other
  modified_base (378)..(378): a, c, t, g, unknown or other
  modified_base (414)..(414): a, c, t, g, unknown or other
  modified_base (421)..(421): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcggcacatcaactgacaagtccagccactaatcttttanacagttccaaacaatagaaaactcttagcttaggtaccagcaganaccaggacagcctctaggctgctcatttacgnggcagtcgtacccgggatccccggggtcccctaggaccgtattccgagtcgcaaggcgggtcnggggactagtacttcacttcacaccatcagcagccngcgacgntagaagtgtggggtacgtacttaagtttattagttacgaactaaacttaattatttaattacgttacgttcggtaacggtaccggttaccggaaccggaaacgggtacgtaaggttgttacttacgtaacgagtaacgtagtggttacgtcgttcgtaac

SEQ ID NO: 429323 - DNA, 652 bp, Homo sapiens
  misc_feature: GZ8MTXP01DG0LP.19.71.G05.1.454.CMB.2.raw
  modified_base (226)..(226): a, c, t, g, unknown or other
  modified_base (235)..(235): a, c, t, g, unknown or other
  modified_base (237)..(237): a, c, t, g, unknown or other
  modified_base (244)..(244): a, c, t, g, unknown or other
  modified_base (248)..(248): a, c, t, g, unknown or other
  modified_base (254)..(254): a, c, t, g, unknown or other
  modified_base (257)..(257): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagccagccanaatctttananatacaanatanaaactntanctagacagacagacgacagacagcctacgtagctgactactatttacgtcgggacagtaccgtaacccgggtacgtcccggggtcctacgaccgtagtcgacggtcggacgacggtcggtcgtacgggacgtacgtacgttactactctaccacctactacacgacgacgtaccgtacgacgacggacgtagaagtagtaggtacggggtacgttaagtttaagtttagtttagttacgtaaactaaatttaatttaatttaagtttaacgttacggttacgggttaacggttacggttaaccggtaaacgggttaaccggtaaacgggtaggttaacgttacgttacgtaacgtaacggtaacgttaggtacggttcgtcgttaaccgtaaccg

SEQ ID NO: 429324 - DNA, 678 bp, Homo sapiens
  misc_feature: GZ8MTXP01AWTV9.19.71.G05.1.454.CMB.2.raw
  modified_base (246)..(246): a, c, t, g, unknown or other
  modified_base (334)..(334): a, c, t, g, unknown or other
  modified_base (376)..(376): a, c, t, g, unknown or other
  modified_base (390)..(390): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccacgatacgaactgacaagtccagccactaattctttaanactactacaaactaatacgtaaaactactagcgttacgaccagacagacgaccagacacgccctacgtagctgactactagtttacgnggctacgtaccgtaacccggacgtcccggtcccctagacgtntcgacggtggacgnggtccgggtcgtagggactagttacttaccacctacctaccaaccgtactacgacgaccgacgaccgtacgacgacggtacgtagtaagtagtaggggtacggtacgttaacgtttaagtttagttacgttaacgtaaacttaaactttaatttaacgtttaacgtttacgttacggttaacgggtaccggttaccggtaaccggttaaacgggtaaacggtaacggttaggttaacgttacgtaacgtaacgtaacgtaacgtacggttacggtcgttaacgtaacg

SEQ ID NO: 429325 - DNA, 628 bp, Homo sapiens
  misc_feature: GZ8MTXP01C3DCU.19.71.G05.1.454.CMB.2.raw
  modified_base (378)..(378): a, c, t, g, unknown or other
  modified_base (554)..(554): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcacgaccctctcgctcacctgtcgccatccgtccggggacagagtcgctagcgacagttgttgcttggcacgtggtcaggcacgtccccagtcgagaggtctagagtggcgtagggaaggactatatttcaattcgtccaaacgacggtaggaaatacgaaattnagacactatctagttgaagagtacgactagaacaatacgaaacgtagaacacgtaacgtaaccgaaacgtaacctaacgttccctacccgttacggacctaacggtcctacggtaacccttcgtacggttacgacccgttaccccgggtaaacgggtaacccgttaacgggggttnttaacgtttaacgttaaccgttaaggggttacgggtaaaccgggttaccgggtaaccccccaagttaaacccgg

SEQ ID NO: 429326 - DNA, 579 bp, Homo sapiens
  misc_feature: GZ8MTXP01ASE53.19.71.G05.1.454.CMB.2.raw
  modified_base (236)..(236): a, c, t, g, unknown or other
  modified_base (248)..(248): a, c, t, g, unknown or other
  modified_base (252)..(252): a, c, t, g, unknown or other
  modified_base (309)..(309): a, c, t, g, unknown or other
tcagtactctcgtgcacgaccggtgctcgatttagtgtcgtcgcaagagagaggggtacaacaggcaggcagggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatcttttaanacagtaccaaanatanaaactactagctgacagcagagaccaggacagcctcgtaggctgctactatttacgngggcactccgtacccgggagtcccggggtcctacgaccgtatcgagtcggacagggtcggtacgtgggacagtattcactctacacatcacgacacgacgtcgacgacgacgtagaagtagtgtaggggtacgtagtttaatttagttacgtacgtaaactaaattaattaattaattacgttacgttggtaacggttacggttacggtaacggacgtaacggtaggttagttattacgaagacgtaacgtaggtggttcgtcgcgtaac

SEQ ID NO: 429327 - DNA, 579 bp, Homo sapiens
  misc_feature: GZ8MTXP01B4J8F.19.71.G05.1.454.CMB.2.raw
  modified_base (234)..(234): a, c, t, g, unknown or other
  modified_base (353)..(353): a, c, t, g, unknown or other
  modified_base (363)..(363): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatagaaaactacttagcttggaccagacagagaccaggacagcctccgtaggctgctctatttacgtggcatccgtacccgggatcccggggtccccctgaccgtntcaggtggcnggcgggtctgggacagtacttcgactctcaccatcagcagccctgacaggctagaagtgtggggtcggtcttaagtttattagttcgtactaaacgtaattatttaattacttacgtttcggtaagggtaccgttcgggaccgttaaaggggaccgtaagggttcgggttattacgtaacgaaggtaacgtaacgtggttacggtcgttcgaaccc

SEQ ID NO: 429328 - DNA, 621 bp, Homo sapiens
  misc_feature: GZ8MTXP01B6YDJ.19.71.G05.1.454.CMB.2.raw
  modified_base (248)..(248): a, c, t, g, unknown or other
  modified_base (337)..(337): a, c, t, g, unknown or other
  modified_base (398)..(398): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactcctggctgtgtctcgtgggtgaggccgggccacgatacgaactgactaagtccagccaactaattctttaanactacgttaccaaataatacgaaaacttctagcttaggacagacaagacgaccgagacacgcctacgtaggctcgctactagtttacgnggactacgtaccggtaaccgggacgtccgggtacccctacggacgtagtcgaggtcgacgngggtcgggtacgtacgggactagtacttcactcacaacatacacgacgacgcgtcgacgacgacgtagaagtagtagggtaggtagttagtttagttagttagtactaactaattaattattattacgttcggtaacggtacggttacggtacggaacggtaacggtaaggttagttagttagtaacgtacgtaacgtacgtacggttacgtcgttcgtaacg

SEQ ID NO: 429329 - DNA, 609 bp, Homo sapiens
  misc_feature: GZ8MTXP01DYOSW.19.71.G05.1.454.CMB.2.raw
  modified_base (413)..(413): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtgccatcgtccggggacagagtcgctagcgacagtgttgcttggcacgtgggtcaggcacgtccccagtcgagaggtctagagtggcgtaggggaacgactagtatttcatcgtaccaacgtacgtaggaaataacaaattacacgacactatcgtagtagagtagtacgactagaacanaactaacggaacaaccaacgaacgtaacggtaaaaccaaccgttacgttacccctcccgtagaccgtacgtcgttaccgtacctcggtaacgtaccggacccgttcccggaaaggtaacccggtacgggttaagttaagttacgttaacggttaggaacggtaaacgccccggttaaccctaagttaacggtaacc

SEQ ID NO: 429330 - DNA, 549 bp, Homo sapiens
  misc_feature: GZ8MTXP01DJV0T.19.71.G05.1.454.CMB.2.raw
  modified_base (236)..(236): a, c, t, g, unknown or other
  modified_base (261)..(261): a, c, t, g, unknown or other
  modified_base (311)..(311): a, c, t, g, unknown or other
  modified_base (517)..(517): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccatcaactgcaagtccagccacaatctttanacagttaccaaacaatagaaaactnttagctggtacagcagagaccaggacagcctcctaggctgctcatttacngggcagtccgtacccgggaatcccggggtccctagaccgtattcgagtggcaggcgggtctgggacagtatttcactctcacatcagcacgcctgcaggactagaagagtggtagggtcttaagtttattattgtacaaactaattaatttattatacgttcgtggtaacgttcggaccgtaaagggaccgtaaagggtgaagttnttacgaagaacgtaactgtacggctgcctaac

SEQ ID NO: 429331 - DNA, 513 bp, Homo sapiens
  misc_feature: GZ8MTXP01CD0T6.19.71.G05.1.454.CMB.2.raw
  modified_base (235)..(235): a, c, t, g, unknown or other
  modified_base (404)..(404): a, c, t, g, unknown or other
  modified_base (418)..(418): a, c, t, g, unknown or other
  modified_base (481)..(481): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgacaagtccagccacaatctttanacagttaccaaacaatgaaactactagctggtaccagcagagaccaggacagcctcctaggctgctcatttactgggcatctaccgggaatcccggggcctgaccattcagtggaccagcgggtctggggacagtattcactctcacatcagcagcctgcagctgaagntgtggctaagtttnttatgtacaatatattatatacgttcgtggaacttcggactaagggaccgaaaggtgaagttnttacgaagacgtaacttgcggctgcctaaccg

SEQ ID NO: 429332 - DNA, 570 bp, Homo sapiens
  misc_feature: GZ8MTXP01DZP2C.19.71.G05.1.454.CMB.2.raw
  modified_base (238)..(238): a, c, t, g, unknown or other
  modified_base (319)..(319): a, c, t, g, unknown or other
  modified_base (444)..(444): a, c, t, g, unknown or other
  modified_base (495)..(495): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttaccaaacaatagaaaactacttagcttaggtaccagacagacgaccaggacagcctcctaggctgctcatttacngggctagtccgtaacccggggaatcccggggtccccctaggaccgtattccgaggtcggcaaggtccgggtctaggggactagtactttcactctcaccatcagcacgcctagcaggctgaagtntgggtggtactagtttatattgtactaaataattattattaatcgtttggnggtacgttcggacgaaagggtacctaagggttggttacttatcgaagtaacgaacgtggttacggcttggaaccc

SEQ ID NO: 429333 - DNA, 536 bp, Homo sapiens
  misc_feature: GZ8MTXP01AL6YX.19.71.G05.1.454.CMB.2.raw
  modified_base (237)..(237): a, c, t, g, unknown or other
  modified_base (313)..(313): a, c, t, g, unknown or other
  modified_base (414)..(414): a, c, t, g, unknown or other
  modified_base (440)..(440): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtggcgagcgggccaccatcaactgcaagtccagccacaattcttttanacagttccaaacaatagaaaactactagctaggtaccagcagagaccaggacagcctcctaggctgctcatttacngggcatccgtacccgggaatcccggggtcctgaccgattcgagtgcaggcggtctgggactagtatttcactctcacatcagcagcctgcaggctagaagngtgtggggactagtttatagttacanaataatattattatacttcgtggaacgttcggaccgaaagggaccgtaaaggtggaattgacgtaagaccggtaactgtgggctcgaacgtaaccc

SEQ ID NO: 429334 - DNA, 615 bp, Homo sapiens
  misc_feature: GZ8MTXP01D03C8.19.71.G05.1.454.CMB.2.raw
  modified_base (247)..(247): a, c, t, g, unknown or other
  modified_base (334)..(334): a, c, t, g, unknown or other
  modified_base (372)..(372): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctccctggctgtgtctcgtgggcgagccgggccacatcaactgacaagtccagccaactaattctttaanacacgttaccaaactaatacgaaaactacttagcttaggaaccagacagacgaccaggacagcctacgtaggctgctctatttacgnggactactccgtaacccgggacgtcccggggtcccccnggaccgtattccgaggtcgggctaacggttcgggtcgtaggggaactaggtactttccactcctacaacccatcaagcacgtcctgaccgaggctagaaagtgtggggtaggtcttaagtttatattgtaactaattaaagttatttaattagttaccgttggtaaggtacgttacggaccgaaaggtaccgtaagggttgacttacaacgaaggtaaccgtaagtggttacgtcttcgaacc

SEQ ID NO: 429335 - DNA, 577 bp, Homo sapiens
  misc_feature: GZ8MTXP01DM3WK.19.71.G05.1.454.CMB.2.raw
  modified_base (248)..(248): a, c, t, g, unknown or other
  modified_base (259)..(259): a, c, t, g, unknown or other
  modified_base (324)..(324): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagactccctggctgtgtctcgtgggcgaggccgggccacgatcgaactgacaagtccagccaactaattctttaanactataccaanaatataaactactagctagacagacagacgacagacacgtcctcgagctgtctactagtttacgnggactacgtacccgaacccgggtacgtccccggggtacccctacggacgtatcgaggtcggcgcgggtcgggtcgacgggactagtacttcactctacacatcagcacgctgcgagacagagtgtgggtgtattattatatagtaactaataattattattagttacgtcggtaacggtacggttacggaacgttaacggtaacgtaggttagttattacgtaacgaagtaacgtacgtgttcgtcgcgtaac

SEQ ID NO: 429336 - DNA, 602 bp, Homo sapiens
  misc_feature: GZ8MTXP01BXOKC.19.71.G05.1.454.CMB.2.raw
  modified_base (245)..(245): a, c, t, g, unknown or other
  modified_base (436)..(436): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagacctccctggctgtgtctcgtgggcgagcgggccacgatacgaactgacaagtccagccactaattctttanactagttaccaataatagaaaactcttagcttaggtaccagacagacgaccgaggaccagccctacctaggctgctactagtttacgtggctagtcccgtaacccggggatccccggggtcccctaggaccgtattccgaggtcggcaacgggcgggtcgtggggactaggtctttcgacttcgacaccancagcacgcgtcgcgagacgagagtagtgggtagtagttagtttattatagtactaataattaattattacttacgttcgtaacggtacgttacggtacggaacggtaacggtaacggttagttagttacgtaacgacgtaacgtacgtagttcgtcgttcgtaacg

SEQ ID NO: 429337 - DNA, 615 bp, Homo sapiens
  misc_feature: GZ8MTXP01DT4EG.19.71.G05.1.454.CMB.2.raw
  modified_base (354)..(354): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagagtcgctagcgacagtgttgcttggcacgtggtcaggcacgtccccagtcgagacggtcagagtggcgtaggggagactatatttcaatcgtccaaanacgtaggaaactaactaaattatcgactaacctattcgtagttagaagtagttacgactagaacaactaacgaaacgtagaaccgaactaataaccgaaacgtaaccctaagttccctcccgtagccctagtacctacggtacccttaacgtcgttacggtaacccgttcccggaaacggtaccgaacggggttgttaaactttaacgttaaccggttggtaaacgggaaccggacccgggtaaccccccaagaaacccgg

SEQ ID NO: 429338 - DNA, 589 bp, Homo sapiens
  misc_feature: GZ8MTXP01B2U90.19.71.G05.1.454.CMB.2.raw
  modified_base (244)..(244): a, c, t, g, unknown or other
  modified_base (320)..(320): a, c, t, g, unknown or other
  modified_base (416)..(416): a, c, t, g, unknown or other
  modified_base (440)..(440): a, c, t, g, unknown or other
  modified_base (461)..(461): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctcgtggggcgagcgggccaccgatcaactgacaagtccagccacaattctttanacagttaccaacaatagaaaactctagcttaggaccagcagagaccaggacagcctctaggctgctctatttacgngggacatccgtacccggggaactcccccgggggtccctaggaccgtattcgaaggtcggcgagggcggggtctagggacagtacttcactctcacntcagacagcctagcagctagaagngtgtggtactagtttatagtntactaaatattattattacttcgttcggtacggttacggttaccggaccgtaaaggggtaaccgttaaggggttcgttaagttaacgtacgaacggtaaccgtaacgttgggtaacggttcgtaaccg

SEQ ID NO: 429339 - DNA, 649 bp, Homo sapiens
  misc_feature: GZ8MTXP01AVHMB.19.71.G05.1.454.CMB.2.raw
  modified_base (224)..(224): a, c, t, g, unknown or other
  modified_base (579)..(579): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctntcgctcacctgtgccatcgtccgggacagagcgctagcgacagtgtgcttggcacgtgggtcaggcacgtcccccagtccgagtacggtctaaggaggtcggcgtagggaaggtactagtatttcgaaattcgtcctaaacgaccggtagaaactaactaaattactcgactaacccagttacgtgttagagtagtacgtactcgaactaacgtacgaaacgttagaaccgacgtaagtaaccgaaacggtaaccctaacggttcccgtaccctacgtccgaacgtcgtacggtaccccttcgtacgttacggtacccgttaccccggtaaacgggtaccgttaaccgggggttnttaacgttaacgtttacccgtaagggttacgggaacggttaacccgggccccccgttaaagttaacccgg

SEQ ID NO: 429340 - DNA, 772 bp, Homo sapiens
  misc_feature: GZ8MTXP01CZI8I.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagagtcgctagcgacagtgtgcttggcacgtggtcaggcacgtccccagtcgagaggtactaggagtggcgtaggggaaggtactagttaactttcaaacgttacgtaacccgtaaaacgtaacgggttaacgggtaaaacttaaaccgtaaaatttaacgtacggtaccctaaaccctaagttaccgttagggttttaaggaaacgggtaacgggttacccggtaaaccgtttacgggaaaaccctaaaacgttaacccgaaaaccgggtttaaccgggaaacctaaaccgtaaacggttaacccggtaaaaaccggtaaaccccgttaaccggtttaccccttaccccgtttaccggaccgtaaacgtcccgttaccgtaacccgttccgttcggttaccggtaaccccgttacccggtaaacgggtaccgttaacggggttcgttaacgtttaacgtttaacgtaacgggttacggaaaccggttaacccggtaacccccgttaagtaaacccgg

SEQ ID NO: 429341 - DNA, 605 bp, Homo sapiens
  misc_feature: GZ8MTXP01C5MD8.19.71.G05.1.454.CMB.2.raw
  modified_base (229)..(229): a, c, t, g, unknown or other
  modified_base (238)..(238): a, c, t, g, unknown or other
  modified_base (247)..(247): a, c, t, g, unknown or other
  modified_base (251)..(251): a, c, t, g, unknown or other
  modified_base (257)..(257): a, c, t, g, unknown or other
  modified_base (260)..(260): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccaggggacatcgtgatgacccagtctccagactccctggctgtgtctcgtgggcgagccgggccaccgatcgaactgacaagtccagccanaatctttanacatacaanatanaaactntanctagacagacagacgacagacacgcctacgtagctgctactagttacgcggactacgtaccgtaaccgggacgttccccggggtacctacgaccgtattcgaggtcggaacgacgggtcgggtcgtagggactagtactttacacttccacacgatcacgacgacgacgtcgacgacgacgtagaagagtagtagggtagttagtttattagttagtactaaactaaattaattaattaattacgttacgtacggtaacggttacggttacggtaaacggaacggtaaacggtaagttagttacgttacgtaagtacgtaacgtagtacgttacgtcgcgtaacg

SEQ ID NO: 429342 - DNA, 573 bp, Homo sapiens
  misc_feature: GZ8MTXP01BN68I.19.71.G05.1.454.CMB.2.raw
  modified_base (247)..(247): a, c, t, g, unknown or other
  modified_base (324)..(324): a, c, t, g, unknown or other
  modified_base (370)..(370): a, c, t, g, unknown or other
  modified_base (383)..(383): a, c, t, g, unknown or other
  modified_base (438)..(438): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccacgatacgaactgacaagtccagccactaattcttttaanactataccaataatacgtaaactactagcttagacagacagacgaccagacacgcctcgtagctgctactagttcgnggactacgtaccggtaaccggacgtcccggggtccccacggacgtntcgaggtacgcgnggccgggtgtagggactagtacttcactcacacactacagacacgcctcgcgagngtagagtagtagggtagtagttagttattatatactaactaattattattattacgttcgtaacgtacggttacggtacgaacggtaacgtaaggttaggttagttataagagaacgacgtagttcgtcgcgtcg

SEQ ID NO: 429343 - DNA, 555 bp, Homo sapiens
  misc_feature: GZ8MTXP01A7PB1.19.71.G05.1.454.CMB.2.raw
  modified_base (283)..(283): a, c, t, g, unknown or other
  modified_base (482)..(482): a, c, t, g, unknown or other
  modified_base (520)..(520): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcagtccccatcgagnggtctaggagtggcgtaggggaaggtactagttatttcattgtaccaaacgacgtaggaaaccttaacgtaaattagtgaccaaacccattcgtgttagagagtcgactagaacatacaacgtagacacgatacgaacaacctagttacctccgtgacacggctacgtacctctgtcgaccgtccggagacgtcgggtntacgtattacgtggtaggagacgaccccgagtacgacngttcgccctacctcgtctcgttgtcgttcgttaag

SEQ ID NO: 429344 - DNA, 742 bp, Homo sapiens
  misc_feature: GZ8MTXP01D0WZY.19.71.G05.1.454.CMB.2.raw
  modified_base (238)..(238): a, c, t, g, unknown or other
  modified_base (251)..(251): a, c, t, g, unknown or other
  modified_base (320)..(320): a, c, t, g, unknown or other
  modified_base (409)..(409): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcggccacatcaactgacaagtccagccacaattctttanacagttaccaaanaatagaaaactacttagcttaggtaccagcagagaccaggacagcctacctaggctgctcatttaccgngggcctagtccgtaaccccggggaagttccccgggggtaccccctaggaccgtatttccgaggtacggcgtaacgggccgggtttacgnggggaccagggttactttccaaccttccttccaaacccaacgttcccaaaggcccaaacgtccccgttgacccgagggtaccgttacggaaaagtacgtttgggggtacgggtacgtttaaagggttttttaactttaaacggtttgttaaacccaaaactttaaaactttaatttttaaaggtttaaacctttacgttttacggggttaacgggttaacgggttttaccgggaacccgttaaaacgggggaaccctaaagggggttaggggttaattacgttaaccgaaggttaaccggtaaacgtgggttacggggtccttggtaaccccg

SEQ ID NO: 429345 - DNA, 598 bp, Homo sapiens
  misc_feature: GZ8MTXP01CZGNP.19.71.G05.1.454.CMB.2.raw
  modified_base (242)..(242): a, c, t, g, unknown or other
  modified_base (254)..(254): a, c, t, g, unknown or other
  modified_base (313)..(313): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccgatacaactgcaagtccagccacaattcttttaanacattaccaaanaatataaactctagctagacagacaagacgacagacacgcctacagctgctctattcgnggacacgtaccgtaaccgggacgtcccggggtacctacgaccgtattcgaggtcggaacgagggtcgggtcgtagggactagtcttcgactctacacatacacgacgacgacgtacgacgacgacgtagaagtagtagtacgggtacgttagtttattagtagtactaactaattaattaattattacgttacgtcggtaacggtacggttacgtaacggaacgtaaggtaggttagttacgttacgtaagtacgtaacgtacgtacgttacgtaacgcgtaacg

SEQ ID NO: 429346 - DNA, 637 bp, Homo sapiens
  misc_feature: GZ8MTXP01DHOY2.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgcctcacctgtcgccatcgtccggggacagagtcgctagcgacagtgttgcttggcacgtggtcaggcacgtccccatcggagaggtctaggacggtggcgtaggggaaggactagttatttcgaaattcgtccaaacgtaccggtagggtaaaactaacgtaaaatttactacgacctaacctaattcgtagttagaaggagttacgtaactacgaacaaactacgaaacgtaacgaacgaacaacgtaaccgaaacgaacccgtaacgttccctacccgtacgcctacgtctacgccttcgtcgttacgtacccgttacccggacgggtaaccgttacggggttagttaagttaacgttaacggttaaggttacgggaaccggttaccgggaacccccttaagtaaccg

SEQ ID NO: 429347 - DNA, 728 bp, Homo sapiens
  misc_feature: GZ8MTXP01A9M5Z.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggccacggtcccccagtccggaggtacggtctaggaggtggcgtaggggaaaggactagttatttcaaagttcgtccgaaacgtaccggtagggaaataaccgtaaaatttagtcgacctaaccgtaattcgttaggttagaaggtaacggttaccggtaacttaggaaacctaaaacgttaccgaaaacggttaacgaaaccgtaaactaaacgttaaccggaaaacggtaaaccctaacggtttccctaacccgttcgaaccgtacggtaccttacgaaccccgttcgttacggttaccggtaacccgttccccggggaaacgggtaacccggttaaccgggggtttattaaacggtttaacgtttaacccgggtaagggttaaacggggaaaccgggttaaccccggggtaaccccccttaaagttaaacccggg

SEQ ID NO: 429348 - DNA, 644 bp, Homo sapiens
  misc_feature: GZ8MTXP01B903I.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccatcgtccggggacagagtcgctagcgacagtgtgcttggcacgtggtcaggcacgtccccagtcgagaggtctagagtggcgtaggggaaggactatacttcaatcgtccaaactacggtaggaaactaactaaattactacgacaaccgtatcgtagttacgaagagttacgactagaactaacgtacaaacgttacgaacaactaacgtaaccgaaacgtaaaccgtagttacccctaccgttacgaccgaaacgtccgttaacggtcccttaacgttcggttaccggtaaacccgttaccccgggaaagggtaaccggttaccggggttagtttaaacgtttaagttaaaccggtgggttaacgggaacggacccggggtaacccccttaagttaaaccgg

SEQ ID NO: 429349 - DNA, 628 bp, Homo sapiens
  misc_feature: GZ8MTXP01E34IQ.19.71.G05.1.454.CMB.2.raw
  modified_base (330)..(330): a, c, t, g, unknown or other
  modified_base (618)..(618): a, c, t, g, unknown or other
  modified_base (620)..(620): a, c, t, g, unknown or other
  modified_base (622)..(622): a, c, t, g, unknown or other
  modified_base (625)..(625): a, c, t, g, unknown or other
  modified_base (627)..(627): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatagaaaactacttagcttggtaccagcagagaccaggacagcctcctaggctgctcatttactgggcatctacccgggaatccggggtccctgaccgattcagtggcagcgggtctgggacagatttcactctcacatcagcagcctgcaggctgaaagntgtgtcttagtttatatgtactaaaataattaattattatacgttcggtaggtacgttacggaccgaaagggaaccgtaagggtgtaataagtacgaacggtaacgtaacggtggtacggacctacggacctaacctaggtttccgttcgtttaccttaccgtaccgtttcccccgttaccccgacctaacgttccgtacgaaccgtaaccgggtaaggtaaccgttaacggttagggaacgggttccggggtacgtcggggaaccgaacgggcgtaaccaagtaagngngntgngng

SEQ ID NO: 429350 - DNA, 600 bp, Homo sapiens
  misc_feature: GZ8MTXP01DKZIG.19.71.G05.1.454.CMB.2.raw
  modified_base (330)..(330): a, c, t, g, unknown or other
  modified_base (350)..(350): a, c, t, g, unknown or other
  modified_base (423)..(423): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatccgtccggggacagagtcgctagcgacagtgttgcgttggcacgtgggtcacggcacgtccccagtcgagaggtctagagtggcgtgggaagactattatttcatgtaccaanacgtagaaactacaaattangacaaaccatcgtgttagagtacgtcgactagaaacaatacaacgtagacacatacgaacgaacctagttccncccgtgcacgctacggaccttcgtggtacgtacccgtacccggaggtaacgtacgggttagttaattaacgttacgtaacggtaacgggaaacggtaacccggaccccctaaagtaacgacttacgttccggaacccctacccgtccgttacctcgttcgggtcgttcgtttaacgg

SEQ ID NO: 429351 - DNA, 567 bp, Homo sapiens
  misc_feature: GZ8MTXP01EBZGB.19.71.G05.1.454.CMB.2.raw
  modified_base (334)..(334): a, c, t, g, unknown or other
  modified_base (516)..(516): a, c, t, g, unknown or other
  modified_base (555)..(555): a, c, t, g, unknown or other
  modified_base (559)..(559): a, c, t, g, unknown or other
  modified_base (561)..(563): a, c, t, g, unknown or other
  modified_base (565)..(565): a, c, t, g, unknown or other
  modified_base (567)..(567): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcggaccaccatcaactgcaagtccagccacaattcttttatacagttccaacaatgaaaactacttagcttggtaccagcagagaccaggacagcctcctaggctgctcatttactgggcatcgtacccgggaatcccggggtccctgaccgattcagtggcaggcgggtctgggacagatttcactctcaccatcagcagcctgcaggctagaagntgtggcctagttttattattgtacaaaactaattaattatttatacttcgtaggtacgttcggaccaaggggaccaagggtgaatatacaggacgtaacgtgtacggctgactaccagttcttgttccttacacttcccttccccgcctaatcccgtgaacccgagtaacggaagttaacgngggacggccggggtcgtcgggacgaacgggcgaacgtanaagngnnngngn

SEQ ID NO: 429352 - DNA, 619 bp, Homo sapiens
  misc_feature: GZ8MTXP01DEI4T.19.71.G05.1.454.CMB.2.raw
  modified_base (230)..(230): a, c, t, g, unknown or other
  modified_base (237)..(237): a, c, t, g, unknown or other
  modified_base (246)..(246): a, c, t, g, unknown or other
  modified_base (250)..(250): a, c, t, g, unknown or other
  modified_base (255)..(255): a, c, t, g, unknown or other
  modified_base (258)..(258): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgccacggggacatcgtgatgaccagtctccagactcctggctgtgtctcgtggggcgaggccgggctacgactacgacgtgactaagcgcanatcttanacatacaanatanaactntanctagacagacagacgacgagacacgactcgtacgctcgctactacttacgtacggacgtacgtaccgtaccggtacggtccggtccccgtacgtacgtacgtacgtacgtacggacgcggtcggtcggtacgggtacgtacgtacttactactactacactactacgacgacgacgacgtacgacgacggtacgtagaagtagtacgggtacgtacgttagttagttagttacgtactaactaattaattaattacttacgttacgtaacggtacggttacggtacggaacggtaacggtaacggttacggttacgttacgtaacgtacgtaacgtacgtacggttacgtcgttcgtaacg

SEQ ID NO: 429353 - DNA, 591 bp, Homo sapiens
  misc_feature: GZ8MTXP01DMSFR.19.71.G05.1.454.CMB.2.raw
  modified_base (227)..(227): a, c, t, g, unknown or other
  modified_base (242)..(242): a, c, t, g, unknown or other
  modified_base (246)..(246): a, c, t, g, unknown or other
  modified_base (255)..(255): a, c, t, g, unknown or other
  modified_base (262)..(262): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgaactgacaagtccagccanatctttaacatcaanatanaactactanctgacancagacgacagacacgcctcgtagctcgactactagtttacgtgggactacgttaccgtaacccgggtaacgtcccggggtcctcgaccgtattcgagtcggacgtaggtcggtcgtagggactagtacttcactctactacatcagacacgcgtgcgaggctagaagtagtggtacgggtacttaagtttattagttacgtaactaattaatttattattaacttacgtttacggtggtaacggttccggacgtaaacggggttacgtaaagggtcgttaagttcgttacgaacggtaacgtaacgttggtcggttactcgcgtaaccg

SEQ ID NO: 429354 - DNA, 711 bp, Homo sapiens
  misc_feature: GZ8MTXP01CTGXQ.19.71.G05.1.454.CMB.2.raw
  modified_base (249)..(249): a, c, t, g, unknown or other
tcagtactctcgtgcacgaccggtgctcgatttagtgtcgtcgcaagagagaggggggaggtacaacaggcaggcaggggcagcgagatggtgttgcagacccaggtcttcatttctctgttgctctggatctctggtcgccccgacggggacatcgtgatcgacccagtcctccagacctccctggctgtgtctcgtgggcgagccggccaccatcaactgacaacgtccagccaactaattctttanactacgttaccaaataatacgaaaactacttagcttaggtaaccagacagacgaccgaggacacgccctacgtaggctgctactatttacgcggactacgtacccggtaacccgggtacgtccccggggtaccccctacggaccgtagttaccggagggtacgggccgtaaggggtcccggggttacgtacggggaactaggttacttttaccaaccttcctaccaaccctatccgaacgaccgacgtcccgtagaccgtacgggtactaggtaaagtcgttaggggtacggtacttttaagtttaacttagttacgtaaactaaattaaatttatttaacttacgttacgttccgggtaagggttaccggttcgggaaaccgaacggggtaaaccgtgggttaagttacttacgtaacgaaacgggtaaccgtaagtcgggttacgtaacgttcgtaaccc

SEQ ID NO: 429355 - DNA, 698 bp, Homo sapiens
  misc_feature: GZ8MTXP01DDA3Y.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttctcttcttcctgccgtgctggcctcccacaaggtgtcctgtcacaagtacagctgcagcagtcaggtccaggactgggtcgaacgccctcgcacgaccctctcgctcacctgtcgccagtcgtccgggacagacgtcgctagcgactaggtgttcgcgttggctacggtcgggtcgacggccacgtccccagtccggaggtacggtacgtaggaggtggcgtaggggaacggtactatttaactttacgaaagttacggtaacccgaaacgtacgggttaaacgggtaaaattaaacctaaaagtttcgacgtacctaacctagttacgttaggttaggtaaggtacggttaccgaacgttacgaaactaaacgtacgtaaaacggtaacgaacgaaaccgtaagtaaaccgaaaccgtaaaccgtcgtttccctacccgtagaccgtagtaccgtacggtacccttcgtacggttaccgacccgttaccggaacgggtaaccgttagggttacgtttaagttaacgttacggtaaggtaacgggaacgttacccggtaaccccttaagtaaccg

SEQ ID NO: 429356 - DNA, 656 bp, Homo sapiens
  misc_feature: GZ8MTXP01DXOMU.19.71.G05.1.454.CMB.2.raw
  modified_base (253)..(253): a, c, t, g, unknown or other
  modified_base (362)..(362): a, c, t, g, unknown or other
  modified_base (422)..(422): a, c, t, g, unknown or other
  modified_base (490)..(490): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctcccgtggctgtgtctcgtgggcgaggccggccacatacaactgacaacgtccagccaataactttcttttaanaactacgttaacccaaactaataacgtaaaaccttacgttagcgttaggaacccagacaagacgaccgaaggacaacgtccctccgtaggcctgacttctatttaccgngggcctagtacccgtaacccgggagtccccggggtccccacggacgtcttcgaggtcgcngggtcgggtcagggacagtactttcactcctacaccatcgagacacgtcctgacaggtactaggaagngttgggggacggtattaaagttttattagttacgtactaaataaatttatttaattaattcgttacggtaacgggttaacgttcgggaacgttaaacgggtaaccgtaaggttaggttattacgtaacgaaggtaaccgtaagtggttcggtcttaacggtaaccc

SEQ ID NO: 429357 - DNA, 602 bp, Homo sapiens
  misc_feature: GZ8MTXP01CT8DB.19.71.G05.1.454.CMB.2.raw
  modified_base (239)..(239): a, c, t, g, unknown or other
  modified_base (285)..(285): a, c, t, g, unknown or other
  modified_base (317)..(317): a, c, t, g, unknown or other
  modified_base (351)..(351): a, c, t, g, unknown or other
  modified_base (363)..(363): a, c, t, g, unknown or other
  modified_base (372)..(372): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgacaagtccagccacaattctttanacagttaccaaacaatgaaaactacttagcttggtaaccagcaganaccaggacagcctctaggctgctcatttacgnggcatccgtaaccggagtcccgggtccccagacntcgagtcggcgnggtcgggtntagggactagtacttcactctacaccatcacgcacgccgtgacgagtcgaggaagtagttcggggtacggtacttaagttttagttagttacgtaactaaacttaaatttaatttaatttaacgttacgtttacggtaacggttaccggttaccgggaaccgttaaagggtaaaccgtaaggttaggttaacttacgtaacgaagaacgtaacgtgttacgtcgttcgcc

SEQ ID NO: 429358 - DNA, 625 bp, Homo sapiens
  misc_feature: GZ8MTXP01DBQPU.19.71.G05.1.454.CMB.2.raw
  modified_base (245)..(245): a, c, t, g, unknown or other
  modified_base (334)..(334): a, c, t, g, unknown or other
  modified_base (591)..(591): a, c, t, g, unknown or other
  modified_base (598)..(598): a, c, t, g, unknown or other
  modified_base (619)..(619): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgacaacgtccagccactaattctttaanactacgttacccaaactaatagtaaaactacttagcttaggtaccagcagagaccaggacagccctactaggctgctactatttaccgngggcctagtcccgtaacccggggagtccccgggggtcccctggaccgtatttccgagggtcggcgtaacgggtcgggtacgtcggggactaggtacttttcgaccttctaccaccatcagcgacgcctgaccaggctagaaagtgtgggggttacggacgttaagttttaattagttacgtactaaacttaaatttattatttactacgtttcggtaaggtacgttacggtaccgaagggtaaccgtagggttacgnttacgtnaagtaacgtatggttcgtcgngtaacc

SEQ ID NO: 429359 - DNA, 650 bp, Homo sapiens
  misc_feature: GZ8MTXP01BAX7M.19.71.G05.1.454.CMB.2.raw
  modified_base (237)..(237): a, c, t, g, unknown or other
  modified_base (334)..(334): a, c, t, g, unknown or other
  modified_base (347)..(347): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcggccaccatcaactgcaagtccagccacaatctttanacagttccaaacaatagaaaactacttagctggtaccagcagagacagacagcctctagctgctctattactggcatctaccggatccgggtccccngacgatcagtgcnggcggtctgggacagtatttcactctacaccgatcaacgcaacgtccctagaccgaacgggtactaacggaaagtggttacggggttacggttacgtttaaagtttttaatttaacgttacgtaaacctaaaacgttaaatttaacttttaagtttaacgtttaaccggtttcgggttaacgggttaacccggtttaaccggggaaaccggttaaacgggtaaaccggtaaaggggttggttaaacttaacgtaaccggtacggtaacggtaaacgttgggttacggtaacgttaacgaaccc

SEQ ID NO: 429360 - DNA, 683 bp, Homo sapiens
  misc_feature: GZ8MTXP01CNV30.19.71.G05.1.454.CMB.2.raw
  modified_base (240)..(240): a, c, t, g, unknown or other
  modified_base (322)..(322): a, c, t, g, unknown or other
  modified_base (462)..(462): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgagcgggccacatcaactgacaagtccagccactaatctttanactagttaccaaacaatagaaaaactacttagcttaggaaccagacagagaccaggacagcctcaggctgctctatttacgngggctagtccgtaaccccggggagttccccggggtccccctaggaccgtatttccgaggttcgggacgaacgggtcggggtacgtgggggaacctaggtactttccaacttcctacaacccatcaaggccaacgtcccgngacgaggactaggaaagtgttaggggtacgggttactttaagtttagttaattacgtaaactaaattaaatttaacgtttaattaacgttaccgtttcgggtaacgggttaacccggttaccggggtaaacccggttaaacggggtaaaccgtaagggttacgttaacgttaacgtaacgaaacgggtaacggtacggtcggttacggtcgttaacgaacc

SEQ ID NO: 429361 - DNA, 574 bp, Homo sapiens
  misc_feature: GZ8MTXP01DDKX1.19.71.G05.1.454.CMB.2.raw
  modified_base (240)..(240): a, c, t, g, unknown or other
  modified_base (252)..(252): a, c, t, g, unknown or other
  modified_base (285)..(285): a, c, t, g, unknown or other
  modified_base (316)..(316): a, c, t, g, unknown or other
  modified_base (359)..(359): a, c, t, g, unknown or other
  modified_base (373)..(373): a, c, t, g, unknown or other
  modified_base (408)..(408): a, c, t, g, unknown or other
  modified_base (411)..(411): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagacctccctggctgtgtctcgtgggcgagcgggccacatcaactgacaagtccagccactaattctttanacagttaccaanaatagaaaactactagcttaggaccagacaganaccagacagcctctagctgctctatttacgnggctagtccgtaacccgggatccccggggtccccaggaccgtnttccaggtcgggcngggcgggtctagggacagtactttcactctcacancancacgctgcgagacagaagtgtgggtagtacttagtttattatactaactaaataaattattaattactacgttcggtaacggtacgttacggaacggttaaacggtaacgtaaggttagttacttagtaacgaaagtaacgtaagtggttacgtcgttcgaac

SEQ ID NO: 429362 - DNA, 724 bp, Homo sapiens
  misc_feature: GZ8MTXP01DPX3U.19.71.G05.1.454.CMB.2.raw
  modified_base (152)..(152): a, c, t, g, unknown or other
  modified_base (652)..(652): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttctcttcttcctgccgtgctggcctcccanaaggtgtcctgtcacaagtacagctgcagcagtcaggtccaggactggtgaacgccctcgccacgaccctctcgcctcacctgtcgccagtccgtccggggacaggtacgtcgacgtagcgacgtaggttgttcgcgttcggacgtacggtcgggtacacgggcctacgtcccccgaggtacgggaaggtacgggttacgtagggtaggtgggaccggttaagggggaaacggtaactaagttaacgttaacgaacgttacgtaacccgaaacgtaccgggttaaaggtaaaactaactaaagttacgtacgacctaacctagttcgtagttagaaggtacgtacgtaacgtacgaaactaacgtacgaaacggtacaacaacgtaagtaaccgggaaactaacctcgttccctacccgtaggcctaacggtcctacgtacccgttaacgtcggttaccgtaacccggttccggtaaacgggtaccggttaacggggttnttaaacgtttaacgttaccggtaagggttaaaccggggaccgttaccggtaacccccttaaagttaacccgg

SEQ ID NO: 429363 - DNA, 557 bp, Homo sapiens
  misc_feature: GZ8MTXP01ELM5A.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccagtcgagaggtctagagtggcgtaggggaaggacagtatttcaaattcgtcccaaacacggtagggaaattaactaaaattatacgacacctattctgttagagtagtcgactagaacaatacaaacgtagaacgaacaatacgaaacgaacctagttcctcccgtagcagtcttcgacctgtcgttcgaccgttaccgaggtacgacgggttgttactaattacgtggtagggaacgacggtaaccccttaagtaacg

SEQ ID NO: 429364 - DNA, 533 bp, Homo sapiens
  misc_feature: GZ8MTXP01BB8LK.19.71.G05.1.454.CMB.2.raw
  modified_base (235)..(235): a, c, t, g, unknown or other
  modified_base (298)..(298): a, c, t, g, unknown or other
  modified_base (346)..(346): a, c, t, g, unknown or other
  modified_base (360)..(360): a, c, t, g, unknown or other
  modified_base (370)..(370): a, c, t, g, unknown or other
  modified_base (377)..(377): a, c, t, g, unknown or other
  modified_base (386)..(386): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtcagccacaatctttanacagttccaacaatgaaaactactagcttggtaccagcagagaccagacagctctagctgctnatttactggcatcgtaccggagtccgggtcccctgacgattcagtgcngcgggtctgggacngattcactcncaccatnagcacgccncgcgagcgagaagagtggtgtagtattagttattagtactaactaaattaattaattattacttcgtaacggtacgttacggtacgaacggaacgtaacggttagttagttagtaacagaacgaacgtagttacgtcgttcgtaacg

SEQ ID NO: 429365 - DNA, 660 bp, Homo sapiens
  misc_feature: GZ8MTXP01B8G4T.19.71.G05.1.454.CMB.2.raw
  modified_base (248)..(248): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccggggccacgatacgaactgacaagtccagccacaattcttttaanactattaccaataatacaaactactagcttagaccagcaagacgaccaggacacgcctacgagctgctctatttacgcggactacgtaccgtaacccgggacgtcccggggtaccccctcggaccgtagttccgaggtcggacgcggcggggttacgtacggggactagtactttcactcctacacactcacgacgacgtccgtacgacgacggacgtagaagtagtacggggtacggtacgttaagtttaacgtttagttacgtaacgtaaacttaaacttaactttaatttaacgttacgttacggttaacggttacggttaccggtaaccggttaaacggtaacggtaacggttaggttacgttacgtaacgtaacgtaacgtacgtacggttacggtcgttcgtaacg

SEQ ID NO: 429366 - DNA, 639 bp, Homo sapiens
  misc_feature: GZ8MTXP01B5BVD.19.71.G05.1.454.CMB.2.raw
  modified_base (244)..(244): a, c, t, g, unknown or other
  modified_base (331)..(331): a, c, t, g, unknown or other
  modified_base (441)..(441): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagcgggccacgatacaactgacaagtccagccactaattctttanacagttaccaaataatagaaaactacttagcttaggaccagcagaacgaccaggacagccctaccgaggctgctactatttaccggnggactacgtccggtaaccgggtacgtcccgggtacccctacggacgtattcgaggtcggacgcgggtcgggtacgtagggaactagttacttccacctcctaccacctanacgacgacgacgcgacgacgagcgtagaagtagtaggggtacgtacgttaagtttattacgttacgtaactaaacgttaaatttattaattacgttacgttcggttaacggtaaccggttaccgggaaccgaaacgggtaaccgtaggttacgttacttacgtaacgaaggtaacgtacgtggttacggtcgttcgcc

SEQ ID NO: 429367 - DNA, 640 bp, Homo sapiens
  misc_feature: GZ8MTXP01ANIKT.19.71.G05.1.454.CMB.2.raw
  modified_base (582)..(582): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccagtccgtccggggacagagtcgctagcgacagtgttgcgttggcacgtgggtcaggcacgtccccagtcgagtaggtctaggagtggcgtaggggaagtactagttatttcaattcgtaaccaaacgtacgtaggaaactaactaaattatacgaccaacctaattcgttaggttagaaggtacgtacgtaactagaaacctaaataccgaaacgttacgaaccacgtaagtaccgaaacgtaaccctacgttccctacccgtagaccaacggtccttacggtaacccttcgtcggttaccggaacccgttacccgggaagggtaaccgttacggggttnttaacgttaagttaccgtaagggtaacgggaacggacccggtaaccccaagtaacccg

SEQ ID NO: 429368 - DNA, 610 bp, Homo sapiens
  misc_feature: GZ8MTXP01E1LJG.19.71.G05.1.454.CMB.2.raw
  modified_base (259)..(259): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgtgcttggcacgnggtcaggcagtccccatcgagaggtctaggagtggctggggaaggactatatttcaatgtaccaaacgacgtaggaaacttacgaaaatttatgaccaaccattctgttagagagtcgactgaacaatacaaacgtagaacacagtacgaaagtaacctagttcctccctgaccaacggtcctacggtaaccccttcgtcggttacgacccgttccccggaagggtaacccgtacgggggttataacgttaacgttaaccgtgggtacgggaaacgaccgggccccctaaagtaacgacttacttcggaacccctcgtccggttcctcgttgggtcgttaaccgtttaagg

SEQ ID NO: 429369 - DNA, 591 bp, Homo sapiens
  misc_feature: GZ8MTXP01A4B27.19.71.G05.1.454.CMB.2.raw
  modified_base (239)..(239): a, c, t, g, unknown or other
  modified_base (250)..(250): a, c, t, g, unknown or other
  modified_base (319)..(319): a, c, t, g, unknown or other
  modified_base (365)..(365): a, c, t, g, unknown or other
  modified_base (379)..(379): a, c, t, g, unknown or other
  modified_base (468)..(468): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccacgatacaactgacaagtccagccataattctttanacattaccaanaatagaaactctagcttagaccagcagacaccgaggacacgcctccgtaggctcgctacgtatttacgngggacagttccgtaacccggggatccccggggtccccaggaccgtnttccgagtcggacngggcgggtcgtagggactagtacttcactctcaaccatcagtcgacgccgtagcgaggctagaagtgtgggtgtattagttattagtanactaaataattattaattacttacgttcgggtaacggtacgttacgggaccgaaagggtaaccgtaagggttacgttattacgtaactaaggtaaccgtaagtcggttaggtccttgtaaccc

SEQ ID NO: 429370 - DNA, 616 bp, Homo sapiens
  misc_feature: GZ8MTXP01EXJZ7.19.71.G05.1.454.CMB.2.raw
  modified_base (229)..(229): a, c, t, g, unknown or other
  modified_base (239)..(239): a, c, t, g, unknown or other
  modified_base (319)..(319): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccgacggggacatcgtgatgacccagtctccagactccctggctgtgtctcgtggcgagcgggccaccatcaactgacaagtccagccanaattctttanacagttaccaaacaatagaaaactacttagctaggtaccagcagagaccaggacagcctctaggctgctactatttacgngggactacgtccgtaaccccggggaagtccccgggggtccctacggacccgtattccgaggtcggacaggccggggtctaggggacctaggtactttcacttcctacacctatcagcacgcctgcgaggactagaagtagtggtggggtacttaagttttaattagttagtaccaaattaaattaatttattaattacgttcggtacggtaacggtttccgggaccggtaaacgggaccgtaaagggtaggattagttacgaagacgtaacgtggtacggttcctggaacctaaccg

SEQ ID NO: 429371 - DNA, 598 bp, Homo sapiens
  misc_feature: GZ8MTXP01EDQLA.19.71.G05.1.454.CMB.2.raw
  modified_base (551)..(551): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctccacaaggtgtcctgtcacaagtacagctgcagcagtcaggtccaggactggtgaacgccctcgcacgaccctctcgctcacctgtcgccagtccgtccggggacagagtcgctagcgacagtgttgcgttggcacgtgggtcaggccacgtccccagtcggagtacggtctaggagtggcgtaggggaaggactattatttcaattcgtccaaacgtacggtaggaaataacgtaaattatcgacaccgtattcgtagttagagtagtcgactcgaacaactacgaaacgtagaacaacgtaagtaaccgaaacgtaacctacgttcctacccgtagccgaacgtccttacgaacccttgtacgttcggacccgttcccggaaggtaccgttacggggttnttacgttaattacgtggtacggaacgttaccggccccttaagtaacg

SEQ ID NO: 429372 - DNA, 602 bp, Homo sapiens
  misc_feature: GZ8MTXP01BLU4T.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtgccatcgtccggggacagagtcgctagcgacagtgttgcttggcacgtggtcaggcacgtccccatcgagaggtctaggagtggctaggggaaggactagtatttcaaatcgtccaaacgacgtaggaataacaaattatcgacacatctgttgagagtcgactgaacaatacgaaacgtaagaacgaacaacgtacgaaacgtaaaccgtaacgttccttaccccgtagaccgtaacggccttacggaacccttcgtacggttcggaacccgttcccggtaacgggaaccggttaccggggttagttaccgttaagttaaccgtcggttagggtaacgggaccgggtaacccccgaataaaccgg

SEQ ID NO: 429373 - DNA, 529 bp, Homo sapiens
  misc_feature: GZ8MTXP01D6FV3.19.71.G05.1.454.CMB.2.raw
  modified_base (331)..(331): a, c, t, g, unknown or other
  modified_base (419)..(419): a, c, t, g, unknown or other
  modified_base (435)..(435): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactggtgaacgccctcgcagacccctctcgctcacctgtgccatcgtccggggacagagtcgctagcgacagtgttgcttggcacgtgggtcaggcagtccccatcgagaggtctaggagtggctaggggaaggacattatttcatgtaccaaanacgtagaaactacaaattatgacaaaccatctgttagagtacgtcgactgaacaatacaaacgtagacacatacgaagaacctagtcnccctgcagctgacctntagtcgactcccgaggactacgggtatatattacgtgtggaacgacggccccaatacgacattcgcctacctcgtctcgttggtcgttcgtaag

SEQ ID NO: 429374 - DNA, 524 bp, Homo sapiens
  misc_feature: GZ8MTXP01EBDFQ.19.71.G05.1.454.CMB.2.raw
  modified_base (228)..(228): a, c, t, g, unknown or other
  modified_base (237)..(237): a, c, t, g, unknown or other
  modified_base (315)..(315): a, c, t, g, unknown or other
  modified_base (356)..(356): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgcaagtccagccanaatctttanacagttacaacaatagaaactacttagcttaggtaccagacagagaccaggacagcctctaggctgctactattacgnggcagtccgacccggatccgggtcccctgacgatcagtgcnggcggtctgggacagtattcactctcacatcagcagcctgcaggcgagagagtggtgtgtagtttattattgtactaataattattaattattacttcgtgtacgttcggtacgttaacggaacgaaggttaggagttataagagaagacgtagttgtcgttcgtaac

SEQ ID NO: 429375 - DNA, 572 bp, Homo sapiens
  misc_feature: GZ8MTXP01CWTEH.19.71.G05.1.454.CMB.2.raw
  modified_base (320)..(320): a, c, t, g, unknown or other
  modified_base (338)..(338): a, c, t, g, unknown or other
  modified_base (489)..(489): a, c, t, g, unknown or other
  modified_base (526)..(526): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcagtccccatcgagaggtctagagtggctgggagacatatttcatgtccaancgtaggaactacaaattntgcaaccatctgttgagtagtcgactgaacaatcaaacgtagacaacatacgaaacgtaaccagttcctccctagccaacggctacggacccttcgtacggtcgaacccgtcccggaaggaaccgacggggttagttaagtactttaacgnggttaacgggaaagaccgggccccaaagttacgaccngttccgaaccctaccgttcgtcttcgttcgggttcttcgtttaagg

SEQ ID NO: 429376 - DNA, 567 bp, Homo sapiens
  misc_feature: GZ8MTXP01BRVXH.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaagccctcgcacgacccctctcgctcacctgtgccatctccggggacagagtcgctagcgacagtgttgcttggcacgtgggtcaggcagtccccatcgagaggtctagagtggcgtggggaaggactatatttcaacttgtcaaacacgtaggaatacaaattatgcaccatcgtgtgagtagtcgtactagacatacaacgtaagacacgataccgaaagaaccctaagttctcccgtgactcggtaaacctcgaccctcgttgttcgtacccgttcccggaaagggaccgttaacgggggttcttaagttaacgtttaacgtcggttagggaacggttaccggcccccttaaagtaaccg

SEQ ID NO: 429377 - DNA, 509 bp, Homo sapiens
  misc_feature: GZ8MTXP01BQ6QR.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagcgctagcgacagtgttgcttggcactgggtcaggcagtccccatcgagaggtctagagtggctggggaaggacatatttcaatgtccaaacacgtggaatacaaattatgacacatctgttgagagtcgatgacaatacaacgtagacacataccgaagaaccagttcctcctgctagctcgacctctgttcgacttcccgaggtaccacgggttgttataattactggtggaacgttacggccccaagtaacg

SEQ ID NO: 429378 - DNA, 505 bp, Homo sapiens
  misc_feature: GZ8MTXP01BZ1MT.19.71.G05.1.454.CMB.2.raw
  modified_base (350)..(350): a, c, t, g, unknown or other
  modified_base (447)..(447): a, c, t, g, unknown or other
  modified_base (472)..(472): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagacccctctcgctcacctgtcgccatcgtccggggacagagtcgctagcgacagtgttgcttggcacgtggtcaggcacgtccccatcgagaggtctaggagtggcgtggggaaggacatattcaatcgtccaanacgtagaatacaaattatgacacatctgttgagagtcgactgaacaatacaagtagacacatacgaaagaacctagttcctcctgcagctcgacctntgttgaccttccgaggcacgggttnttataattacgtgtaggacgcgcccaagtaacg

SEQ ID NO: 429379 - DNA, 629 bp, Homo sapiens
  misc_feature: GZ8MTXP01APO09.19.71.G05.1.454.CMB.2.raw
  modified_base (243)..(243): a, c, t, g, unknown or other
  modified_base (268)..(268): a, c, t, g, unknown or other
  modified_base (323)..(323): a, c, t, g, unknown or other
  modified_base (383)..(383): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccacatcaactgacaagtccagccacaattcttttaanactacgtaccaaacaatagaaactntagcttagacagacagacgacagacacgcctacgagctcgctactacgtttacgnggactacgtaccgtaacccgggtacgtcccggggtccccacgacgtatcgaggtcgacgnggtcgggtcgaggactagttacttacactcgtacacctactacgacgacgacgccgtaggaccgaggtacgtagtaagtagtaggggtacggtacgttagtttagtttagttagtaactaaactaaattaattaattaacttacgttcggtaacggtacggttacggtaaccggttaacggtaaccgtaacggttagttacgttacgtaacgtacgtaacgtacgtacgttacgtcgttcgtaacg

SEQ ID NO: 429380 - DNA, 649 bp, Homo sapiens
  misc_feature: GZ8MTXP01BRO3T.19.71.G05.1.454.CMB.2.raw
  modified_base (331)..(331): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactgggtgaacgccctcgcacgacccctctcgctcacctgtcgccagtccgtccggggacaggagtcgctagcgactagtgttgtcgttggcacgtgggtcaggcctacgtccccagtcggagtaggtctaggnggtggcgtagggaatgactattacttaacacgtcgacaacgtaggtaagtaataaactaattatacgactactagttcgttagtagaagtacgtacgtacgtaacgaactaacgtaacgtaaacgtaacgaaacgtaacgtaaacgtaacggtaaaaccgtaaccgttaccgttaccctaccgtacgtaccgtacgtaccggttaccttaaccgtcgttaccggaccggttaacccgaccgggtacggttacgggttacgggttatttaacgttacgttaaggttcgggaacggaacggaaccccggttaacctaacg

SEQ ID NO: 429381 - DNA, 622 bp, Homo sapiens
  misc_feature: GZ8MTXP01C2XFG.19.71.G05.1.454.CMB.2.raw
  modified_base (391)..(391): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagacctccctggctgtgtctcgtgggcgagcgggccacatcaactgacaagtccagccaacaattctttaatactagttaccaaacaaatagaaaactacttagcttaggtaccagacagaacgaccaggaccagcctaccgtaggctgctactatttacgtgggacagtccgtaacccggggatcccgggggtccccctaggacgtattccgaggtcggcnggcgggtctacggggactagtacttcactctacacatcagcagcctgcaggctagaagtagtgggtacggtacttaagtttattaagttacgtaacctaaattaaatttatttaatttactaacgtttcggtaagggtaccgtttccgggaaaccgaaacgggtaccgtaagggttcggttaattacgtaaccgaaggtaaccgtaaggtggttacgtaacgttcgaaccc

SEQ ID NO: 429382 - DNA, 541 bp, Homo sapiens
  misc_feature: GZ8MTXP01AQRJK.19.71.G05.1.454.CMB.2.raw
  modified_base (330)..(330): a, c, t, g, unknown or other
  modified_base (507)..(507): a, c, t, g, unknown or other
  modified_base (531)..(531): a, c, t, g, unknown or other
  modified_base (536)..(541): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccgggggtccctgaccgattcagtggcagcgggtctgggacagatttcactctcaccatcagcagcctgcaggctgaagntgtggcctagtttattattgtacaaaactaattaatttattaatactttcgtagggtacgtttcggacccgaaagggacctaaagggttggaatagtccaaggacgaaacttggtggctggactaccagttctgtcttcattccttccccgctactctgactacgagaacgttacgnggcggcggcgtggcgacggcgaanagtgnnnnnn

SEQ ID NO: 429383 - DNA, 674 bp, Homo sapiens
  misc_feature: GZ8MTXP01B9IE0.19.71.G05.1.454.CMB.2.raw
  modified_base (244)..(244): a, c, t, g, unknown or other
  modified_base (339)..(339): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgagcgggccaccatcaactgacaagtccagccactaattctttanactagttaccaaactaatagaaaactacttagcttaggtaccagacaagacgaccgaaggacacgccctacgtaggctcgctactacgtttacgnggactacgttacccgtacccggggaacttcccgggggtaccccctcggaccgtattacgaggtcgggacgtaagggccggggtacgtacggggactaggtactttccaacgtcctacacctatcgaagcacgtccctagaccgaggctagaagtgtggggtacggtactttaagtttattagttacgtaacctaaattaaattatttaagttaacttacggttacggtaacggttaaccggtttccgggaaacccgttaaagggaaccgtaaggggttagttattaacgtaaccggaaggtaaccgtaacgtggttacggtccttcggtaacccc

SEQ ID NO: 429384 - DNA, 695 bp, Homo sapiens
  misc_feature: GZ8MTXP01EPBM9.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatccgtccggggacagagtcgctagcgacagtgttgcttggcacgtgggtcaggcacgtccccagtcggagacggtctaggagtgggacgtaggggaaaggtactattaacgttttcagttcgtacccgaaacgtacggtaggtaaaacttaaccgtaaaatttagtacgaccctaaaccctagttccgttaggtttaggaggtacggttaccgaacgttagaaacctaaacttacgaaacgtagaacaacaacgtaaccgaaacgtaaacctacgttcctaccccgtgacacggtcctacgtaccttcgtacgtacgtacccgtcccgggtaaggtaaccggtacgggttattaacgttacttacgtaaggttaacgggaaacggtacccggttacccctaaagttaacgaaccgttcttacccggtaaccctaccgttcgttcccgttacggttcggggtaacttaacgtttaaggg

SEQ ID NO: 429385 - DNA, 580 bp, Homo sapiens
  misc_feature: GZ8MTXP01A2VQ1.19.71.G05.1.454.CMB.2.raw
  modified_base (540)..(540): a, c, t, g, unknown or other
  modified_base (574)..(574): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccagtccgtccgggggacaggagtcgctaggcgactaggtgttgcgttggcacgtggtcaggcacgtccccatcgagaggtctaggagtggcgtaggggaaggtacgtattatttcaattcgtaaccaaacgtacgtaggaaataacgtaaattatacgactaccctattcgttagttagagtacgtcgtactagaactaactacaaacgtacgaacacgaacgtacgaaacggtaacctacgttcctaccctagcctagcttacgacctctgcgtaccttcccggaggtacgttacggttnttataagttagtggtacggacgttcgaaccccgngtaacg

SEQ ID NO: 429386 - DNA, 614 bp, Homo sapiens
  misc_feature: GZ8MTXP01BHQWI.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaacgccctcgcacgaccctctcgctcacctgtcgccatcgtccggggacagacgtcgctagcgacagtgttgcgttggcacgtgggtcaggccacgtccccagtcgagaggtcagagtggcgtagggaaggtatattattcaaatcgtaaccaaagtaacggtagaaaactaactaaaagttctacacctactagttcgtagtagagtacgtacgactacgaactaactacgtaaacgtacgaactaagtaacgtaacgaaacgtaaccgttacgttcctaccgtacgactacgaccgttacgtaccttcgtacgttaccgtacccgttaccggaaggtaccggttacgggttactttacgtaacgttacggaacggtaacgggaaccggacccgtcccgttaagtaacg

SEQ ID NO: 429387 - DNA, 578 bp, Homo sapiens
  misc_feature: GZ8MTXP01ECZ2I.19.71.G05.1.454.CMB.2.raw
  modified_base (243)..(243): a, c, t, g, unknown or other
  modified_base (253)..(253): a, c, t, g, unknown or other
  modified_base (264)..(264): a, c, t, g, unknown or other
  modified_base (317)..(317): a, c, t, g, unknown or other
  modified_base (361)..(361): a, c, t, g, unknown or other
  modified_base (408)..(408): a, c, t, g, unknown or other
  modified_base (412)..(412): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagacctccctggctgtgtctcgtgggcgagcgggccacgatacgaactgacaagtccagccataattctttaanactatacaanaatacaaactntagctagacagacagacgacagacacgcctacgtagctgctactagtttacgnggactacgtaccgtaaccgggtacgtcccgggtccctcgacgtntcgaggtcgacgtgggcggtcgaggactagtacttcactctacacanacanactacgcacgacgacgacgagagtagtgggtgtagttagttattattagtactaataattaattattattacgtcgtaacggtacggttacggtacggaacggtaacggtaaggttagttagttacgtaacgtacgtaacgtacgtaggttacgtcgttcgtaacg

SEQ ID NO: 429388 - DNA, 564 bp, Homo sapiens
  misc_feature: GZ8MTXP01EDJ3X.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatcgtccggggacagagcgctagcgacaggtgttgcttggcacgtggtcaggcacgtccccagtcgagaggtctagagtggcgtaggggaaggactagtatttcaattcgtaacccaaagtacggttaggaaattaactaaattatagaccactatcgtagttagaagtagtacgtactagaacaaatacgaaacgtacgaacgtaactaacgtacgaaaacgacctacgttcctcccgtagtcagctcgacctctcgcgaccgttccgaggtacgttacgggttcttataattacgtggtaggacgaccggcccgaagtaacg

SEQ ID NO: 429389 - DNA, 586 bp, Homo sapiens
  misc_feature: GZ8MTXP01EF4GD.19.71.G05.1.454.CMB.2.raw
  modified_base (243)..(243): a, c, t, g, unknown or other
  modified_base (327)..(327): a, c, t, g, unknown or other
  modified_base (357)..(357): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccacgatacaactgacaagtccagccactaattctttanacagttaccaaactaatagaaaactacttagcttaggtaccagacagacgaccaggacagcctcctaggctgctctatttacgnggcagtccgaccgggatcccggggtccccnggaccgattcgaggtcggcaagggtcgggtctaggggactagtacttcactctacacatcacgcacgcctgcgagacgtagaagtagtggggtaggtattaagtttattagttcgtaactaaataaatttattaatttattaccgttcggtaacggttaacggttccggaaccgttaagggaaccgaaggttcgaattatcgaagtaacgtatggttagtcttcgaacc

SEQ ID NO: 429390 - DNA, 661 bp, Homo sapiens
  misc_feature: GZ8MTXP01A4C0G.19.71.G05.1.454.CMB.2.raw
  modified_base (236)..(236): a, c, t, g, unknown or other
  modified_base (322)..(322): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtggcgagcggccacatcaactgacaagtccagccacaatctttanacagttaccaacaatagaaaactacttagcttaggtaccagcagacgaccaggacagccctaccgtaggctgctactagtttacgngggacacgtccgtaaccccggggaagtccccgggggtccccctacggtaccgattccgaaggttcgggactaaggggccggggttcgtacggggaacaggtactttccgaactcctaccaacctactcgacgactacgccctggaccgtaggggactaggaaacgtagtcggggtagggtacttaaggttttattagttcgtaacctaaataattatttaacttaagttaccgttcggtaaggttacccgttacgggaacccgttaaacgggggtaaaccgtaagggttacgaattacgaacgaacggtaacgtaacgtggttccggaattcgaacccg

SEQ ID NO: 429391 - DNA, 626 bp, Homo sapiens
  misc_feature: GZ8MTXP01CQMRY.19.71.G05.1.454.CMB.2.raw
  modified_base (216)..(216): a, c, t, g, unknown or other
  modified_base (234)..(234): a, c, t, g, unknown or other
  modified_base (245)..(245): a, c, t, g, unknown or other
  modified_base (303)..(303): a, c, t, g, unknown or other
  modified_base (316)..(316): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgaccagtctccagactcctggctgtgtctcgtgggcgagccgggcacgactacgactnacaagcagcacatcttanacagttccaanatagaaactcttagcttaggaccagcagagaccaggtcaacgtcctaccgtaggctcnctacgtattacgnggactacgtaccgtaaccggacgtcccggtacccctacggacgtagtacgaggtacggacgtcggtcgggtacgtagggactagtacttcactctacactactcgacgacgacgtcgtacgacgacgacgtacgtaagtagtacgggtacgtacgttacgtttacgttacgttacgtaacgtaacgtaattaattaacttacgttacgttcggtaacggtacggttacggtacggttaacggtaaacggtaacggttacgttacgttacgtaacgtaacgtaacgtacgtacgttacgtcgttcgtaacg

SEQ ID NO: 429392 - DNA, 612 bp, Homo sapiens
  misc_feature: GZ8MTXP01E0K7N.19.71.G05.1.454.CMB.2.raw
  modified_base (231)..(231): a, c, t, g, unknown or other
  modified_base (240)..(240): a, c, t, g, unknown or other
  modified_base (244)..(244): a, c, t, g, unknown or other
  modified_base (301)..(301): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctgctgtgtctctggcgaggcggcacagtcactgcagtccagccacatctttanacatacaanatanaaactctagctgacagcagacgacagacacgtcctcgtaggctgctactatttacgnggctacgtaccgtacccgggtacgtcccggggtcccctaggaccgtatcgagtacggcgcggtcgggtcgtacgggacgtagtacttactacctctaccaccactacgacgacgacgaccgtacgacgacggtacgtagtagtagtacgggtcgtacgttacgtttagttacgttacgtactaaactaaattaattaattaacttacgttacggtaacggtacggttaccggtaccggaacggtaaccggtaacggttacggttacgttacgtaacgacgtaacgtacgtacgttcggtaacgttcgtccg

SEQ ID NO: 429393 - DNA, 561 bp, Homo sapiens
  misc_feature: GZ8MTXP01ETEY7.19.71.G05.1.454.CMB.2.raw
  modified_base (243)..(243): a, c, t, g, unknown or other
  modified_base (288)..(288): a, c, t, g, unknown or other
  modified_base (323)..(323): a, c, t, g, unknown or other
  modified_base (357)..(357): a, c, t, g, unknown or other
  modified_base (375)..(375): a, c, t, g, unknown or other
  modified_base (383)..(383): a, c, t, g, unknown or other
  modified_base (426)..(426): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagccgggccaccatcaactgcaagtccagccataattctttaanacagttaccaaacaatagaaaactactagcttaggaccagcaganaccgaggacagccctctaggctgctatatttacgngggccatccgaacccggggatcccggggtccccnggaccgattccaggtgcnggcgggtnggggactagtattcactctcaccatcagcacgcctgacacggntaggaaagtgtaggggtggtattagtttaattattgtacaaataattattattattacgttggtggtaacgttcggaccgaaagggtactaagggttggattagtaacgagaacgaacgtgacggtcttgaaccc

SEQ ID NO: 429394 - DNA, 570 bp, Homo sapiens
  misc_feature: GZ8MTXP01ENE3S.19.71.G05.1.454.CMB.2.raw
  modified_base (521)..(521): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttctcctgccgtgctgggcctcccacaaggtgtcctgtcacaagtacagctgcagcagtcaggtccaggactggtgaacgccctcgcacgacccctctcgctcacctgtgccatccgtccggggacagagtcgctagcgactagtgttgcttggcacgtgggtcaggcacgtccccatccgagaggtctagaggtggcgtggggaaggactagttatttcaattcgtcccaaacgtacggtaggaaattaactaaattatacgacacatcgtagttagagtagtacgactagaacaatacaaacgtacgacgactaagtacgaaacgaacctagttcctcctagctacgctcgacctctcgttacgaccgttcccggaggtaccgttacggttnttacgttaagttacgtggtacggaacgaccgtaaccccgttaagtaacg

SEQ ID NO: 429395 - DNA, 626 bp, Homo sapiens
  misc_feature: GZ8MTXP01AGFXC.19.71.G05.1.454.CMB.2.raw
  modified_base (324)..(324): a, c, t, g, unknown or other
  modified_base (577)..(577): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgaccctctcgctcacctgtcgccagtccgtaccggggacagagtcgctagcgacagttgtgcttggctacgtggtcacggcacgtccccagtcgagtaggtctaggngtggcgtagggaaggactagttacttcaattacgtaaccaaacgtacggtaggaaataacgtaaattacgtacgactacctaattcgtagttaggagtaacgtcgactagaacaaagttcaaacgtacgaacctacgaacgtaacgaaaccgtaacctacggttacctcccgttagaccgtacggtaccgtacgtaaccccgttgtcggttaccggaacccgttacccggaaaggtacccggttacggggttnttactaacgttaccggtggtaacggacggaccggtccccttaagtaacg

SEQ ID NO: 429396 - DNA, 654 bp, Homo sapiens
  misc_feature: GZ8MTXP01DSLCW.19.71.G05.1.454.CMB.2.raw
  modified_base (608)..(608): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtcgaacgccctcgcacgaccctctcgctcacctgtcgccatcgtccgggacagagtcgctagcgactggtgttgcttggctacgtggtcacggcacgtccccagtcggagtacggtcgtaggaggtggcgtaggggaacggtactattacttcaagttacgtaacccgaaacgtacggttaaggaaaacttaactaaatttacgtacgacctaacctagtttcgtaggtttaggaaggtacgttaccgaacgttacgaacctaaacttaccgaaaacgggttaacgaaccgtaaacgtaacgttaaaccgaaacggtaaacccttccgtttaccctacccgttaggacctacgtcctacgtacccttgtcggttacgacccgttaccggaaggacgttacgggttnttaacttgttacgtggtaacggacgttaccgccccttaagtaaccg

SEQ ID NO: 429397 - DNA, 667 bp, Homo sapiens
  misc_feature: GZ8MTXP01BM1RW.19.71.G05.1.454.CMB.2.raw
  modified_base (241)..(241): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgacaagtccagccactaatctttanacagttaccaacaatagaaaactacttagcttggtaccagacagagaccaggacagcctccgtaggctgctctagtttacgtggcacgttccgaacccgggacgtcccgggggtccccctggaccgattccgaggttcgggacgcgggcgggtacgtacggggacaaggttactttaccactacctacaacctactcgaacggccaacggtccctgccgaaggcgtagaaagtgtggggtggtacttaagttttattagttcgtaacctaaattaaattatttaattaacgttacgttacgggttcgggtaaaccgtttcggggaaccccgttaaagggggtaaccctaaagggggttacggttaatttacggaaccgtaagggtaaccgtaaaccggtcgggttaggccgttaacggtaaccccg

SEQ ID NO: 429398 - DNA, 563 bp, Homo sapiens
  misc_feature: GZ8MTXP01BCACI.19.71.G05.1.454.CMB.2.raw
  modified_base (453)..(453): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatcgtccggggacagacgtcgctagcgacagtgttgcttggcacgtggggtcaggcacgtccccagtcgagaggtctagagtggcgtagggaagacattattcatacgtaccaacacgtaggaaatactaaattatacgacaccgtatctgtagagtagtacgactacgaacaatacaacggtaacaacaacactacgaaacgaactaacgtccncccgtgaccacgtactcgtacctgtcgtacgaccgtaccggaggtaccggtacgggttagttagttacgttaacgtgtaacgggacgaccggaccccaagttaacgaacg

SEQ ID NO: 429399 - DNA, 544 bp, Homo sapiens
  misc_feature: GZ8MTXP01CUM3A.19.71.G05.1.454.CMB.2.raw
  modified_base (226)..(226): a, c, t, g, unknown or other
  modified_base (235)..(235): a, c, t, g, unknown or other
  modified_base (310)..(310): a, c, t, g, unknown or other
  modified_base (378)..(378): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatctttanacagttccaaacaatgaaaactacttagctggtaccagcagagaccaggacagcctcctaggctgctcatttacngggcatctacccggaatccggggtcctcgaccgatcagtggcagcgggtctgggacagatttcactcncacatcagcagcctgcaggctagaagatcgtggggctagtttattattgtacaactaataattattatacttcgtggtaacgttcggacctaacggggaaccgtaagggtaggttattacgttaccgaaggtacgtaaccgtggttacggcgttcggcctaacccg

SEQ ID NO: 429400 - DNA, 521 bp, Homo sapiens
  misc_feature: GZ8MTXP01B307N.19.71.G05.1.454.CMB.2.raw
  modified_base (237)..(237): a, c, t, g, unknown or other
  modified_base (356)..(356): a, c, t, g, unknown or other
  modified_base (411)..(411): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctctaggctgctcatttactggcatctacccgggatccggggtcccctggaccattcagtcggcnggcgggtctgggacagtatttcactctcaccatcagcagccctgcaggctgaagntgggtggctagtttattatgtacaataatattattatacttcgtgggtacttggacccaaagggaccaagggttggattagtcagaacgtaactgttacggtcttgaacc

SEQ ID NO: 429401 - DNA, 626 bp, Homo sapiens
  misc_feature: GZ8MTXP01CE7T3.19.71.G05.1.454.CMB.2.raw
  modified_base (286)..(286): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatccgtccggggacagagtcgctagcgacagtgttgcgttggcacgtgggtcaggcacgtcccatcgagnggtctagagtggcgtagggaagacattatttcatcgtaccaaacgacgtaggaaactacgaaattgtagacaaaccctaattcgtagttagaagtagtaccgactagaaactaatacgaaacgtagacaacaagtacgaaacgaacctacgttacctaccgtagctacgccgtacggtaacccttcgtacggtccgaccgtacccggaggtaaccgtacgggttagttaagttacgttaacgttggttaacgggaacggtaaccggacccccgtaaagttaacgacttacgttacggaacccctaccgttccgttcttccggttggtcgttcgttaacgg

SEQ ID NO: 429402 - DNA, 678 bp, Homo sapiens
  misc_feature: GZ8MTXP01DFNM4.19.71.G05.1.454.CMB.2.raw
  modified_base (248)..(248): a, c, t, g, unknown or other
  modified_base (263)..(263): a, c, t, g, unknown or other
  modified_base (332)..(332): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctccctggctgtgtctcgtgggcgagccggccacatacaactgacaacgtccagccaactaattctttaanactacgttaccaaanaatagaaaactctagcttaggaccagacagacgaccaggacacgcctcgaggctgctactagtttacgnggactacgttaccgtaacccgggacgttcccggggtcccccaggtaacctagtttccgaggttcgggacgtaacgggtccggggtcgtaggggaacctaggttaacctttccaacccttcctaccaaccctatacccgaagcccaacggtcccgtagaccgagggtacctaaggaacgtagttggggtacggttaactttaaagttttagtaattacgtaaactaaattaaattatttaagttacttacggttggtaacggttaaccgttcgggaaaccgaaagggtaaccgtaagggttagacttacgtaagaacgtaacgtaaggtgttacggccttcgtaacc

SEQ ID NO: 429403 - DNA, 579 bp, Homo sapiens
  misc_feature: GZ8MTXP01DGPDG.19.71.G05.1.454.CMB.2.raw
  modified_base (250)..(250): a, c, t, g, unknown or other
  modified_base (265)..(265): a, c, t, g, unknown or other
  modified_base (297)..(297): a, c, t, g, unknown or other
  modified_base (308)..(308): a, c, t, g, unknown or other
  modified_base (314)..(314): a, c, t, g, unknown or other
  modified_base (326)..(326): a, c, t, g, unknown or other
  modified_base (377)..(377): a, c, t, g, unknown or other
  modified_base (421)..(421): a, c, t, g, unknown or other
  modified_base (424)..(424): a, c, t, g, unknown or other
  modified_base (430)..(430): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtggggcgaggccgggccacgatacaactgactaagtccaagccaacaattctttaanactagttacccaaanaatagaaaactctaagcttaggaccagcaganacagacagccnctagcngctcatttacgnggactagtcgtaaccgggatcccggggccccctgaccgattccgagtcggncggcgggtctaggggacagtctttcactctacactgacagcacncgngcgagngagagagtagggtgtagtagttattatatataataattaattaattattacgttcggttaacggtacggttacggtacgaaacggtaacggtaacggttagttagttacgtaacgtaagtaacgtacgtacgttacgtcgttcgtaacg

SEQ ID NO: 429404 - DNA, 552 bp, Homo sapiens
  misc_feature: GZ8MTXP01A5SK2.19.71.G05.1.454.CMB.2.raw
  modified_base (239)..(239): a, c, t, g, unknown or other
  modified_base (314)..(314): a, c, t, g, unknown or other
  modified_base (360)..(360): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaattctttanacagttccaacaatagaaaactactagcttggtaccagcagagaccaggacagccctctaggctgctcatttacngggacatccgtaccccgggaatccccccgggggtccctggacccgnttcgaaggtggcgaggcggggtctggggacagtatttcactctacaccatcagcagcctgcaggctagaagagtgtaggtctaggtttattattgtacaaataattattattactacttcggtggttacgttcggacgtaaacggggaacaagggttggattaagtcgaagacgaacgttggtaacggctcg

SEQ ID NO: 429405 - DNA, 543 bp, Homo sapiens
  misc_feature: GZ8MTXP01D8EPX.19.71.G05.1.454.CMB.2.raw
  modified_base (240)..(240): a, c, t, g, unknown or other
  modified_base (319)..(319): a, c, t, g, unknown or other
  modified_base (350)..(350): a, c, t, g, unknown or other
  modified_base (394)..(394): a, c, t, g, unknown or other
  modified_base (416)..(416): a, c, t, g, unknown or other
  modified_base (431)..(431): a, c, t, g, unknown or other
  modified_base (513)..(513): a, c, t, g, unknown or other
  modified_base (517)..(517): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagcgggccacatcaactgcaagtccagccacaattctttanacacttaccaaacaatagaaaactacttagcttaggaccagacagagaccaggacagcctctaggctgctctatttacnggctatccgtaccggggatccggggtccccngaccgattcaggtcgctggcgggtctagggacagtattcactcncacatcagcacgcctagcagcngaagtgtgggtggtnttaagtttatattgtactaaataaattatttaattacttacgttgtaaggtacgttcggaccgttaagggacgaaggttagnttangtaagaacgacgtgacggtcttcgcc

SEQ ID NO: 429406 - DNA, 565 bp, Homo sapiens
  misc_feature: GZ8MTXP01DSHW6.19.71.G05.1.454.CMB.2.raw
  modified_base (464)..(464): a, c, t, g, unknown or other
tcagtactctcgtgcacgaccggtgctcgatttagtgtcgtcgcaagagagaggggggcagagtctgctgaattctggctgaccagggcagtcaccagagctccagaaaatgtctgtctccttcctcttcttcctgcccgtgctgggcctcccacaaggtgtcctgtcacaagtacagctgcagcagtcaggtccaggactggtgaagccctcgcacgaccctctcgctcacctgtgcccatcgtccggggacagagtcgctagcgacagtgtgcttggcacgtgggtcaggcacgtccccatcgagaggtctagagtggcgtagggaagactattagtttcagtcgtaccaacgacgtacggaaattaacaaattatacgacacctatctagttgagtagtacgactagaacaatacaacgtaagaacaacaatacgaaacgtaacctagttcctccctgacncgtctcgtacctgtaagtcgaccgtaccgaggtaacgtacgggttagttaattacgttaacgtaggtaacggaacgaccggacccctaagttaacgaaccg

SEQ ID NO: 429407 - DNA, 679 bp, Homo sapiens
  misc_feature: GZ8MTXP01DV3N0.19.71.G05.1.454.CMB.2.raw
  modified_base (609)..(609): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaacgccctcgcagaccctctcgctcacctgtcgccatccgtccggggacagagtcgctagcgactagtgttgcttggcacgtgggtcacgggcacgtccccagtcgagtaggtctaggagtggcgtagggaaggtactattactttcaattcgtaaccaaacgtacggtaggaaactacgtaaattactcgacctacctattcgttaggttagaaggtacgttacgtacgttagaactaaacttacgaaacgtacgaaacgtaacgtaacgttaaccggaaaacgtaaacccgtacggtttaccctaccccgttaggacctacgggtacccttacggtaaccccgttgtttacgggttcgtaaccccggttcccgggaaacggggtccgttaaaccgggggtttnttaaacgttaacgtttaaccgttcggggttaacggaacgggaccccggtaacccccgttaagttaaccgg

SEQ ID NO: 429408 - DNA, 672 bp, Homo sapiens
  misc_feature: GZ8MTXP01DA57D.19.71.G05.1.454.CMB.2.raw
  modified_base (250)..(250): a, c, t, g, unknown or other
  modified_base (261)..(261): a, c, t, g, unknown or other
  modified_base (330)..(330): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctcctggctgtgtctcgtgggcgaggccgggccacgatacgaactcgacaacgtcagccacaaattctttaanactactacaanaatactaaactctagctagacagacagacaccgagacacgtcctacgagctcgtactactagtttacgnggactacgtaccggtaacccgggacgttcccgggtacccctagacgtatcgaggtcggacgtcgggtcgggtacgtacgggaactagttactttccaccgttactaccaaccgatacgacgacgacgtacgtacgacgacgacgtaagtaacgtagtacggggtacggttaacgttaagtttaacgtttaagttaacgtaactaaattaaattaactttaatttaacgttacgttacggttaacgggttaacggttacggtaacggttaaacggtaaacggtaacggttacggttacgttacgtaagtaacgtaacgtacgtacgttacgtcgttcgtaacg

SEQ ID NO: 429409 - DNA, 611 bp, Homo sapiens
  misc_feature: GZ8MTXP01ERP28.19.71.G05.1.454.CMB.2.raw
  modified_base (239)..(239): a, c, t, g, unknown or other
  modified_base (321)..(321): a, c, t, g, unknown or other
  modified_base (394)..(394): a, c, t, g, unknown or other
  modified_base (594)..(594): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaatgcaagtccagccacaattctttanacagttaccaacaaatagaaaactacttaagcttaggtaccagacagagaccaggacagcctctaggctgctacatttacgngggacagtccgtaacccggggaagttcccgggggtaccccctggaccgtattcgaggtgggctcggcgggtcnggggacaggtatttcactctacacatcagcacgcctagcagggctagaaagcgttggggtcggtacgttaagttttattagttacgtaactaaactaattaatttaatttactaacgtttcggtaacgggtacgtttaccggacccgttaaagggtaaccgtagttacgggttattacgtcaaggtaaccgtaacgtggnggtaaccttcggaaccc

SEQ ID NO: 429410 - DNA, 667 bp, Homo sapiens
  misc_feature: GZ8MTXP01D6YKO.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactggtgaacgccctcgcagacccctctcgctcacctgtcgccatcgtccggggacagagtcgctagcgacagtgttgcttggcacgtgggtcaggcacgtcccagtcgagaggtctaggagtggcgtaggggaagactagttatttcagttcgtaccaaacgtacggtaggaaacttaacgtaaaatttacgtacgacctaaaccctattccgtaggtttacggaggtacgtaccgtaacgtagaaacctaatacgaaacgtagaacaacaagtaaccggaaacgtaaacctacgttaccctacccgtagacacgtcgttacgtacccttcgtacggtacgacccgtacccggaaggtaaccggtacggggttagttaacttacgttacgtaagggttacgggaaacggtacccggttaccccaaagtacgacgttacgttaccgtaaccctaccgttccgtccgtcgttcggtcgttaacgtttaacgg

SEQ ID NO: 429411 - DNA, 557 bp, Homo sapiens
  misc_feature: GZ8MTXP01B0EKL.19.71.G05.1.454.CMB.2.raw
  modified_base (238)..(238): a, c, t, g, unknown or other
  modified_base (318)..(318): a, c, t, g, unknown or other
  modified_base (354)..(354): a, c, t, g, unknown or other
  modified_base (363)..(363): a, c, t, g, unknown or other
  modified_base (425)..(425): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcggccaccatcaactgcaagtccagccacaatcttttanacagttaccaaacaatagaaaactacttagcttggtaccagcagagaccaggacagcctcctaggctgctctatttacgnggcatccgtacccgggatcccggggtcccctgacgnttcagtgcnggcgggtctgggactagtacttcactctacaccatcagcacgcctagccgaggctaggaagngttgggtgacttaagtttattagttgtacctaaataattaatttagttaacttacgttcggtggtacggttccggaccgttaaagggaccgtaagggttgattatcaaggaactaacgtgagtcgttgaacc

SEQ ID NO: 429412 - DNA, 594 bp, Homo sapiens
  misc_feature: GZ8MTXP01AYP3C.19.71.G05.1.454.CMB.2.raw
  modified_base (242)..(242): a, c, t, g, unknown or other
  modified_base (319)..(319): a, c, t, g, unknown or other
  modified_base (374)..(374): a, c, t, g, unknown or other
  modified_base (410)..(410): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccacgatcaactgacaagtccagccactaattctttanacagttaccaacaatacgaaaactctagcttggaccagcagagaccaggacagcctctaggctgctactatttacgngggacagttccgtaaccggacgtccggggtcccctggaccgtattcgaggtcgcnggtcgggtacgtgggactagtacttcactctcaccntacgagcacgtcctagcgtaggctaagagtagtggggtacggtattagtttaagttatcgtaactaaataattattagttaattacccgttggtaacggtaccgtttacgggaaaccgttaaggggtaacctaaggggttgttattacgaagaacgtaacgtacgtggttcggtcttaaggccg

SEQ ID NO: 429413 - DNA, 637 bp, Homo sapiens
  misc_feature: GZ8MTXP01AVTWZ.19.71.G05.1.454.CMB.2.raw
  modified_base (247)..(247): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtcgcccgacggggacatcgtgatcgacccagtctccagactccctggctgtgtctcgtgggcgagccgggccaccatcaactgacaagtccagaccaactaattcttttanacacgttaccaaacaatagaaaactacttagctagtaccagcagagaccaggacacgcctcgtaggctgctactatttacgtgggactagtccgtaacccgggtacgtccccgggggtccctacggaccgtattccgaggtcggcgagggcggggtcgtaggggactagtactttccactcctacaccatcgagccagcctgacgaggctagaagtgtaggtggggtacttaagttttatagtttacgaactaaattaattatttaactttattaccgttacgggttgggtaacccgtttacgggaaccggtaaacggggttaccgtaaaggggtacgttaagttacttaccgaaggtacgtaacgttggcggttctaacgccgtaaccg

SEQ ID NO: 429414 - DNA, 518 bp, Homo sapiens
  misc_feature: GZ8MTXP01CC2BT.19.71.G05.1.454.CMB.2.raw
  modified_base (371)..(371): a, c, t, g, unknown or other
  modified_base (454)..(454): a, c, t, g, unknown or other
  modified_base (464)..(464): a, c, t, g, unknown or other
  modified_base (489)..(489): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctaggcctcccacaaggtgtcctgtcacaagtacagctgcagcagtcaggtccaggactggtgaagccctgcagacccctctcgctcacctgtcgccatcctccgggggacagagtcgctagcgacagtgttgcttggcacgtgggtcaggcagtccccagtcgagaggtctagagtggctggggaaggacatattcaatgtccaaacgacgtaggaaatacaaagttntgacactatctgttagagtaagtcgaacttgaacaatacaacgtagacaactagtaccgaaagaacctagtcctccctgctancgtgaccctntgttcgaccttccgagcacgggttnttataatctgtgacgacgcccaagtaacg

SEQ ID NO: 429415 - DNA, 532 bp, Homo sapiens
  misc_feature: GZ8MTXP01CC22B.19.71.G05.1.454.CMB.2.raw
  modified_base (212)..(212): a, c, t, g, unknown or other
  modified_base (218)..(218): a, c, t, g, unknown or other
  modified_base (230)..(230): a, c, t, g, unknown or other
  modified_base (238)..(238): a, c, t, g, unknown or other
  modified_base (244)..(244): a, c, t, g, unknown or other
  modified_base (246)..(246): a, c, t, g, unknown or other
  modified_base (248)..(248): a, c, t, g, unknown or other
  modified_base (255)..(255): a, c, t, g, unknown or other
  modified_base (258)..(258): a, c, t, g, unknown or other
  modified_base (260)..(260): a, c, t, g, unknown or other
  modified_base (262)..(262): a, c, t, g, unknown or other
  modified_base (264)..(264): a, c, t, g, unknown or other
  modified_base (266)..(266): a, c, t, g, unknown or other
  modified_base (268)..(268): a, c, t, g, unknown or other
  modified_base (275)..(275): a, c, t, g, unknown or other
  modified_base (278)..(278): a, c, t, g, unknown or other
  modified_base (280)..(280): a, c, t, g, unknown or other
  modified_base (282)..(282): a, c, t, g, unknown or other
  modified_base (284)..(286): a, c, t, g, unknown or other
  modified_base (288)..(288): a, c, t, g, unknown or other
  modified_base (292)..(292): a, c, t, g, unknown or other
  modified_base (294)..(294): a, c, t, g, unknown or other
  modified_base (296)..(296): a, c, t, g, unknown or other
  modified_base (311)..(311): a, c, t, g, unknown or other
  modified_base (313)..(315): a, c, t, g, unknown or other
  modified_base (317)..(317): a, c, t, g, unknown or other
  modified_base (321)..(321): a, c, t, g, unknown or other
  modified_base (323)..(323): a, c, t, g, unknown or other
  modified_base (325)..(325): a, c, t, g, unknown or other
  modified_base (330)..(330): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgaggccgggcacganacgacngataagcagcanatcttaanatacanananaatatantananananananacgaganacncncngnnntntatngnanacgacgacgcgccanannngngcgngngngaganatatacactacacacacacagacacgcgacgacgacgacgagaagtagtagggtagtagttagttagttatagtaactaaataattaattaattacgttacgttacggtaacggtacggttacggtaacggaaacggtaaacggtaaggttagttagttacgtaacgtacgtaacgtacgtagttacgtaacgttcgtaacg

SEQ ID NO: 429416 - DNA, 612 bp, Homo sapiens
  misc_feature: GZ8MTXP01A999U.19.71.G05.1.454.CMB.2.raw
  modified_base (244)..(244): a, c, t, g, unknown or other
  modified_base (255)..(255): a, c, t, g, unknown or other
  modified_base (325)..(325): a, c, t, g, unknown or other
  modified_base (438)..(438): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccacatcgaactgacaagtccagccactaattctttaanactataccaanaataactaaactctagctacgacagacagacgacgagacacgcctacgtagctcgcttactagtttacgnggactacgttaccggtaacccggggtacgttccccggggtacccctacggtaccgtagtcgaggtcggacgtcgggtcgggtcgtagggaactagttacttcactcacacacncgacgcgacgtctagacgagctagagtgtggggtacgtattaagtttatagtacgtaactaaattaattattaattacgttacgttcggtaaggtacgttacggaacgttaaacgggtaacgtaggttagttacttacgtaagacgtaacgtacgtggttacgtcgttcgaacc

SEQ ID NO: 429417 - DNA, 631 bp, Homo sapiens
  misc_feature: GZ8MTXP01DOL12.19.71.G05.1.454.CMB.2.raw
  modified_base (243)..(243): a, c, t, g, unknown or other
  modified_base (328)..(328): a, c, t, g, unknown or other
  modified_base (460)..(460): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctcagactccctggctgtgtctcgtgggcgagcgggccacatcaactgacaacgtccagccaactaattcttttanactagttaccaaacatagaaaactcttagcttaggtaccagacagacgaccaggacacgcctacgtaggctgctactatttacgnggctagtccgtaaccggggacgtcccggggtacccctcggaaccgtatccgaggtcgggacaacgggtccgggtacgtacggggaactacgtacgtttccaacttctaccaccctagtcaacgcacggtccngacgagacgtaagagtagtggggtacgtacttagtttattataacgtaactaaagttaattaatttagttaacgttacgttcggtaacgggttaccgttacgggaaccggttaaaggtaacgtaaggttagttattacgtaacgagtaacgtagtgttacgtcgttaacgc

SEQ ID NO: 429418 - DNA, 539 bp, Homo sapiens
  misc_feature: GZ8MTXP01AQH4W.19.71.G05.1.454.CMB.2.raw
  modified_base (243)..(243): a, c, t, g, unknown or other
  modified_base (311)..(311): a, c, t, g, unknown or other
  modified_base (319)..(319): a, c, t, g, unknown or other
  modified_base (413)..(413): a, c, t, g, unknown or other
  modified_base (421)..(421): a, c, t, g, unknown or other
  modified_base (431)..(431): a, c, t, g, unknown or other
  modified_base (434)..(434): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccgatcgaactgacaagtccagccaataatcttttanacagttccaaacaatagaaaactactagcttggtaccagcagagaccaggacagcctctaggctgctnatttacgnggcatcgtaccggatcccccgggcctgaccgatcaagtgcaggcgggtctgggacagtacttcactctcacatcagcagcctgcagctagaagngtgtggtntagtttattnttnactaaataattattattatacttcggtaggttacgttcggacgaaacgggtaccgaaggttcggaattaacgtacgaacgtaacgtaacgttggtcggctaaccg

SEQ ID NO: 429419 - DNA, 766 bp, Homo sapiens
  misc_feature: GZ8MTXP01AEO64.19.71.G05.1.454.CMB.2.raw
  modified_base (245)..(245): a, c, t, g, unknown or other
  modified_base (328)..(328): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccggaccacatcaactgacaacgtccaaccactaattcttttaanactagttaccaaactaatacgaaaacttactagctggtaaccagacagacgaccaggacagcctcaggctgctctatttacgngggactagtccgtaacccgggatcccgggggtccctaggaccgtattccgaggtcggaactacgggccggggttctaggggacagttacttttccaaaccttcctaccaaccctacgtaccgacgacccaacggtccccgttacggaccgtaacggggtaccttaagggaaaacggtacgtttggggttacgggggtaaccctttttaaggggttttttaaactttaaggtttaacggttaaaccctaaaacgttaaactttttaaagttttaacttttaaacgtttaaccgggttttcgggtacggggttaaacccggttttcccgggaaacccgggtaaaacggggttaaacccgtaaaggggttacggttaagttacgttacgaaagggtaaccgtaaacggttgggtcgggttactccggttaaccctaacccg

SEQ ID NO: 429420 - DNA, 616 bp, Homo sapiens
  misc_feature: GZ8MTXP01C3E16.19.71.G05.1.454.CMB.2.raw
  modified_base (327)..(327): a, c, t, g, unknown or other
  modified_base (554)..(554): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgcccctgccacgacccctctcgctcacctgtcgccatccgtccggggacaggacgtcgctagcgactagtgttgcgttggcacgtggtcaggcacgtccccagtcggagaggtctaggngtggcgtagggaagactattatttcaaattcgtaaccgaaacgtacggtagaaactaactaaattatcgaccactattcgtgttacgaagtacgttcgatagaacaagtacaaagtacgacaactaataccggaaactaaccgtagttccctccgtagtcaccggtctacgtacccttcgtcggttacgtaccccgttaccggaagggttaaccgttacggggtttnttaacgttaacgtttacgtcgggttacgggaaccggttacccgggtaaccccttaagtaacg

SEQ ID NO: 429421 - DNA, 622 bp, Homo sapiens
  misc_feature: GZ8MTXP01BXZ92.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccatccgtccggggacaggacgtcgctagcgacgtagtgttgcgttggcacgtgggtcaggcacgtccccagtcgagagtcaggagtggcgtaggggaacgactagttactttacattacgtaccaacgacggtaggaaattaacgaaatttacgcgacactagtgttacccccgtgacgtagtacgtacgtagaacgaacttacaacgtaacgaacgaacaacgtaacgaaacgaaaccgtacgttacctcccgtcgaccgacgtccgtaccgtaccgtcgtaacgtaccgttaccgtacccggacggtaaccgtacgggttagttaacgttacgttaagtacgtaacgggtaacggaccgacccgtaacgttaacgtaaccg

SEQ ID NO: 429422 - DNA, 602 bp, Homo sapiens
  misc_feature: GZ8MTXP01ESMP4.19.71.G05.1.454.CMB.2.raw
  modified_base (239)..(239): a, c, t, g, unknown or other
  modified_base (317)..(317): a, c, t, g, unknown or other
  modified_base (358)..(358): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgaccaagtctccagactccctggctgtgtctcgtgggcgagcgggccaccatcaactgcaagtccagccacaattctttanacagttccaaacaatagaaaactactagcttaggaccagcagacaccaggacagcctctaggctgctctatttaccgnggcatccgtacccgggaactcccggggtccccctggaccgnttcgaggtcggcgaaggtcgggtcgtaggggaccaggtactttcactcctacaccctatccagctacgccctgcgaggctaggaaagtgtggggtcggtacttaaggttttattagttcgtacctaaattaattattaacttattaacgttcggtaagggtaacgttcggaccggttaaagggaccgtaaggttgggattacgtcgaacggtaaccgtaacgtgggttacggtcttcggaaccc

SEQ ID NO: 429423 - DNA, 589 bp, Homo sapiens
  misc_feature: GZ8MTXP01CU5LV.19.71.G05.1.454.CMB.2.raw
  modified_base (179)..(179): a, c, t, g, unknown or other
  modified_base (240)..(240): a, c, t, g, unknown or other
  modified_base (253)..(253): a, c, t, g, unknown or other
  modified_base (321)..(321): a, c, t, g, unknown or other
  modified_base (385)..(385): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacttccnggctgtgtctcgtgggcgagcgggccacatcaactgacaagtccagccactaattctttanacagttaccaaanaatagaaaactctagctaggtaccagcagagaccaggacagccctcctaggctagctactatttacgngggacatccgtaacccggggattccccgggggtaccccctggaccgtattccgaggtcggacgngggccgggttctggggaaccaggtactttcactctcacctatcagctagccctgccaggctaggaaagtgtgggtggtacttaagttttatattcgaactaataattattaattactacgtttggtaacggtacgttcggaaccgaagggtacctaagggttagacttagtccgaagtaaccgtaagtggacgtcgttgaaccc

SEQ ID NO: 429424 - DNA, 587 bp, Homo sapiens
  misc_feature: GZ8MTXP01BQGQG.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctggcctcccacaaggtgtcctgtcacaagtacagctgcagcagtcaggtccaggactggtgaacgccctcgcacgaccctctcgctcactgtcgccagtccgtccgggacagacgcgctagcgacagtgttgcttggcacgtggtcaggcacgtccccagtcgagtcggtctagagtggcgtaggggaaggactattacttcaagtcgtaaccaaacgtacggtaggaaactaactaaattacgtacgacactatcgtgttagagtacgtacgactacgaactaatacgaaacgtacgacaactaacgtaccgaaacgtaacctacgttcctcccgtagacctacgtcctcgaccttctcgttcgtaccgttaccgaacggacgttagggttacttagttaagttacgtaaggtacggacgaccggtaaccccttaagtaaccg

SEQ ID NO: 429425 - DNA, 715 bp, Homo sapiens
  misc_feature: GZ8MTXP01AMU8M.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcacgtccccatcgagaggtctaggagtggcgtaggggaagactattatttcatcgtaccaaacgacggtaggaaactaactaaatttagtcgacctaaaccctattccgttaggtttacggaaggtacggtaccgtaacgttagaaacctaaacgtaccgtaaaacggttaacggaaacctaaccgtaaacgttaaaccgggaaaacgtaaaccccgttaacggtttaccccttaccccgttacgaccgtaacggtaccggttacggtacccgttccgttacggtaccggtacccgttaccccggaacgggtaccggtacggggttagttaacgttaacgttaacggtggtaacgggaaacggtacccggacccccgtaagtaacgacttcgttaccgtaaccctacccgttcgttccgttacgttcgggtaacgttcgttaacgg

SEQ ID NO: 429426 - DNA, 586 bp, Homo sapiens
  misc_feature: GZ8MTXP01EM41S.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccatcgtccggggacagagtcgctagcgacagtgttgcttggcacgtggtcaggcacgtccccagtcgagagtctagagtggctagggaagacatattcaatcgtccaaacgtacgtaggaaataacgtaaattatgacactatcgtgttgagtagtcgactagaacaatacgaaacgtagacgaactaatacgaaacgaacctagttcctacccgtagtaccacggtcctacggaaccttcgtcggttacgtacccgttacccgggaaggtaaccgttaacggggttcttaagtttaacgttacgtaaggttacgggaaacggaccgggtaacccccgttaagtaaccg

SEQ ID NO: 429427 - DNA, 633 bp, Homo sapiens
  misc_feature: GZ8MTXP01A28PO.19.71.G05.1.454.CMB.2.raw
  modified_base (244)..(244): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatgacccagtctccagactccctggctgtgtctcgtgggcgagccgggccacgatacaactgacaagtccagccataattctttanacattccaataatacgaaaactcttaagcttaggaccagcagagaccaggacagcctcgagctgctctaatttcgcggcacgttaccgacccgggagttccccggggtacccctagaccgtattaccggaggtacggcgcgggtcgggtacgtacgggactagttacttaccactccaccacactacgacgacgacgacgtcgacgacgacgtagtaagtagtacgggtacggttacgttaagtttagttagttacgtaactaaacttaaattaattaattacgttacgttacggtaacgtacggttacggtaaccggaacggtaacggtaacggttacgttacgttacgtaacgacgtaacgtacgtacgttacgtcgttcgtaaccg

SEQ ID NO: 429428 - DNA, 626 bp, Homo sapiens
  misc_feature: GZ8MTXP01ELP7O.19.71.G05.1.454.CMB.2.raw
  modified_base (351)..(351): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccatcgagaggtctagaggtggcgtagggggaagactatatttcatcgtaccaacgacgtagaaactacaaattangacaaccattctgtgagtagtacgactgaacatacgaacgtagacacagtaacgaaacgtaaacctgttacctcccgtagacacgtctcgtacccttcgtacggtcgtacccgtcccggaagggtaacccggtacgggggtttataacgtttaacgtttacgtaacgggtaacggttaacgggacccgttaaccccgtaagtaaccgacgttacgttaccggtcccctacccgttccggttcttcgggttacggttcgttaaccgtttaacgggg

SEQ ID NO: 429429 - DNA, 578 bp, Homo sapiens
  misc_feature: GZ8MTXP01ANEGA.19.71.G05.1.454.CMB.2.raw
  modified_base (393)..(393): a, c, t, g, unknown or other
  modified_base (524)..(524): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccagggactggtgaacgccctcgcacgaccctctcgctcacctgtcgccatccgtccggggacaggacgtcgctagcgacagtgttgcgttggcacgtcgggtcaggcacgtccccagtcgaggtaggtctaggagtcggcgtaggggaaggactagttacttcaattcgtccaaacgacggtagaataacgtaaattancgacactattcgtgttagagacgtcgatacgactaatacgaaacgtagacacagtacgaaacgtaacctgttcctccctgcctagctacgccttgtcgttcgaccgttcccggagggtacccgaggggttnttaacttaacgttacgtcgggtaacgggaccggttaccgtccccgaagtaaccg

SEQ ID NO: 429430 - DNA, 653 bp, Homo sapiens
  misc_feature: GZ8MTXP01CULGK.19.71.G05.1.454.CMB.2.raw
  modified_base (354)..(354): a, c, t, g, unknown or other
  modified_base (364)..(364): a, c, t, g, unknown or other
tcagtactctcgtgcacgaccggtgctcgatttagtgtcgtcgcaagagagagggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatccgtccggggacagacgtcgctagcgacagtgtgcgttggctacgtgggtcacggcacgtcccagtccgagtaggtctaggagtggcgtagggaagactatattcatgtagacaacgacgtagaataactaattanacgaacactntcgtgtagagacgtacgactagactaatacgaacgtagacaacgacgtaacgaaacgtaaccgtacgttcctaccctagactacggtaccttacggtacccttacgtacggtaccgttaaccccgtacccgggtaaacggtaccggtaacggggtttacgttaacgttaacgtttaacggttacgggttaacggggtaaaccgcccggggtaaaccccctaagttaacccgacttacggtcccgacccgtaacccgtttcgtaccgttcggttcggttaacgttaacgg

SEQ ID NO: 429431 - DNA, 588 bp, Homo sapiens
  misc_feature: GZ8MTXP01AEGF1.19.71.G05.1.454.CMB.2.raw
  modified_base (383)..(383): a, c, t, g, unknown or other
  modified_base (481)..(481): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatccgtccggggacagagtcgctagcgacagtgttgcttggcacgtggggtcaggcagtccccatcgagaggtctagagtggcgtagggaacgactatatttcatacgtacccaacgtacggtaggaaattaacgtaaatttacncgacctactattacgtggttagagtagtacgactacgaacaacgtacaaacggtacaacaacgtaacgtaacggaaaccgtaaccctacgtttccccnccgtacgactacgtctacgtcctcgtcgtaccgaccgtaccggacggtacgtacggttagttacgttacgtaacggtggaacggacgacccgaccctaagaacgtcg

SEQ ID NO: 429432 - DNA, 621 bp, Homo sapiens
  misc_feature: GZ8MTXP01DI86E.19.71.G05.1.454.CMB.2.raw
  modified_base (240)..(240): a, c, t, g, unknown or other
  modified_base (250)..(250): a, c, t, g, unknown or other
  modified_base (254)..(254): a, c, t, g, unknown or other
  modified_base (260)..(260): a, c, t, g, unknown or other
  modified_base (309)..(309): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgaccagtctccagactcctggctgtgtctcgtgggcgagcgggccacgatacgaactgacaagtccagcacaattctttaanactatacaanatanaaactntagctagacagcagacacagacacgtcctcagctgctactagtttacgngactacgtaccgtaccggtacgtccgggtcccacgacgtatcgaggtcgcgcgggtcgggtacgacgggactacgtacttcactcacacactcacgacgacgacgtacgacgacgtacgtagtaagtagtaggggtacggtacgttaacgtttaagtttaacgttacgtaactaaacttaaattaaatttaatttaacgttacgttacggttaacggtacggttacggtaaccggaaacgggtaacggtaacggttaggttacgttacgtaacgaacgtaacgtacgtacgttacgtaacgttaacgtaacg

SEQ ID NO: 429433 - DNA, 626 bp, Homo sapiens
  misc_feature: GZ8MTXP01CMX75.19.71.G05.1.454.CMB.2.raw
  modified_base (385)..(385): a, c, t, g, unknown or other
  modified_base (421)..(422): a, c, t, g, unknown or other
  modified_base (434)..(434): a, c, t, g, unknown or other
  modified_base (453)..(453): a, c, t, g, unknown or other
  modified_base (507)..(507): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctcctggctgtgtctcgtgggcgagcggccacatcaactgacaagtccgacacaactattacttacactactaacaaataataactaaactactagtcgtacgacagacgagacacgaacgacgaccgtcctacgtagtctcgtactacttagttacggacgactacgtaccggtaaccggtacggtcccggtccgtacgacgtctacgnggacgacgcggtcgtgagactagtctcactcacacnncgacacgcgtcngacgacgtgaaagacgttntcggggggtacttaacgttttagttactagttaccaaacttaaatttaagtttntttaaacgttcgtaaccggttggtaaccgggttaacaccggggtaacgaaaccgggttaacgtgggttaattaacgttacgaacgaacggtaacgtcggtgttacgtaacgcgtaaccc

SEQ ID NO: 429434 - DNA, 714 bp, Homo sapiens
  misc_feature: GZ8MTXP01BIEJM.19.71.G05.1.454.CMB.2.raw
tcagtactctcgtgcacgaccggtgctcgatttagtgtcgtcgcaagagagagggggggtacaacaggcaggcatgggcagcaagatggtgttgcagacccaggtcttcatttctctgttgctctggatctctggtgcccacggggacatcgtgatgacccagtctccagacctccctggctgtgtctcgtgggcgagccgggccaccatcaactgcaagtccagccactaattcttttatactacgttaccaaactaatagtaaaactacttagcttaggtaacccagacaagacgacccgaaggacacgccctccgtaggctgtctactacttttaccgtgggacctacgttacccgtaacccggggtaacgttcccccgggggtacccccctaggacccgtagtttcccgacgggttccgggccgtaacggggtcccggggttaccgtagggggtaaccctagggttaccttttaccgaaaccttccctaccgaacccctagtccgaaggtacccaacgtcccgtagcccgaagggtcctaaggaaagtgtggggttacggtacgttaagtttattagttcgaacctaaataaatttatttaagttacttaccgtttcggcggttaacggtttaccgggaacggttaaacggggaaccgtaagggttaggattacgtaaccgagaacgtactggttcggaactttcgaacc

SEQ ID NO: 429435 - DNA, 527 bp, Homo sapiens
  misc_feature: GZ8MTXP01DQ56J.19.71.G05.1.454.CMB.2.raw
  modified_base (231)..(231): a, c, t, g, unknown or other
  modified_base (240)..(240): a, c, t, g, unknown or other
  modified_base (252)..(252): a, c, t, g, unknown or other
  modified_base (315)..(315): a, c, t, g, unknown or other
  modified_base (365)..(365): a, c, t, g, unknown or other
  modified_base (401)..(401): a, c, t, g, unknown or other
  modified_base (501)..(501): a, c, t, g, unknown or other
  modified_base (505)..(505): a, c, t, g, unknown or other
  modified_base (508)..(508): a, c, t, g, unknown or other
  modified_base (517)..(517): a, c, t, g, unknown or other
  modified_base (524)..(524): a, c, t, g, unknown or other
  modified_base (527)..(527): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagactccctggctgtgtctctggggcgagcgggccacgatacgaactgacaaatccagccanaatctttanacagttaccaanaatgaaaactactagcttggtaccagcagagaccagacagcctctaggctgactcatttacgnggcacgtccgtaccggacgtccgggtcccctagacgtatcgaggtcgcgngggtcggtacgagggactagtacttcactctacacntacgagcacgctgacagacgtagagagtgggtagtagttagttattattagtataataattattattatactgtgtcgttcgtacgacggacgagttagnttanaanagaacgagngttgtgngtn

SEQ ID NO: 429436 - DNA, 531 bp, Homo sapiens
  misc_feature: GZ8MTXP01AOCBJ.19.71.G05.1.454.CMB.2.raw
  modified_base (231)..(231): a, c, t, g, unknown or other
  modified_base (240)..(240): a, c, t, g, unknown or other
  modified_base (284)..(284): a, c, t, g, unknown or other
  modified_base (315)..(315): a, c, t, g, unknown or other
  modified_base (342)..(342): a, c, t, g, unknown or other
  modified_base (360)..(360): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccacgatcgaactgacaagtccagccanaatctttanacagttccaacatagaaaactcttagcttaggtaccagcaaganaccaggacagccctcaggctgctcatttacnggcatccgaccggatccggggtccccngaccgtatccgagtcgcnggcgggtctgggacagtactttcactctacacatcagcacgcctagcagctagaagagtgggtagctagtttatagttgtacaataatattattatacttgtaaggtcgttcggtacgaacggtaccgaaggttggattagtaacgagaacgaacgtgttaggcttaagcc

SEQ ID NO: 429437 - DNA, 621 bp, Homo sapiens
  misc_feature: GZ8MTXP01BUX3N.19.71.G05.1.454.CMB.2.raw
  modified_base (199)..(199): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctntcgctcacctgtgccatctccggggacagagtcgctagcgacagtgttgcttggcacgtgggtcaggcacgtccccagtcgagaggtctaggagtggcgtagggaagactatatttcatcgtaccaacgtacgtaggaaactaactaaattatacgctaaaccattcgtagttagagacgtacgatagaactaatacaaacgtagaaccactaagtacgaaacgtaacctacgttcctacccgtgacctaacgcgtacgtaccgtcgtagtacgtacccgtaccggaaggacccgtagggttataacttacgtttaccgaagggttacgggaaacgtacccggttacccctaaagtaccgaacgttccgttacgaaccccttcttccgttctacggttgggtttaaccaagttttaaccggg

SEQ ID NO: 429438 - DNA, 521 bp, Homo sapiens
  misc_feature: GZ8MTXP01B2FWP.19.71.G05.1.454.CMB.2.raw
  modified_base (365)..(365): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagccctctcgctcacctgtgccatcgtccggggacagagtcgctagcgacagtgttgcttggcactgggtcaggcagtccccatcgagaggtctagagtggctggggaaggacatatttcaatgtccaaacacgtaggaatacaaattangacacatctgttgagagtcgactgacaatacaacgtagacgacaagtacgaaacgaacctacgttcctaccctgcacgctcgacctctgttcgaccgttcccgacggacacgggttcttataattactggtaggacgacggtaaccccaagtaacg

SEQ ID NO: 429439 - DNA, 665 bp, Homo sapiens
  misc_feature: GZ8MTXP01DVZW9.19.71.G05.1.454.CMB.2.raw
  modified_base (243)..(243): a, c, t, g, unknown or other
  modified_base (254)..(254): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccacggggacatcgtgatcgacccagtctccagacctcctggctgtgtctctgggcgagcgggcacgatacgaactgacaagtccagccataattctttaanactactacaanaatagaaactctagctacgacagacagacacagacacgcctacgagctcgctactagtttacgcggtactacgttaccgtaaccgggacgttcccggggtacccctacggacgtacgttacggacggtacggaccgaacgggtacgggtacgggtacgggtacgtacgtacgttactacctacctacctaccactacgacgacgacgtaccgtacgacgacggtacgtagtaagtagtacggggtacggttacgttaagtttaattacgttacgtaactaaacttaaacttaatttaattaacgttacgttacgtaacggtacggttacggtaacggttaaacggtaacggtaaggttaggttacttacgtaacgtaacgtaacgtacgtacggttacgtcgttcgtaacg

SEQ ID NO: 429440 - DNA, 663 bp, Homo sapiens
  misc_feature: GZ8MTXP01CYRLY.19.71.G05.1.454.CMB.2.raw
  modified_base (248)..(248): a, c, t, g, unknown or other
  modified_base (314)..(314): a, c, t, g, unknown or other
  modified_base (324)..(324): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccgacggggacatcgtgatgacccagtctccagactccctggctgtgtctcgtggggcgagcgggccacgatacgactgactaagtccagccactaattcttttanacagttaccaacaatagaaaactctagcttagaccagcagacgacaggacagcctcgtagctgctntattttacgnggctacgtccgtaacccggggtacgttccccccgggggccctaggacccggtatttaccggagggtcggcgtacggggtccggggttacgtaggggactacggttactttacccgacttcctaccacctataccgacgtacgacgtaccgtcgacgacgtacgtacgtaaggtagggttggttacggttacgtttaagtttaagtttagttacgttaactaaacttaactttaatttaactttactttacgttcggttacggttacggttaccggttacggtaacggtaacgttaggttagttagtaatacgtaacgacgtacgttacgtcgttcgtcg

SEQ ID NO: 429441 - DNA, 631 bp, Homo sapiens
  misc_feature: GZ8MTXP01EMUZN.19.71.G05.1.454.CMB.2.raw
  modified_base (592)..(592): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaacgccctcgcacgaccctctcgctcacctgcgccatcgtccggggacagacgtcgctagcgacgagtgtgcttggctacgtcgggtcaggccacgtcccagtcggagacgtcgtagagtggcgtaggggaaacgtctattacttcagtacgaccaacgtacgtaggaaattaacaaatttagtacgacctactagtcgttaggtagaggtacgttacgaacttagaactaacttaccgaaacgttaacgacctaaacggaacgtttaaccggaaaacgtaacccgttaacggtttccctacccgtggacccagtccgtaacgtccgtctaacggtacgacccgtaccggttaggacgttaaccgggttgttaaacttacgtttaacggnggtaacggaacgccggttaacccctaaggttaacaaccg

SEQ ID NO: 429442 - DNA, 601 bp, Homo sapiens
  misc_feature: GZ8MTXP01BXF96.19.71.G05.1.454.CMB.2.raw
  modified_base (240)..(240): a, c, t, g, unknown or other
  modified_base (322)..(322): a, c, t, g, unknown or other
  modified_base (361)..(361): a, c, t, g, unknown or other
  modified_base (372)..(372): a, c, t, g, unknown or other
tcagtactctcgtgcacgaccggtgctcgatttagtgtcgtcgcaagagagaggggggaggtacaacaggcaggcaggggcagcaagatggtgttgcagaccccagttcttcatttctctgttgctctggatctctggtgcccacggggacatcgtgatgacccagtctccagacctccctggctgtgtctctgggcgagccggccaccatcaactgcaagtccagccacaattctttanacagttaccaacaatagaaaactacttagcttaggtaccagcagacgaccaggacagccctcctaggctgctctatttacgnggcatccgtacccgggatcccggggtcccctggaccgtntcgagtggcgnggcgggtcgtgggactagtactttcacctcctacacctatcgagcacgtccgtgccgaggctagaacgtgtggggtacgtcgttaagtttacttagttcgtaactaaattaatttaatttaattaacgttccgttggtaacggtaacggttcgggaccgttaaaggggaaccgtaagggttcgttaattactaacgaggtaaccgtaggtggttcggtcaacgtaaccc

SEQ ID NO: 429443 - DNA, 564 bp, Homo sapiens
  misc_feature: GZ8MTXP01BP1GS.19.71.G05.1.454.CMB.2.raw
  modified_base (239)..(239): a, c, t, g, unknown or other
  modified_base (315)..(315): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgacaagtccagccacaatctttanacagttaccaacaatgaaaactactagcttaggtaccagcagagaccaggacagcctctaggctgctcatttacgnggctacgtccgtaccggacgtcccgggtcccctaggacgtattcgaggtcggacgtgggcgggtcgtagggactagtacttcactctacacatacgagcgacgcctgcgaggctagaagtgtggggtcgtacgttagtttattatacgtaactaaattaattaattattacttacgttcggtaacggtacgttacggacgaaagggacgtaaggttgttattagcgagaacgtagtgttcgtcgttcgc

SEQ ID NO: 429444 - DNA, 630 bp, Homo sapiens
  misc_feature: GZ8MTXP01AKR6R.19.71.G05.1.454.CMB.2.raw
  modified_base (245)..(245): a, c, t, g, unknown or other
  modified_base (258)..(258): a, c, t, g, unknown or other
  modified_base (326)..(326): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgccccgacggggacatcgtgatgacccagtctccagacctccctggctgtgtctcgtgggcgagccgggccaccatcaactgacaagtccagccactaattctttanacagttaccaaanaatagaaaactctagcttaggtaccagcaagacgaccgagacagcctcgaggctgctactatttacgnggcacgtaccgtaaccccggggaactccccgggggtccccctaggaccgtagttccgaggtcgggcgtaagggtccggggtacgtaggggacctagtactttacgacctcctacaccatcgacgcacgacctgacgagggctaaggaagtgtggggtacgtacttaagttttatattagaccaaattaattatttaattagttaccgttcggtaacggtaaccgttcgggaaccgaaacgggtaaccgtaagggttgttattaacgtcgaagtaaccgtaacgtgggttacgtcttccggaacc

SEQ ID NO: 429445 - DNA, 643 bp, Homo sapiens
  misc_feature: GZ8MTXP01AMVBA.19.71.G05.1.454.CMB.2.raw
  modified_base (591)..(591): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccatccgtccggggacagacgtcgctagcgacagtgttgcttggcacgtgggtcaggcacgtccccagtcgaggaggtctaggaggtggacgtaggggaacggactagttatttcaaattcggtaacccaaacgtacggttagggaaactaactaaattatacgacctaacctagttcgttaggttaggaagtacggtacggaactggaaactaagtaccgaaacgttagaaccggtaactaagttaaccgaaacggtaaaccctacgttccctaccccgtagacctacggtacctacggtacccttcgtacggttaccgtacccgttccgggaaacggtacgttaacggttnttagttaacttagttaacggtggtacgggaacgaacccggttaacccctaag

SEQ ID NO: 429446 - DNA, 618 bp, Homo sapiens
  misc_feature: GZ8MTXP01E1BCR.19.71.G05.1.454.CMB.2.raw
  modified_base (205)..(205): a, c, t, g, unknown or other
  modified_base (554)..(554): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtnaagccctgcagaccctctcgctcacctgtcgccagtcgtccggggacagagtcgctagcgacagtgttgcttggcacgtggtcaggccacgtccccagtccggagtaggtcaggaggtggcgtaggggaaaggacagttattcaaattcgtcccgaaactacgggtaggaaattaacaaatttatacgctaaccattcgtgttagagtacgtcgactacgacaactacaaacgtacgaactaacgtaatacggaaacgtaaccctaacgttccctcccgttacggctacgtacgtacgtaccttcgtacgttacgaccgttacccggaacggtaacgttaccggggttnttaacgtttaacgttaccggttaaggtacggggaacggaccgggtaacccccttaagtaaccgg

SEQ ID NO: 429447 - DNA, 700 bp, Homo sapiens
  misc_feature: GZ8MTXP01ACOXO.19.71.G05.1.454.CMB.2.raw
  modified_base (245)..(245): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagactccctggctgtgtctcgtgggcgagccgggccacgatacaactgacaagtccagccaactaattcttttaanactacttaccaaataataacgtaaaacttacttagcttacggaccagacagacgacagacacgtcctacgtaggctgctactagtttacgcggactacgttaccggtaacccggggtacgtccccggggtacccctacggaccgttagttacgacggtacgggacgtcggggtccgggtacgtaggggaacctagttactttaccaaccttcctaccaacctatccgaacgccgaacgtcctacgacgacggtacgtaggtaacgtagtacggggtacggtacgttaagtttaacgttagttacgtaactaaacttaaatttaatttaatttaacgttacgttacggttaacggttaccggttaccgggtaaccggttaaacgggtaacggtaacggttacggttacgttacgtaacgtacgtaacgtaacgtacggttacggtcgttcgtaacg

SEQ ID NO: 429448 - DNA, 588 bp, Homo sapiens
  misc_feature: GZ8MTXP01APBWN.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtggtcaggcagtccccatcgagaggtctagagtggcgtagggaaggtacatatttcaaattcgtccaaacacggtaggaaactactaaattatacgacacctatctgtagagagtacgactagacaatacaacgtacgacgtaacaacgtacgaaacgtaaccctacgttcctacccgtacgcgacgtacctcgaacccttcgtgttaccggacccgttacccggaacgggtaaccgttaccggggttgttacgttaacgtttacgtggttacgggaacggaccggtaacccccgttaagtaaccg

SEQ ID NO: 429449 - DNA, 601 bp, Homo sapiens
  misc_feature: GZ8MTXP01BCW0D.19.71.G05.1.454.CMB.2.raw
  modified_base (240)..(240): a, c, t, g, unknown or other
  modified_base (257)..(257): a, c, t, g, unknown or other
  modified_base (276)..(276): a, c, t, g, unknown or other
  modified_base (318)..(318): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgagccgggccacgatcaactgacaagtccagccataattctttanacagttaccaacaatanaaactctagcttggacagnagacaccaggacacgcctacgtaggctagctactatttacgnggactacgttccgaaaccggggtacgtcccccgggggtccctacggtaccgtattccgaggtcggaccgaagggtcgggttcgagggacctagttacttcacttccacaccatcacgacacgcctgaccgaggctaggaagtgtgggtcggtattagtttaatagttaacgtaacttaaattaattactttagtacttacggtggtaacggtacggttaccgaacggaaacggtacgtaaggttagttacttagaacgagtaacgtagtcgacgtcgcgtaac

SEQ ID NO: 429450 - DNA, 580 bp, Homo sapiens
  misc_feature: GZ8MTXP01CVXY3.19.71.G05.1.454.CMB.2.raw
  modified_base (248)..(248): a, c, t, g, unknown or other
  modified_base (272)..(272): a, c, t, g, unknown or other
  modified_base (327)..(327): a, c, t, g, unknown or other
  modified_base (365)..(365): a, c, t, g, unknown or other
  modified_base (434)..(434): a, c, t, g, unknown or other
  modified_base (437)..(437): a, c, t, g, unknown or other
  modified_base (444)..(444): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagacctccctggctgtgtctcgtggggcgaggccgggccaccgatacgaactgacaagtccagccataattctttaanacagttccaacaatagaaaacttntagcttggtaccagacagagaccaggaccagccctccaggctgctacattttacngggctactaccgtaccgggtactccccccggggtaccngacccgtattccgaaaggtcggcagggccgggtctggggaccagttcttaccactctacacgatccganacncgtccgngacgagcgtagagaggtgtgtattagttattagtatactaataattattattactcgttcgtacggttacgtacggacgtaacggtaacgttaggttagttagtaatacgaacgacgtacgttacgtcgttcgtcg

SEQ ID NO: 429451 - DNA, 502 bp, Homo sapiens
  misc_feature: GZ8MTXP01EGSBP.19.71.G05.1.454.CMB.2.raw
  modified_base (339)..(339): a, c, t, g, unknown or other
  modified_base (389)..(389): a, c, t, g, unknown or other
  modified_base (405)..(405): a, c, t, g, unknown or other
  modified_base (420)..(420): a, c, t, g, unknown or other
  modified_base (469)..(469): a, c, t, g, unknown or other
  modified_base (493)..(493): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatctcggggacagagtcgctagcgacagtgttgcttggcactgggtcaggcagtcccatcgagagtctagagtggctagggaagcagtatttcatgtaccaaacacgtaggaaactacaaaattntgacaaacccatcgtgttgagagtcgactgggacaatcaaacgtagacanatacgaagaacagtcncctgcagctgacctntgtcgactcccgaggacacgggtgtatatcgtgtaggagacggccccanacgttacattcgccactcgtctcngtcgctaag

SEQ ID NO: 429452 - DNA, 519 bp, Homo sapiens
  misc_feature: GZ8MTXP01EG422.19.71.G05.1.454.CMB.2.raw
  modified_base (351)..(351): a, c, t, g, unknown or other
  modified_base (419)..(419): a, c, t, g, unknown or other
  modified_base (460)..(460): a, c, t, g, unknown or other
  modified_base (488)..(488): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatcgtccggggacagagtcgctagcgacagtgttgcttggcacgtgggtcaggcacgtccccagtcgagaggtctaggagtggcgtaggggaagactattatttcatgtaccaacacgtggaaactacaaattngaccaaaccatctgtagagtagtcgactgaacaatacaacgtagacacatacgaacgaacctagttcnccctgacacgctcgactctgtcgacctccgagacgacggtntatatctgtagagacgacccagtacgcnttcgcctactcgtactcgttgtcgcgttaag

SEQ ID NO: 429453 - DNA, 607 bp, Homo sapiens
  misc_feature: GZ8MTXP01DJK2V.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccatcgtccggggacagagtcgctagcgacagtgttgcttggcacgtggtcaggcagtccccatcgagaggtcagagtggctggaagacagtattcaatcgtccaaacacgtagaaatactaaagtatgacaccaatctgttgagagtcgactagacaatacaacgtagacaacaagtacgaaacgtaacctacgttcctacccgttaggcctacggtaccttaccggaaacccttccgttacggttacgggtaaccccgttaccccggaaacgggtaaccgttaaccgggggtttagttaaactttaacgttaaccgttaagggttaacggaaacgggttaccgggaaccccccttaaagttaaacccgg

SEQ ID NO: 429454 - DNA, 587 bp, Homo sapiens
  misc_feature: GZ8MTXP01D1U24.19.71.G05.1.454.CMB.2.raw
  modified_base (182)..(182): a, c, t, g, unknown or other
  modified_base (345)..(345): a, c, t, g, unknown or other
  modified_base (431)..(431): a, c, t, g, unknown or other
  modified_base (576)..(576): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtnaagccctgcagaccctctcgctcacctgtcgccagtcgtccggggacagagtcgctagcgacagtgttgcttggcactgggtcaggcagtccccatcgagtaggtctagagtggctagggaagactagtatttcatcgtaccaagacgtggaaatacaaattntgacaaccatcgtgttagacgtagtaccgagtagaacaatcgaaacgtacgacaacatacgaaagaactacgtctaccctgacgancgtacgacctcgtacgtcgaaccgtcccggaaggtaccgtaccgggggtataactaccgttagtaacggtaacgggaacgacccggttaccccaagtacgacgttacttccggaaccctaccgtcgttcctcgttggggttaacnccgtttaaggg

SEQ ID NO: 429455 - DNA, 513 bp, Homo sapiens
  misc_feature: GZ8MTXP01A86RQ.19.71.G05.1.454.CMB.2.raw
  modified_base (346)..(346): a, c, t, g, unknown or other
  modified_base (470)..(470): a, c, t, g, unknown or other
  modified_base (506)..(509): a, c, t, g, unknown or other
  modified_base (511)..(511): a, c, t, g, unknown or other
  modified_base (513)..(513): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctagaagatgtggctagtttattntgtcaaaataagtaattattatacgttcgtggtacgttcggacagggacaggtgatatcgagacgatgtgactgcactgtctgtcttcactcctccgctactcgtacgacagagtaacgtacgnggacggcgggtcgtcgggcgaggccgaatagtaagnnnngngn

SEQ ID NO: 429456 - DNA, 556 bp, Homo sapiens
  misc_feature: GZ8MTXP01DJJ1U.19.71.G05.1.454.CMB.2.raw
  modified_base (240)..(240): a, c, t, g, unknown or other
  modified_base (318)..(318): a, c, t, g, unknown or other
  modified_base (349)..(349): a, c, t, g, unknown or other
  modified_base (355)..(355): a, c, t, g, unknown or other
  modified_base (364)..(364): a, c, t, g, unknown or other
  modified_base (373)..(373): a, c, t, g, unknown or other
  modified_base (420)..(420): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgcaagtccagccacaattctttanacagttaccaaacaatagaaaactacttagcttggtaccagcagagaccaggacagcctctaggctgctctatttacnggcatccgtacccgggatcccggggtccccngaccgnttcagtgcnggcgggtcngggacagtattcactctcaccatcagcagcctgcaggctagaaagtntggggtgtcttagtttatattgtactaaataaattattattatacttcggtaaggtcgttacggaccgaaagggtaccgtaagggttaggttacttaagtccgaagtaacgtaacgtggttacggcttaacgaacc

SEQ ID NO: 429457 - DNA, 592 bp, Homo sapiens
  misc_feature: GZ8MTXP01DVEDU.19.71.G05.1.454.CMB.2.raw
  modified_base (432)..(432): a, c, t, g, unknown or other
  modified_base (459)..(459): a, c, t, g, unknown or other
  modified_base (497)..(497): a, c, t, g, unknown or other
  modified_base (547)..(547): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcagtccccatcgagaggtctaggacgtggcgtggggaaagacattatttacattgtaccaaacacgtaggaaactaacaaattatacgaccaaaccattcgtagttagagtacgtcgactagaacaatacgaaactagacacatacgaaacgaactacgttccncccgtgacacggtctacgtaaccgttntacggtcgaaccgtcccggaaggtaccgtacggggttntaattagttacgtaaggtcggaaacggccggacccctaagtacgaacttnttaccggaaccctaccgttcgtcctgttaggttcgcgtttaaggg

SEQ ID NO: 429458 - DNA, 602 bp, Homo sapiens
  misc_feature: GZ8MTXP01DF0KJ.19.71.G05.1.454.CMB.2.raw
  modified_base (318)..(318): a, c, t, g, unknown or other
  modified_base (393)..(393): a, c, t, g, unknown or other
  modified_base (550)..(550): a, c, t, g, unknown or other
tcagtactctcgtggcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccagtccgtccggggacaggacgtcgctagcgactagtgttgcttggcacgtggtcacggcacgtccccagtcgagnggtctagagtggcgtagggaagactattacttcaaagttcgtccaaacgtacggtaaggaaactaactaaaattntacgacctactattcgtaggtagagtagtacgtatagaaccaagtacaaagtacgactaactaagttaccgaaacgtacctacgttcccgtccgtagcctagtacctcgtacctcgtcgttaccgtacccgttaccgggaagtaacgttacgggttnttaacgttaagttaccgtggtacggaacgaccgtaaccccgttaagtaaccg

SEQ ID NO: 429459 - DNA, 577 bp, Homo sapiens
  misc_feature: GZ8MTXP01DJFVH.19.71.G05.1.454.CMB.2.raw
  modified_base (529)..(529): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgcccagtccgtccggggacaggagtcgctagcgacagtgttgcttggcacgtggtcaggcacgtccccagtcgagaggtctaggagtggcgtaggggaaggactattattcaatcgtccaaacacgtaggaaatactaaattatgacactatctgtgagagtcgactagaacaatacaaacgtacgaacaactaagtaacgaaacgaacctacgttcctacccgtagctaacggtcctacgtacccttcgtcggttccgacccgttacccggtaacgggacgttacggggttnttaacgttaattacgtggtacggaacgaccggtaaccccaagtaaccg

SEQ ID NO: 429460 - DNA, 548 bp, Homo sapiens
  misc_feature: GZ8MTXP01CPFOX.19.71.G05.1.454.CMB.2.raw
  modified_base (235)..(235): a, c, t, g, unknown or other
  modified_base (243)..(243): a, c, t, g, unknown or other
  modified_base (252)..(252): a, c, t, g, unknown or other
  modified_base (256)..(256): a, c, t, g, unknown or other
  modified_base (262)..(262): a, c, t, g, unknown or other
  modified_base (285)..(285): a, c, t, g, unknown or other
  modified_base (312)..(312): a, c, t, g, unknown or other
  modified_base (355)..(355): a, c, t, g, unknown or other
  modified_base (367)..(367): a, c, t, g, unknown or other
  modified_base (410)..(410): a, c, t, g, unknown or other
  modified_base (519)..(519): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgccccacggggacatcgtgatgacccagtctccagacctccctggctgtgtctcgtggggcaggccgggccacgatcgaactgacaagtccagccanatctttanacatacaanatanaaactntagctagacagcagacacagacngtcctacgtagctgctactatttacgnggacacgtaccgaaccgggacttccgggtccccctaggacgtnttcgaggtgcgnggcgggttcagggactagtacttcaccttctacacgtatcganacgacgcgtcgacgacgacgtagtagtagtagggtgtagttagttattattataataattattattatacgtcgtgtaacgtacgttacgacgacgtagtagttagttnttacgaagagtaacgtgtgctcgcgtaac

SEQ ID NO: 429461 - DNA, 641 bp, Homo sapiens
  misc_feature: GZ8MTXP01BVLBX.19.71.G05.1.454.CMB.2.raw
  modified_base (231)..(231): a, c, t, g, unknown or other
  modified_base (242)..(242): a, c, t, g, unknown or other
  modified_base (320)..(320): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatacgactgacaagtccagccanaattctttaanactactaccaataatagaaactatagctagacagacagacgaccagacacgcctacgtagctgactactacgtttcgnggctacgtaccgtaacccgggtacgtcccggggtaccccctaggacgtatcgaggtacgggcgtcgggtcgggtactagggaactagttacttaccacctctacacctactacgacgaccgacgtcctacgacgacgtacgtagtaagtagtacgggtacggtacgttaacgtttagttacttacgtaactaacttaaacttaattaactttaacttacgttacgttaacggtacggttacggtaccggttaacggtaacggtaacggttacgttacgttacgtaacgacgtaacgtacgtacgttacgtcgttcgtaacg

SEQ ID NO: 429462 - DNA, 569 bp, Homo sapiens
  misc_feature: GZ8MTXP01ETGRF.19.71.G05.1.454.CMB.2.raw
  modified_base (243)..(243): a, c, t, g, unknown or other
  modified_base (256)..(256): a, c, t, g, unknown or other
  modified_base (323)..(323): a, c, t, g, unknown or other
  modified_base (356)..(356): a, c, t, g, unknown or other
  modified_base (363)..(363): a, c, t, g, unknown or other
  modified_base (372)..(372): a, c, t, g, unknown or other
  modified_base (380)..(380): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagccgggccacgatcaactgacaagtccagccataattctttanacagttaccaaanaatagaaaactctagcttaggaccagcagacaccaggacacgcctactaggctgctactatttacgnggcagtccgtacccgggagtcccggggtccccnggacctntcaggtgcnggcgggtntagggactagtacttcactctacaccatcagcacgcctgcgaggctaggaaatgtggggtggtacttaagtttatagtcaactaaataatttattattaagtcgttggtaaggtacgttacggacgaaaggtaacgtaagggttgttattacgtaacgacggtaacgtaacgtggcggtcttcgaaccc

SEQ ID NO: 429463 - DNA, 549 bp, Homo sapiens
  misc_feature: GZ8MTXP01BK1XK.19.71.G05.1.454.CMB.2.raw
  modified_base (237)..(237): a, c, t, g, unknown or other
  modified_base (250)..(250): a, c, t, g, unknown or other
  modified_base (312)..(312): a, c, t, g, unknown or other
  modified_base (460)..(460): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgacaagtccagccacaattctttanacagttaccaaanaatagaaaactactagctggacagcagagaccaggacagcctctaggctgctctatttacgngggctacgtccgtacccgggaatcccggggtccctagacccgtatcgaggtcggacgagccggggtctggggacagtactttccactcctacaccagtcacgcacgtcctgcaggcagaagtgtgtaggggcttaagtttataagttnaactaataattatttatattacgttcggtggtaacgtcggacgaaggacgtaaggtgattagacgaagacgtaagtggtgctgcctaag

SEQ ID NO: 429464 - DNA, 618 bp, Homo sapiens
  misc_feature: GZ8MTXP01A2CNC.19.71.G05.1.454.CMB.2.raw
  modified_base (243)..(243): a, c, t, g, unknown or other
  modified_base (255)..(255): a, c, t, g, unknown or other
  modified_base (293)..(293): a, c, t, g, unknown or other
  modified_base (364)..(364): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccaggggacatcgtgatgacccagtctccagactccctggctgtgtctctgggcgagcgggccaccatcaactgacaagtccagccactaattcttttaanactactacaaanaatagaaactatagtcttagacagacagacgacagacncgcctcgagctgctactatttacgcggactacgtccggtaaccgggtacgtcccccgggtcctagaccgtntcgaggtcgcgacggtccgggtcgagggactagtacttccacttcaccacactacgacgacgacgtcgtcgacgacgacgtagtaagtacggtagtacgtacgttagtttatttacgttacgtaactaaactaattaattaacttacgttacgttaacggttacggttaccggttaccggttaccggtaacggtaacggttaacggttagttacgtaacgtacgaacgtacgtacgttacgtcggttcgtaacg

SEQ ID NO: 429465 - DNA, 569 bp, Homo sapiens
  misc_feature: GZ8MTXP01ALQKH.19.71.G05.1.454.CMB.2.raw
  modified_base (417)..(417): a, c, t, g, unknown or other
  modified_base (434)..(434): a, c, t, g, unknown or other
  modified_base (467)..(467): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgtgcttggcacgtggtcaggcacgtccccatcgagagtctagagtggctgggaagtacagtatttcatcgtaccaaacgacgtaggaaactacaaattagtgacaaacccattctgttagagtagtacgactagactatacaacgtagacacatacgaagacctgttaccncctgcagctcgtacctntcgtacgaccgtcccggaggtacgtacggggtnttaacttacgttacgtaaggtacgggaaacggacccggacccctaagtacggacttacgttcgtccctaccgtcggtctcggttcggtcgttccgttaaggg

SEQ ID NO: 429466 - DNA, 571 bp, Homo sapiens
  misc_feature: GZ8MTXP01EI84X.19.71.G05.1.454.CMB.2.raw
  modified_base (233)..(233): a, c, t, g, unknown or other
  modified_base (241)..(241): a, c, t, g, unknown or other
  modified_base (251)..(251): a, c, t, g, unknown or other
  modified_base (255)..(255): a, c, t, g, unknown or other
  modified_base (261)..(261): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccgacggggacatcgtgatgacccagtctccagactccctggctgtgtctcgtgggcgaggccgggccacgatacgaactgacaagtccagccanatctttanacactacaanatanaaactntagctagacagcagacgacgagacacgcctacgtagctcgcttatacgtttacgcggactacgtaccggtaacccgggacgtcccggggtcctaccgaccgtatcgaggtcggaacgacggtcgggtagtacgggatagttacttacacttccacactatcgagcgacgtacgcgacgacgacgtagaagtagtgtacgggtagttagtttattatatataataattattattattagtgtgtaacggtacggacgtaacggacggtagtagttagttagttacgaagacgtaagtgtgcgtcgcgtaac

SEQ ID NO: 429467 - DNA, 659 bp, Homo sapiens
  misc_feature: GZ8MTXP01A6I62.19.71.G05.1.454.CMB.2.raw
  modified_base (307)..(307): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttctcttcttcctgcccgtgctgggcctcccacaaggtgtcctgtcacaagtacagctgcagcagtcaggtccaggactggtgaacgccctcgcagacccctctcgctcacctgtcgccatcgtccggggacagagtcgctagcgacagtgttgcttggcacgtgggtcaggcagtccccagtcgagnggtctagagtggcgtagggaacgacattattcatacgtacccaagacgtagggaaactacgaaatttatacgaccaacctaattcgttaggttaggaagtaggttacgtaaccgttaggtaaccaaacgtaccgtaaacgttaagaaccaactaacgttaacgggaaaactaacccgtaacggtttaccctcccgttaggaccctaacggtccgttacggaacccttcgtaacggttacgacccggttaaccccggagggtaccggtaacggggtttacgttattaacggtttaaccgtgggttaacggggtaacggaccgggttaaccccccgaagttaacgggtaacccg

SEQ ID NO: 429468 - DNA, 641 bp, Homo sapiens
  misc_feature: GZ8MTXP01D90FT.19.71.G05.1.454.CMB.2.raw
  modified_base (336)..(336): a, c, t, g, unknown or other
  modified_base (448)..(448): a, c, t, g, unknown or other
  modified_base (460)..(460): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtagaacgccctcgcacgacccctctcgctcacctgtcgccagtccgtaccggggacaggacgtcgactagcgacgtaggttgttcggcttcggctacggtgggtcaggcacgtccccagtcgagtaggtcgtaggngtggcgtagggaacgactattattcattacgaaccaacgtaggtaagtaaataactaaaattagtacgacctaacgtattctaggttagaaggtagtaccgatagaactaanacaaacggtaanacctacgaagtacggaaactacccttaaggttccccacgtacgacgtcgtaccgtacctaacccgtggttaacgtacggttaacccgtacccggaagggtaaaccgtacggggtttattaagttacgttaaccgtagggtaacggaaaccggacccggttaccctaagttaacggtaaccg

SEQ ID NO: 429469 - DNA, 700 bp, Homo sapiens
  misc_feature: GZ8MTXP01E0SZ9.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactggtgaacgccctcgcacgaccctctcgctcacctgtcgcctagtccgtccggggacagacgtcgctagcgactagtgttgcgttggcacgtgggtcaggcacgtccccatcgagagtctaggagtggcgtaggggaagactattactttcagttcgtaccaaacgtacggtaggaaaactacgtaaaattgtacgacctaaaccattcgtaggttgaacggtagtccgtaactacgaaactaactacgaaacgtacgaacaacgtaataaccggaaaacgtaaccctacgtttaccctacccgtagaccaacgtcggtacgtaacccgttcgtacggttaccggaacccgttacccgggaacggtaacccggtagggggttacttaagttaacgttaaccgttgggtaacgggttaaacggaacccgggttaccccctaaagtaaccggaccgttaacgttcccgtaaccccgtacccgttcccggttccttcggttacggttccgttaacgtttaacggg

SEQ ID NO: 429470 - DNA, 607 bp, Homo sapiens
  misc_feature: GZ8MTXP01CTKUS.19.71.G05.1.454.CMB.2.raw
  modified_base (245)..(245): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacngtgttgcttggctacgtgggtcaggcacgtccccagtccggagaggtctaggaggtggcgtaggggaaggactattatttcatcgtaccaaacgtacgtaggtaaactaacgtaaattagtcgaccaaaccgtatcgtgttagagtagtcgactagacaatcgaaacgtagacaacatacgaaacgtacctacgttcctcccgtagcaacgtcgtacgaccgttcgtacggtcgaaccgtacccggaaggtaccgtacggggttataacgttaacgttcgtaagggtacgggaaacgtaccggacccctaagtacgaacttgttccgaacctacgtcgtacgtcgttcggtcgttcgttaag

SEQ ID NO: 429471 - DNA, 520 bp, Homo sapiens
  misc_feature: GZ8MTXP01B3H35.19.71.G05.1.454.CMB.2.raw
  modified_base (339)..(339): a, c, t, g, unknown or other
  modified_base (448)..(448): a, c, t, g, unknown or other
  modified_base (453)..(453): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctgggaagacatatttcatgtaccaacacgtggaactacaaattntgcaaccatcgtgttgagagtcgactgacatacaacgtagacacatacgaagaacctagttctcctgacacgcgtcgacctcgtgtcgacctcccggaggacgcgggtntaatnttacgtggtaggaagacggccccagtacgacgcttcgcctacctcgtctcgttggtcgttcgttaag

SEQ ID NO: 429472 - DNA, 581 bp, Homo sapiens
  misc_feature: GZ8MTXP01ETSCV.19.71.G05.1.454.CMB.2.raw
  modified_base (246)..(246): a, c, t, g, unknown or other
  modified_base (261)..(261): a, c, t, g, unknown or other
  modified_base (267)..(267): a, c, t, g, unknown or other
  modified_base (320)..(320): a, c, t, g, unknown or other
  modified_base (362)..(362): a, c, t, g, unknown or other
  modified_base (409)..(409): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccgatcaactgacaagtccagccataattcttttaanactatacaataatanaaactntagctagacagacagacgacagacacgtcctcgagctgactactagtttacgnggactacgtaccgtaccggtacgtcccgggtccctagacgtntcgaggtcgcgcggtcgggtacgaggactagttactcactctacacnacacgcacgcgtcgacgacgacgtagagtagtggtagtagttagttagttatagtactaataattattattacttacgttcgtaacggtacggttacggtacggttaacggtaacgtaaggttagttacgttagtaagtacgtaacgtacgtacgttacgtcgttcgtaacg

SEQ ID NO: 429473 - DNA, 533 bp, Homo sapiens
  misc_feature: GZ8MTXP01DM4BW.19.71.G05.1.454.CMB.2.raw
  modified_base (435)..(435): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcactggggtcaggcagtccccatcgagaggtctagagtggctgggaaggacatatttcatgtccaacacgtagaaatacaaaattatgcaccatctgttgagagtcgactgacaatcaaacgtagaacacgatacgaaagaacccagttcctcccgtanacacgtctacgtacctctgtcgaccgtaccggacggtacgtacgggttagttattattaacgtaggtaacggaacgacggacccctaagttaacgaac

SEQ ID NO: 429474 - DNA, 574 bp, Homo sapiens
  misc_feature: GZ8MTXP01AB5N0.19.71.G05.1.454.CMB.2.raw
  modified_base (239)..(239): a, c, t, g, unknown or other
  modified_base (252)..(252): a, c, t, g, unknown or other
  modified_base (284)..(284): a, c, t, g, unknown or other
  modified_base (315)..(315): a, c, t, g, unknown or other
  modified_base (553)..(554): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgccccacggggacatcgtgatgacccagtctccagactccctggctgtgtctctgggcgagccgggccacatcaactgcaagtccagccactaatctttanacagttaccaaanaatagaaaactacttagcttggtacagcaganaccagacagcctcaggctgctctatttacgnggctagtaccgtacccggggaattccccgggggtacccctggaccgtatttccgaggtacgggcccgaaggtccggggtacgtaggggaacctaggtactttacaaccttccctacaaccctataccgaaggcaaggccctgaccgaggcttaagaagtatggggtgacgtagttttatagttgacaaataattagttactatacgtcgtgcgttcgacgaaggtactagttgattannagaacagtgttgcttgaacc

SEQ ID NO: 429475 - DNA, 621 bp, Homo sapiens
  misc_feature: GZ8MTXP01EQ0SY.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccctcgcacgacccctctcgctcacctgtcgcccatccgtccgggggacagagtcgctagcgacaggtgttgcttggcacgtggtcaggcacgtccccatcgagtaggtctagaggtggcgtaggggaaggtactagttatttccaaattcgtcccaaacgtacggtaggaaataacgtaaattctacgacacctatcgtgttagagtacgtcgactagaactaatacgaaacgtaacgaacaacgtaacgttaacggaaacgtaaacccgtaacgtttccctacccgtagtaccaacggtcctacggtaacccttcggttacgttaccggaacccgttcccggaaacgggtacacgggggttattaacttaagtacgtggtacgggaacgaccggtccccttaagtaaccg

SEQ ID NO: 429476 - DNA, 575 bp, Homo sapiens
  misc_feature: GZ8MTXP01B6S9D.19.71.G05.1.454.CMB.2.raw
  modified_base (369)..(369): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccatcgtccggggacagagtcgctagcgacagtgttgcttggcacgtgggtcagcacgtccccagtcgagaggtctagagtggcgtaggggaacgacatattcatacgtaccaagacgtagaaactacaaattanacgacacctattctgttagagtagtacgactagactaatacaaacgtacgaaccaacgaatacggaaacgtaacctacgttccctcccgtagaccacgtcctacgtaccttcgtcggtacgaccgttaccccggaaggtaccgtacggggttagttaacttacgttaacggtagtaaggaacggcgttaccccaagttaacgaacg

SEQ ID NO: 429477 - DNA, 732 bp, Homo sapiens
  misc_feature: GZ8MTXP01EXHEJ.19.71.G05.1.454.CMB.2.raw
  modified_base (224)..(224): a, c, t, g, unknown or other
  modified_base (238)..(238): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctggcctcccacaaggtgtcctgtcacaagtacagctgcagcagtcaggtccaggactggtcgaacgccctcgcacgaccctntcgctcacctgtcnccagtccgtccggggacaggacgcgctagcgacgtagtgttgcgttggctacgtggtcacggcacgtccccagtcgaggtacggtactagaggtggcgtaggggaaggtactagttatttccaaagttcgtaacccaaacgtaacgggtagggtaaaacttaaccgtaaagtttactacggacctaaccgtagtttccttagggttacgaacggttaacggttaccgtaacgttacggaaacctaaacttaacccggtaaaacgttacggaaaccctaacgtaaacgttaaacccggaaaacgttaacccgtaacggtttcccctaccccttaggtaccaacggtccttccgggtaaacccctttcggtaacggttaccggtaaccccggttaccggaacggggtaaccccgttacgggggttatttaaacgttaacgttacggtcgggttaacgggaaacccgggttacccgtaaccccgttaagtaaaccgg

SEQ ID NO: 429478 - DNA, 589 bp, Homo sapiens
  misc_feature: GZ8MTXP01CJDTP.19.71.G05.1.454.CMB.2.raw
  modified_base (230)..(230): a, c, t, g, unknown or other
  modified_base (241)..(241): a, c, t, g, unknown or other
  modified_base (251)..(251): a, c, t, g, unknown or other
  modified_base (255)..(255): a, c, t, g, unknown or other
  modified_base (264)..(264): a, c, t, g, unknown or other
  modified_base (319)..(319): a, c, t, g, unknown or other
  modified_base (579)..(579): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccacatcaactgcaagtccagccanaattctttaanactatacaanatanaaactctanctagacagacagacgaccgagacacgtccctcgtaggctcgctacttatttacgnggactacgtaccgtaacccgggtacgtcccggggtcccctacggtacgtatcgaggtcggacgcgggtcgggtacgtagggactagtacttcacttctacactatcgactcgacgctgacgaggactaggagtgtggggtagtactttatttagttattacgtaactaacttaattattattacttcgttcggtaacggtacgttacggaacggaaagggtaccgtaagggttagattacgtaagaagtaacgtatgggntcgttgaacc

SEQ ID NO: 429479 - DNA, 605 bp, Homo sapiens
  misc_feature: GZ8MTXP01CBWBT.19.71.G05.1.454.CMB.2.raw
  modified_base (293)..(293): a, c, t, g, unknown or other
tcagtactctcgtgcacgaccggtgctcgatttagtgtcgtcgcaagagagagggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcagtccccatcgagaggtctaggngtggcgtagggaagactattatttcagtcgtaccaaacgacggtaggtaaactaactaaattatcgacaaccctatcgtgttagagtagtcgactagaactaatacaacgtagacacactacgaaacgaacctagttcctacctgacacgctacgtaccttctacggtcgacccgtccgggacggtaacgtacgggtagttaagttacgttaacgtaaggtacgggaaacggtaccgggaccccctaagtaacgacgacgttccggtaacctacccgttcgttcgtccgttgggtcgttaacgtttaacggg

SEQ ID NO: 429480 - DNA, 612 bp, Homo sapiens
  misc_feature: GZ8MTXP01EU0Z2.19.71.G05.1.454.CMB.2.raw
  modified_base (226)..(226): a, c, t, g, unknown or other
  modified_base (238)..(238): a, c, t, g, unknown or other
  modified_base (252)..(252): a, c, t, g, unknown or other
  modified_base (257)..(257): a, c, t, g, unknown or other
  modified_base (267)..(267): a, c, t, g, unknown or other
  modified_base (437)..(437): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgcaagtccagccanaattcttttaanactacgtaccaaanaatanaaactactanctagacagcaagacgaccaggacacgcctcgtaggctgcttactatttacgtgggactacgtaccgtaacccgggacgtcccggggtcctacgaccgtattcgaggtcggacgagggcgggtcgtagggactagtactttcacttctacacatcagcacgtcctgcgagngtagaagtagtgtgggtagttagtttattattagtactaactaattaatttaatttattacgtttacgttacggtaacggttacggttacggtaaacgggttaacggtaaggtaaggttaagttacgttacgtaacgtaacgtaacgtaggtacggttacgtcgttaacgtaacg

SEQ ID NO: 429481 - DNA, 628 bp, Homo sapiens
  misc_feature: GZ8MTXP01BUL04.19.71.G05.1.454.CMB.2.raw
  modified_base (244)..(244): a, c, t, g, unknown or other
  modified_base (258)..(258): a, c, t, g, unknown or other
  modified_base (270)..(270): a, c, t, g, unknown or other
  modified_base (326)..(326): a, c, t, g, unknown or other
  modified_base (377)..(377): a, c, t, g, unknown or other
  modified_base (439)..(439): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctccctggctgtgtctcgtgggcgagccggccacatcaactgacaagtccagccataattctttanactagttaccaaanaatagaaaactntagcttaggaccagacagacgaccgagacagccctacaggctgctactatttacgngggactacgtccgtaacccggggactccccgggggtccccctaggaccgtnttaccgaggttcgggctaagggccgggtcgtaggggactaggtactttccactctacactancgacgcacgtccgtgaccgaggcgtagaagtgtggggtaggtattaggtttatacttagtaactaaataaattatttaattacttacgttcggtaacggttacgttaccgggaaccgaaaggggtaacctaagggttacggattacgtcgaaggtaaccgtaacggtggttcggtaacgttcgtaaccc

SEQ ID NO: 429482 - DNA, 654 bp, Homo sapiens
  misc_feature: GZ8MTXP01CPF1P.19.71.G05.1.454.CMB.2.raw
  modified_base (241)..(241): a, c, t, g, unknown or other
  modified_base (252)..(252): a, c, t, g, unknown or other
  modified_base (256)..(256): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactcctggctgtgtctcgtgggcgagccgggccacgactacgactgactaagccagcactatctttaanactactacaanatanaactctagctagacagacagacgacgagactcgcctacgtacggctacgactacgtacgtttacgcggactacgtaccggtaacccggggtacgttcccggggtacccctacggacgtagtcgtacggtacggacgtaacgggtccgggtacggtacgggtacgtacgtacgttactacctacctacctactacgtacgacgacgacgtacgtacgacgacgtacgtacgtacgtagtacgggtacgtacgttaagttagttacgttacgtacgtaacgttaattaacttacttacgttacgttacgtaacggtacggttacggtacggaacggtaacgtaacggttagttacgttacgtaacgtacgtaacgtacgtacgttacgtcgttcgtaacg

SEQ ID NO: 429483 - DNA, 631 bp, Homo sapiens
  misc_feature: GZ8MTXP01EZX6O.19.71.G05.1.454.CMB.2.raw
  modified_base (572)..(572): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccagtccgtccggggacagagtcgctagcgacagtgttgcttggcacgtggtcaggcacgtccccagtcgaggacggtcgtagaggtggcgtaggggaaggactagttatttcgaatcgtaaccaaacgacggtaggtaaataactaaattactacgacctaacctattcgttgttagagtaacgtacgtaacgtagaaacaactaacgaaacgtaacgaacaactacgtaacgaaacgaaaccgtacgttcctacctacgacgtagtccgtacaacccttcgtcggttaccggaccgttaccccgggaaacgggtacgttaaccgggggtttnttaattaagttaccgtaagggtaacgggaacggaccgggtaacccccttaagtaaccgg

SEQ ID NO: 429484 - DNA, 580 bp, Homo sapiens
  misc_feature: GZ8MTXP01DD9U5.19.71.G05.1.454.CMB.2.raw
  modified_base (252)..(252): a, c, t, g, unknown or other
  modified_base (267)..(267): a, c, t, g, unknown or other
  modified_base (344)..(344): a, c, t, g, unknown or other
  modified_base (380)..(380): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccgacggggacatcgtgatcgacccagtcctccagacctccctggctgtgtctcgtggggcgaggccgggccaccatcaactgacaagtccagccaataattcttttaanactacgttaccaaanaatagaaacactacttagcttggaaccagcaagacgacccaaggaccacgccctaccgtaggctgcttctattacgnggcacgtccgtacccgggactcccgggtctgacctntcgagtgcagggcgggtcagggacagtacttcactctacacatacagccagcctgacaggtctaggaagtagtggtagtacttagtttactagttacgtaactaaataattattaattattaacgttcggaggtaccgttacggaaccgaagggttaccgttagggttacgtaatagtcgaagacgttacgtgcgtaacg

SEQ ID NO: 429485 - DNA, 656 bp, Homo sapiens
  misc_feature: GZ8MTXP01A8YTS.19.71.G05.1.454.CMB.2.raw
  modified_base (607)..(607): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcacgacccctctcgctcacctgtcgccatcgtccggggacaggagtcgctagcgacagtgtgcttggcacgtgggtcacggcacgtccccagtcgagacggtctagagtggcgtaggggaagactagttacttcgaaatcgttaaccaaacgtaaccgggtaggtaaaacttaaactaaaagtttatacgaccaaccgtaattctagggttagaaggtacggttaccgacttaggaaaccaaacgttacgaaaacgttacgaacaaactaacgttaaccgggaaaacgaaaccctaacggtttcctaccccgttaaggccctaacggtacctacggtaacccttcgtcggttaccgacccgttaccccgggaaaggtaccggttaccggggttnttaacttaagtacgtaaggtacggaacgttaccggccccttaagtaacg

SEQ ID NO: 429486 - DNA, 774 bp, Homo sapiens
  misc_feature: GZ8MTXP01CKDJ1.19.71.G05.1.454.CMB.2.raw
  modified_base (224)..(224): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggactggtgaagccctcgcagaccctntcgctcacctgtcgccatccgtccggggacagagtcgctagcgacagtgtgcttggcacgtggtcaggcagtccccatccggagaggtctagagtggcgtacggggaaggtacattatttccgaaattacggtaacccaaaacgtaaccgggttaagggtaaaacttaaaccgaaaaaagttttactacggacctaaacccgtaattaccgttacggtttaaggaaggtaacgggtttaccggaaaccgttagggaaaccccgtaaaatttaaaccgaaaaccggttaacggtaaacctaaacccgaaaacggtttaaaccggaaaaccgggtaaaacccttaaccgggtttaaccccgttcccctttaacgggtacccaaaccgggtcccttaccgggtaaaccccttccgtttaacggttaccggtaaaccccgttaccccgggaaacggggtaaccggttaaccggggtttagttaaacgttaacgtttaacccgttgggttaacgggaaacggttaccgggtaaccccccttaaggttaaacccgg

SEQ ID NO: 429487 - DNA, 695 bp, Homo sapiens
  misc_feature: GZ8MTXP01CWGOW.19.71.G05.1.454.CMB.2.raw
  modified_base (313)..(313): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgcccatccgtccggggacagagtcgctagcgacagtgtgcttggcacgtggtcaggccacgtccccagtcgagnggtctagagtggctaggggaaaggactagttatttcaaagttcgtaacccaaacgtacggttaggtaaaactaaccgtaaaatttactacgacctaaccctaattccgttaggttaggaacgtaacggttaccgtaaacgttacggaaacctaaaacttaccgaaaacggttaacgaaacctaaacgtaaacgttaaccgaaaacggtaaaccctaacgtttcccctaccccgttacgccgtaacggtcctacggtaccccttcgttcggttacgtaaccccgttaccccgggaagggtaaccgttaaccggggttgttaacgttaacgtttaccggtaaggtacgggaacggttacccggtaacccccttaagttaacccg

SEQ ID NO: 429488 - DNA, 585 bp, Homo sapiens
  misc_feature: GZ8MTXP01CJ9Q9.19.71.G05.1.454.CMB.2.raw
  modified_base (249)..(249): a, c, t, g, unknown or other
  modified_base (328)..(328): a, c, t, g, unknown or other
  modified_base (387)..(387): a, c, t, g, unknown or other
  modified_base (413)..(413): a, c, t, g, unknown or other
  modified_base (415)..(415): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctcgtggggcgaggccgggccacgatacgacgtcgacaagtccagccactaattcttttaanactacgttccaaacaatagaaaactactagcttggaccagcagacgacaggacacgcctctaggctgctctatttacgnggctagtccgtaccgggaatcccccggggtcctgaccgtattcgaagtgcgtgcgggtntgggactagtacttcacttcacacancncacgacgcgcgacgacgagagagaggtgtgtagttagttattatatactaataattattattacttacgttaacgttacggttacggtacggttaccggtaacggtaacggttacggttaggttacgtaacgtacgtaacggtaacgtacgttacggtaacggttcgtcg

SEQ ID NO: 429489 - DNA, 631 bp, Homo sapiens
  misc_feature: GZ8MTXP01AFKWZ.19.71.G05.1.454.CMB.2.raw
  modified_base (249)..(249): a, c, t, g, unknown or other
  modified_base (331)..(331): a, c, t, g, unknown or other
  modified_base (339)..(339): a, c, t, g, unknown or other
  modified_base (619)..(619): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgccccgacggggacatcgtgatcgacccagtctccagacctccctggctgtgtctcgtgggcgaggccgggccacatacgaactgacaagtccagccaactaattctttanactagttaccaaatatacgaaaacttcttagcgttacggaccagacaagacgaccgaaggacacgccctacgtaggctgctntatttcgnggcagtcccgtaaccgggacgtcccgggtccctacggaccgatttcgaggtcgggacgtcgggtccggggtactaggggactagtactttaccactctacgacatcgagcgacgccgtagcgtaggctagaagtgtggggtggtacgttatttattagtacgtaactaaatttaattaatttacttaattacccggttggtaacggttaccggttaccggaaccgttaaagggaacgtaagggttggttattacgaacggagtaaccgaggtgttccgtnttaaccgaaccg

SEQ ID NO: 429490 - DNA, 630 bp, Homo sapiens
  misc_feature: GZ8MTXP01BZZJZ.19.71.G05.1.454.CMB.2.raw
  modified_base (575)..(575): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtccgtccggggacaggacgtcgctacgcgactaggtgttgcgttggcacgtggtcgaggcacgtccccagtcggagtaggtctaggaggtggcgtaggggaaggactattactttcaattcgtaaccaaacgtacgggtaggtaaactaactaaatttactacgacctaacctattcgttgttaggaagtacggtacgaacgtagaacaatacgaagtacgaacacgtaagtaaccgaaacgtaacctacgttccctacctacgctaacggtcctacggacccttcgtcggttaccgacccgttacccggaacgggtaccgttacggggttnttaacgttaacgttacgtggttaacggaacggaccggtaaccccttaagtaaccg

SEQ ID NO: 429491 - DNA, 569 bp, Homo sapiens
  misc_feature: GZ8MTXP01DEGNR.19.71.G05.1.454.CMB.2.raw
  modified_base (382)..(382): a, c, t, g, unknown or other
  modified_base (515)..(515): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgcgctgggcctcccacaaggtgtcctgtcacaagtacagctgcagcagtcaggtccaggactggtgaagccctcgcagaccctctcgctcacctgtgccatcgtccgggggacagagtcgctagcgacagtgttgcttggcacgtgggtcaggcacgtccccagtcggagaggtctaggagtggcgtaggggaaggactattatttacaattcgtccaaacgacgtaggaaataacaaattangacacctatctagttagagagtcgactagaacaaatacgaaacgtagaacaacagtaaccgaaagaacctagttcctcctagctagctcgaccctgtgttacgaccgttaccggaaggtacgttacggggttnttaagttaacgttacgtggttaacgggaacgttaccggaaccccgaagtaaccg

SEQ ID NO: 429492 - DNA, 617 bp, Homo sapiens
  misc_feature: GZ8MTXP01B72QU.19.71.G05.1.454.CMB.2.raw
  modified_base (230)..(230): a, c, t, g, unknown or other
  modified_base (239)..(239): a, c, t, g, unknown or other
  modified_base (319)..(319): a, c, t, g, unknown or other
  modified_base (373)..(373): a, c, t, g, unknown or other
  modified_base (410)..(410): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatcgaactgcaagtccagccanaatctttanacagttaccaacaatagaaaactacttagcttaggaccagcagacgaccaggacagcctcctaggctgctctatttacgnggctacgtaccgtaccggacgtccgggtcccctagacgtagtcgaggtcggcgnggtcggtacgtgggactagtacttcactctacactanacacgcgacgtctgacgaggcgtagaagtcgtggggtacggttacgtttaagtttacgtttagttacgtaactaaattaaatttaactttaatttaacgttacgttcggttaacggtaaccggttcggaaccggttaaacgggtaacggtaaggttacgttacgttaactaacgtaacggaacgtacgtggttacgtcgttcgaacg

SEQ ID NO: 429493 - DNA, 652 bp, Homo sapiens
  misc_feature: GZ8MTXP01DFPSN.19.71.G05.1.454.CMB.2.raw
  modified_base (227)..(227): a, c, t, g, unknown or other
  modified_base (237)..(237): a, c, t, g, unknown or other
  modified_base (246)..(246): a, c, t, g, unknown or other
  modified_base (250)..(250): a, c, t, g, unknown or other
  modified_base (256)..(256): a, c, t, g, unknown or other
  modified_base (259)..(259): a, c, t, g, unknown or other
  modified_base (309)..(309): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatacaactgacaagtccagccanaatctttaanacatacaanatanaaactntanctagacagacagacgacagacacgcctcgagctgactactacgtttacgngggactaacgttaccggtaaacccgggtacgtccccggggttccctacggaccgtagttcgaggtcggaacgacgggtcgggtcgtagggaactagtacttaccactcctacaacctataccgaagacgacgaccgtcgacgacgacgtagaagtagtagtaggggtacgttaagtttaagttaagttacgtaactaaactaaattaaatttaattaacgttaacgttacggttacggttaacggttacggttaacggtaaacggaaacggtaaacggtaaggttaagttaacgttacgtaacgtaacgtaacgtacgtacggttacgtaacgaaccgtaacg

SEQ ID NO: 429494 - DNA, 724 bp, Homo sapiens
  misc_feature: GZ8MTXP01BOTFN.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgaccctctcgctcacctgtcgccagtccgtccggggacagacgtcgctagcgactagtgttgcgttggcacgtgggtcacggccacgtccccagtccgagaggtcgtaggaggtggcgtaggggaaggtactattattcaattcgtaaccaaacgtacggtagtaaactaactaaattacgtacgacctaactaagtttcgttagggttagaaggtaacggttaccgtaacgttacggaaacctaaacgtaaccgtaaacgttaacgaacctaacgtaacgttaaaccggaaaacgtaaacccgtacgtttaccccgtacccgtacggtaccgtacggtaccgttaccgtacccgttaacgttaccggttaccggtaacccgttacccggggaaacggggtaacccggttaaccgggggtttgttaaacggttttaacgtttaaccgggttaaggggttaaccggggaaaccgggttaccccgggaacccccttaaggtaaccccgg

SEQ ID NO: 429495 - DNA, 636 bp, Homo sapiens
  misc_feature: GZ8MTXP01C4H7M.19.71.G05.1.454.CMB.2.raw
  modified_base (246)..(246): a, c, t, g, unknown or other
  modified_base (338)..(338): a, c, t, g, unknown or other
  modified_base (442)..(442): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgaggggacatcgtgatgacccagtctccagacctccctggctgtgtctcgtgggcgaggcgggccacatcaactgacaacgtccagccaactaattcttttaanaactacgttaccaaactaaataacgaaaacttactagcttacggaaccagacagacgaccaggacacgcctacaggctgctactatttacgnggcctagtccgtaaccccggggagtcccggggtcccctggaccgtatcgaggtgcgcggtcgggtgtagggactagtacttacaccttctacacctatcgaacncacgtcctgacgaggactagaagtgtaggggtcggtatttaagtttatattacgtacaaattaatttagttaatttacgttacgtttcgggttaagggtaaccggttacgggaaaccggaaaggggtaacctaaggggttagttacttacgtaaccgaaggtaaccgtaaggtggttacgaacttaacgaaccc

SEQ ID NO: 429496 - DNA, 745 bp, Homo sapiens
  misc_feature: GZ8MTXP01DNRJY.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggactggtgaagccctcgccacgaccctctcgcctcacctgtcgccagtccgtccggggacaggagtcgctagcgacgtagttgttgcgttggctacgtgggtcacggcacgtccccatcggagaggtctaggaggtggcgtaggggaaggtactagtttatttacaattcgtaaccaaacgtaacggttaggaaaactaacgtaaaatttacgtacgacctaacctaagttcgttaggttaggtaaggtaacggttaccggtaacgttacggaaacctaaacgttaaccgaaaacgttaacgaaaccgtaaacgtaaacgttaaaccggaaaaccgtaaacccgttaaccggtttcccttaccccgttacggaccgtaacggtaccttaccggtaaccccgtttaacgttacgggttaccggtaaccccgttaccccggggaacgggtaacccgggttaaccggggtttaggttaaacctttaagtttaaccggtaagggttaacggggaaacggttacccgggtaacccccttaaggttaacccgg

SEQ ID NO: 429497 - DNA, 744 bp, Homo sapiens
  misc_feature: GZ8MTXP01AITIG.19.71.G05.1.454.CMB.2.raw
  modified_base (297)..(297): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgaccctctcgctcacctgtcgccagtcgtccggggacaggacgtcgctacgcgactagtgttgcttggctacgtgggtcnggcacgtccccagtcggagaggtctaggaggtggtcgtaggggaacggtactagtttactttacgaaagttcgtaacccaaacgtaacggttagggtaaaactaaccgtaaaagtttactacgacctaacccgtagttaccgttagggtttaaggaacggttaacggttaccggtaacgtacgtaaacgtaaaccttaaccggtaaaaccggttaacgaaacccgtaacgtaaacgttaaacccggaaaaaccggttaaaccgttacccgttacccgttaccccgtacggtacctacgttaccgttaccgaacccgtttcggtcggttaccggtacccggttacccgggtaacgggtaaccggttaccggggttagttaagttaaccggtttacggtaacgggttaacgggaaccgggttacccggtaaccccgttaagtaacccgg

SEQ ID NO: 429498 - DNA, 607 bp, Homo sapiens
  misc_feature: GZ8MTXP01CWP49.19.71.G05.1.454.CMB.2.raw
  modified_base (230)..(230): a, c, t, g, unknown or other
  modified_base (423)..(423): a, c, t, g, unknown or other
  modified_base (446)..(446): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtgccatccgtccgggganagacgtcgctagcgacagtgttgcgttggcacgtgggtcaggcacggtcccccagtcggagaggtctaggagtggcgtaggggaagcaattattttcattgtaccaaacgacgtaggaaactaacaaattagtacgaccaaaccctatcgttagttagagtacgtcgactagacaattacaaacgtagacganactacgaaactaacctagttccncctagcacgtctcgtaccttcgtacgtcgtaacccgtccggaggtaaccgtcgggttattagttaacttacggtggtaacgggaaacgacccggttcccaaagtacgacgttattccgaaccctacgtcgttacctcgttcggtaacgttaacgtttaacg

SEQ ID NO: 429499 - DNA, 664 bp, Homo sapiens
  misc_feature: GZ8MTXP01CKXEY.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagaaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatcgtccggggacagagtcgctagcgacagtgttgcttggcacgtgggtcaggggcacgtccccagtcgagaggtcgtagagtggcgtagggaaacggactattatttcattaacgttacccaacgtacgtagggaaacttaacgtaaaattactacgaccaaccctattcgttaggttaggaagtaggttacgaaccgttaggaaacctaaagttaccgaaaacgttacgaaacctaaacggtaacgttaaccggaaaaccgaaacccgttacggtttaccctaccccgtagaccgtacgtccgttacggtaacccttcgttaacggtaccgaccggttacccggaacggtaacgtacggggttattacgttaacgtttaacgaggttaacgaacggaccggttacccctaagttaacgtaacg

SEQ ID NO: 429500 - DNA, 547 bp, Homo sapiens
  misc_feature: GZ8MTXP01CP45T.19.71.G05.1.454.CMB.2.raw
  modified_base (224)..(224): a, c, t, g, unknown or other
  modified_base (464)..(464): a, c, t, g, unknown or other
tcagtactctcgtgcacgaccggtgctcgatttagtgtcgtcgcaagagagaggggggcagagtctgctgaattctggttgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctntcgctcacctgtgccatcgtccggggacagagtcgctagcgacagtgttgcttggcacgtgggtcaggcacgtccccatcgagaggtctagagtggcgtaggggaacggactatatttcataaggttacccaacgacgtagggaaattaacaaattatgaccactatctgttgagagtcgactagaacaatcaaagtagacacatacgaagaacctagttccacctgacagtctgacctntcgtcgaccgtcccggaaggacgtcgggttagttattacgttaacgtaggtcgggaacgccggacccctaagttaacgaaccg

SEQ ID NO: 429501 - DNA, 565 bp, Homo sapiens
  misc_feature: GZ8MTXP01AHCY0.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatcgtccggggacagagtcgctagcgacagtgttgcttggcacgtggggtcaggcacgtccccatcgagaggtctagagtggctggggaacgacagtatttcatcgtacccaacgtacgtagggaaattaacgaaatttatacgaccacctatcgtgttagagtagtacgactagaacaataccaaacgtagaacacatacgaaagaacctagttcctcccgtgaccagtctacggacctgtcgtcgacctccccgggaaggtaccgtacgggttgttattacgtttaacgtgggtaaggaaccgaccggcccctaagttaacgaac

SEQ ID NO: 429502 - DNA, 643 bp, Homo sapiens
  misc_feature: GZ8MTXP01B8VGL.19.71.G05.1.454.CMB.2.raw
  modified_base (305)..(305): a, c, t, g, unknown or other
  modified_base (427)..(427): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctccacaaggtgtcctgtcacaagtacagctgcagcagtcaggtccaggactggtgaacgccctcgcagaccctctcgctcacctgtcgccagtccgtccggggacagagtcgctagcgactaggtgttgcgttggctacgtgggtcaggccacgtccccagtcggaagaggtctaaggngtggcgtagggaagactattatttcatcgtacaaacgtcgtagaaactacgtaaattatacgtaccaattcgttgttagaagtacgtaccgtaatacgaaactaaacgttaccaaacggtanaactaactacgtaacgaaaacggtaaaccctagtttaccccacccgttagactacggtaccttacggggtaacccttcgttcgacgtaacccgtccggaaggaccgtaacggggttataacgttaattaccgtggtaacggaacgaccggtaccccaagtaacgacttacgttcgaccctaacctcggtcctacgtggctcgttaagttaacgggg

SEQ ID NO: 429503 - DNA, 658 bp, Homo sapiens
  misc_feature: GZ8MTXP01DQQ6G.19.71.G05.1.454.CMB.2.raw
  modified_base (603)..(603): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttctcttcttcctgcccgtgctgggcctcccacaaggtgtcctgtcacaagtacagctgcagcagtcaggtccaggactggtgaacgccctcgcagaccctctcgctcacctgtcgccatcgtccggggacagagtcgctagcgacagtgttgcttggcacgtggtcaggcacgtccccatcgagaggtctagagtggcgtaggggaaggactattactttcaattcgtcccaaacgtaacggttagggtaaaactaacgtaaaatttagtacgacctacctaattcgtggtttagaagtaacggtcgtaacttacgaactaaacgttacgaaacgtacgaaacgtaacaacgttaaaccggaaaacgtaaacccgtaacggtttccccttacccgttacgaccgtaacggtcccttacggtaacccttcgttacggttacgtaacccgttaccccgggaagggaacccgttacgggggttnttaaacgttaagttaaccgtggtaacggaacggttaccggccccttaagtaaccg

SEQ ID NO: 429504 - DNA, 573 bp, Homo sapiens
  misc_feature: GZ8MTXP01AGP6C.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgtgcttggcacgtggtcaggcagtccccatcgagaggtctagagtggctagggaaggacatagtttcaatcgtccaaacgacgtaggaatacaaagttatagcaccatctagttgagagtcgactgaacaatacaaacgtagaacaacaagtacgaaacgaaacctaggttacctcccgtagccgaagtcctacgtaccctaactcggttacgtaccgttacccggtaacggaaccgttacggggttcggttaattaacttacgtggttaacgggaacggaccggaacccccgttaagtaaccg

SEQ ID NO: 429505 - DNA, 726 bp, Homo sapiens
  misc_feature: GZ8MTXP01D0XXR.19.71.G05.1.454.CMB.2.raw
  modified_base (661)..(661): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacaggagtcgctagcgacagtgttgcgttggcacgtggtcacggcacgtccccagtcggagcggtctaggagtggcgtaggggaacggtactattactttacaagttcgtaacccgaaacgtaccgggttaagggtaaaacttaaaccgtaaaagtttacgtacgtaccctaacccgtaatttccgtaggtttaggaaacggtaacggttaccggtaaacttacggaaaccgtaaaacttccgaaaaaacggttaaccgaaacctaaaccgtaaagttaaaccggaaaacgtaaacccgttaacggttttaccctccccgttagacccgtaacggtccctacgggtaaccccttgttcggttacggtaacccgtttacccgggaaagggtacccgttaacgggggtttnttaaacgtttaacgtttacggtcggtaacgggaaccgttaacccgggtccccttaagtaacccgg

SEQ ID NO: 429506 - DNA, 625 bp, Homo sapiens
  misc_feature: GZ8MTXP01D2VKC.19.71.G05.1.454.CMB.2.raw
  modified_base (242)..(242): a, c, t, g, unknown or other
  modified_base (314)..(314): a, c, t, g, unknown or other
  modified_base (323)..(323): a, c, t, g, unknown or other
  modified_base (361)..(361): a, c, t, g, unknown or other
  modified_base (370)..(370): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccacatcaactgacaagtccagccataattctttaanacacgttaccaacaatagaaaactacttagcttaggaccagcagagaccaggacacgcctactaggctgctntatttacgnggactagtacccgtaacccgggatccccggggtccccnggaaccgtntcgaggtcggcgtggtcgggtcgacgggactagtacttacactctacacatcacgcacgcctgcgaggactaggaagtgttggggtacggttagtttaagtttagttagtacgtaactaaattaaagtttactttaattacgttacgttacggttaacgggttaccggttaccgggaaaccggttaaacgggtaacgtaagggttacgttattacgaacgtaagtaacgtacggtggttacgtcgttaacgtaac

SEQ ID NO: 429507 - DNA, 679 bp, Homo sapiens
  misc_feature: GZ8MTXP01CT3QJ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgccacgaccctctcgctcaccttgtcgccagtccgtaccgggggacaggacgtcgactacgcgactaggtgttgcttggctacgtggtcaggcacgtccccagtcgagaggtactaggagtggacgtagggaaggactagttattacaacgttacgtaaccgaaacgtacgggtaaggtaaactaactaaaattcgtacgacctaacctacgttcgtttaggtaggtaaggtaacgtccgtaaacgttacggaaactaacgtaaccgtaaacggttaacgaaaccaacgtaaacgtaaccggaaacgtaaacccgtacgttaccctacccgttgaccgtacgtcgtacgtcccttaacgtcgttacggacccgttacccgggaggtacgttaacggggtttcttacgtttaacgttaccggtggttaacgggaaaccgttacccgggtaaccccttaaggtaaccg

SEQ ID NO: 429508 - DNA, 617 bp, Homo sapiens
  misc_feature: GZ8MTXP01AE26X.19.71.G05.1.454.CMB.2.raw
  modified_base (235)..(235): a, c, t, g, unknown or other
  modified_base (247)..(247): a, c, t, g, unknown or other
  modified_base (308)..(308): a, c, t, g, unknown or other
  modified_base (378)..(378): a, c, t, g, unknown or other
tcagtactctcgtgcacgaccggtgctcgatttagtgtcgtcgcaagagagagggggaggtacaacaggcaggtaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatctttanacagttccaaanaatgaaaactctagctggaccagcagagaccaggacagcctcctaggctgctcatttacgnggactacgtccgtaccgggacgtccgggtcctacggacctattcgaggtcggacgacgggcgggttacgnggggactagtactttcactctacacatcgacgcacgcctgacgtaggactaagaagtgtggtagggtacttaagtttacttagttacgtaactaaacttaatttaacgtttattaacgttaccgttacggtcggtaaccggttacgggaacccgtaaacgggttaaccgtaaagggtacgttaacgttacgttacgtaacgtaaacgtaacgttggtcggttactaaccgccgtaaccg

SEQ ID NO: 429509 - DNA, 633 bp, Homo sapiens
  misc_feature: GZ8MTXP01E37RL.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccatccgtccggggacaggacgcgctagcgacagtgtgcttggcacgtggtcaggcacgtccccagtcgagaggtctaggagtggcgtaggggaagactattattcaaagttcgtaacccaaacgtacgtaagggaaactaactaaaattagtacgtacctaacctagttcgttaggttaggaaggtaacggttacgaactacgaaactaaacgtaaccgaaacgtaacgaacaacgtaacgtaaccgaaacgtaaccctacgttccctacccgtagaccgtagtccgtacgtaccctcgtcgttacgacccgttacccggaagggtacgttacggggttattacgttaagttacgtcggtacggaacgaccgggtaaccccttaagtaaccg

SEQ ID NO: 429510 - DNA, 555 bp, Homo sapiens
  misc_feature: GZ8MTXP01AZO6V.19.71.G05.1.454.CMB.2.raw
  modified_base (425)..(425): a, c, t, g, unknown or other
  modified_base (471)..(471): a, c, t, g, unknown or other
  modified_base (483)..(483): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctaggagtggcgtggggaaggacatatttcatcgtaccaacgacgtaggaaactacaaattatagaccaaacctattcgtagttgaagtagtcgactgaacaatcgaaacgtagacacatacgaaacgaacctagttccnccctgacacgcgtgacctctggtcaccgtccgaggaccgacgggtntatacgttacgnggtaggacgaccggcccctaagtacgacagttccgaacccaccgttcgtctcgttcggtcgttcgttaacgg

SEQ ID NO: 429511 - DNA, 666 bp, Homo sapiens
  misc_feature: GZ8MTXP01DNNPR.19.71.G05.1.454.CMB.2.raw
  modified_base (224)..(224): a, c, t, g, unknown or other
  modified_base (238)..(238): a, c, t, g, unknown or other
  modified_base (611)..(611): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctntcgctcacctgtcnccatcgtcggggacagagtcgctagcgacagtgttgcttggctacgtgggtcagggcacgtcccccagtcggaagtaggtctaggaggtgggccgtaggggaaacggactagttactttacgaaattcgtaacccgaaacgtaccgggttaagggtaaaacttaacctaaaatttagtacggacctaacccgtattccgttaggtttacgaaggtacgttacgactaggaacctaaataccgaaacgtacgaacaacgtaagttaaccgaaacgtaaccctaacggttccctaccgtacggactaaggtcctacggtaaccccttcgtggttaccgtaacccgttaccggaaacggtaccgttaacggggttnttaacgttaagtacgttcgggtaacggaacggttaccggaaccccttaagtaacg

SEQ ID NO: 429512 - DNA, 613 bp, Homo sapiens
  misc_feature: GZ8MTXP01BVDH6.19.71.G05.1.454.CMB.2.raw
  modified_base (245)..(245): a, c, t, g, unknown or other
  modified_base (339)..(339): a, c, t, g, unknown or other
  modified_base (378)..(378): a, c, t, g, unknown or other
  modified_base (397)..(397): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctcctggctgtgtctcgtgggcgagccggccaccatcaactgacaagtccagccaactaattcttttaanactacgttaccaaataatagaaaactacttagcttaggaaccagacaagacgaaccgaggacacgcctacgtaggctgactactagtttaccgnggacacgttccgtaacccgggagtccccggggtaccccnggacgtattcgaggtggcngggtcggtacgtgggactagtacttcgactctacactagtcacgctacgcctgacgagacgtagaaagtcgtggggtacgtattaagtttattagtactaactaaattaattattaattattaccgttggtaacgggtaccgttacggaccgaaaggtaccgtaaggttacgttattagaaccgtaagaacgtacgtggttacgtcgttcgaaccg

SEQ ID NO: 429513 - DNA, 589 bp, Homo sapiens
  misc_feature: GZ8MTXP01BH9FB.19.71.G05.1.454.CMB.2.raw
  modified_base (282)..(282): a, c, t, g, unknown or other
  modified_base (320)..(320): a, c, t, g, unknown or other
  modified_base (340)..(340): a, c, t, g, unknown or other
tcagtactctcgtgcacgaccggtgctcgatttagtgtcgtcgcaagagagaggggggaccagggcagtcaccagagctccagacaatgtctgtctccttcctcttcttcgtgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagngtcagagtggcgtgggaagcattatttcatgtaccaanacgtaggaactactaaattntgctaaccattctgttagagagtcgactagacaatacaacgtagacacatacgaacgaccagttacctcctgcgagctcgaccttcgtcgtacgacccgtcccggacgggtaaccggtacggggttagttaacgttacgtttaacgtggttaacggggaaacggacccgggttaccccccgaagttaacgacgacgttccggcccctaccgttccgttacccgtcgttgggtaacgttccgtttaaggg

SEQ ID NO: 429514 - DNA, 723 bp, Homo sapiens
  misc_feature: GZ8MTXP01BGZL5.19.71.G05.1.454.CMB.2.raw
  modified_base (243)..(243): a, c, t, g, unknown or other
  modified_base (322)..(322): a, c, t, g, unknown or other
  modified_base (366)..(366): a, c, t, g, unknown or other
  modified_base (380)..(380): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgacaagtccagccacaattctttanacagttccaaactatagaaacttctagcttaggtaccagcaagagaccaggacagccctctaggctgctctatttacgnggctagtccgtacccgggatcccccggggtaccctggacccgtnttcgaaggtggcgngggtcccggggttctaggggaacctagggtacttttacccaccttcctaccaacccgtataccgagaccgaacgtcccgtggaccgaacgggtacgtaacggtaaacggtaggttacgggttacggtaacctttaagtttttaacgtttaacgttacgtttaaacctaaaacttaaagtttaacgttttaacgtttaacgtttaccggtttaacgggtttaaccgggttaccgggtttacccgggaaacccgggtaaacggggtaaccggttaaaggggttcggttaagttaacgtacgtaaacggtaaccggtaacggttacgggttaacggttccgtaacg

SEQ ID NO: 429515 - DNA, 535 bp, Homo sapiens
  misc_feature: GZ8MTXP01BMG7C.19.71.G05.1.454.CMB.2.raw
  modified_base (239)..(239): a, c, t, g, unknown or other
  modified_base (316)..(316): a, c, t, g, unknown or other
  modified_base (360)..(360): a, c, t, g, unknown or other
  modified_base (412)..(412): a, c, t, g, unknown or other
  modified_base (501)..(501): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccacatcaactgcaagtccagccacaattcttttanacagttccaaacaatagaaaactattagcttaggtaccagcagagaccaggacagcctcctaggctgctcatttacnggcatcgtacccggatccggggtcccctgaccgattcagtggcngcgggtctgggacagtactttcactctcaccatcagcagcctgcagctgaangtggtggctagttattatgtacaataagttattattatacttcgtggtacgttcggacccgttaagggacctaaagggttgttaattanaacgagaaccgtaagtggttggtccttgaacccg

SEQ ID NO: 429516 - DNA, 520 bp, Homo sapiens
  misc_feature: GZ8MTXP01BGWVP.19.71.G05.1.454.CMB.2.raw
  modified_base (233)..(233): a, c, t, g, unknown or other
  modified_base (333)..(333): a, c, t, g, unknown or other
  modified_base (487)..(487): a, c, t, g, unknown or other
  modified_base (511)..(511): a, c, t, g, unknown or other
  modified_base (514)..(520): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaattcttttatacagttccaacaatagaaaactacttagcttggtaccagcagagaccaggacagcctctaggctgctcatttacnggcatcgtacccgggaatccggggtccctgaccgattcagtggcaggcgggtctgggacagtatttcactctcaccatcagcagcctgcaggctagaagntggtggcctagttttattattgtacaaaataattaattattatacgtttgtggtacgttcggaccaaagggaccaaggtgatatgaagacgtaatggagctgacacagttctgttcttcattcccgttcccgctattctagacacgagaagtcnggacgcgggctgggacagggcaanagnnnnnnn

SEQ ID NO: 429517 - DNA, 616 bp, Homo sapiens
  misc_feature: GZ8MTXP01AM2OX.19.71.G05.1.454.CMB.2.raw
  modified_base (243)..(243): a, c, t, g, unknown or other
  modified_base (252)..(252): a, c, t, g, unknown or other
  modified_base (256)..(256): a, c, t, g, unknown or other
  modified_base (262)..(262): a, c, t, g, unknown or other
  modified_base (311)..(311): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccgatacgaactgacaagtccagccacaatctttaanacatacaanatanaaactntagctagacagcagacacagacacgcctacgagctgctactatttacgnggactacgtccgtaaccggacgtcccgggtcccctaggacgtatcgaggtcggacgcggtcgggtacgtagggactagtacttcactctacactatacgacgacacgccgtacgacgacggacgtagtagtagtacgggtacggtacgttagtttaagttagttacgtaactaaactaaattaatttaatttacgttacgttacggttaacggtacggttacggtaaccgttaacggtaacggtaacggttacggttacgttacgtaacgtacgtaacgtacgtacggttacgtcgttcgtaacg

SEQ ID NO: 429518 - DNA, 684 bp, Homo sapiens
  misc_feature: GZ8MTXP01BQGSW.19.71.G05.1.454.CMB.2.raw
  modified_base (625)..(625): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccatcgtccgggacagagtcgctagcgacagtgttgcttggcacgtggtcaggcacgtccccagtccgagaggtctaggagtggacgtaggggaaggtactagttatttcaattcgtaacccaaacgtaccggtagggaaactaacgtaaaattacgtacgacctaacctagttacgttggttaggtaaacggtaacggttaccgtaaacgttagaaaacctaaagttaaccgaaaacggttacggaaacctaaacgtaaacgttaccggaaaacggtaaaccctacggtttccctaccccgttaggaccctaacggtcccttacggtaacccttcgttacggttacccggaacccgttacccgggaagggtaccgttacgggggtttnttaaacgttaagttaccgtggtacgggaaacgttacccgggaaccccttaaggtaaccg

SEQ ID NO: 429519 - DNA, 565 bp, Homo sapiens
  misc_feature: GZ8MTXP01CMMLZ.19.71.G05.1.454.CMB.2.raw
  modified_base (519)..(519): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcacgtggtcaggcacgtccccatcgagaggtctagacgtggcgtacggggaaggactatagttttcaaagttcggtcccaaacgtacggtagggaaataaccgaaaattatacgactaacccattccgtgttagaggacgtcgaactgaacaattacaacgtagaacacatacgaacgaactagttctacctagctagctcgacctctcgttcgaccgcccgtaaggaccgttacgggttnttacgttaagttacgtcggtaggaacggacggaaccccaagtaacg

SEQ ID NO: 429520 - DNA, 630 bp, Homo sapiens
  misc_feature: GZ8MTXP01ENQD2.19.71.G05.1.454.CMB.2.raw
  modified_base (242)..(242): a, c, t, g, unknown or other
  modified_base (256)..(256): a, c, t, g, unknown or other
  modified_base (326)..(326): a, c, t, g, unknown or other
  modified_base (445)..(445): a, c, t, g, unknown or other
  modified_base (467)..(467): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccacatcaactgacaagtccagccaataattctttanacagttacccaaanaatagaaaacttacttagctaggtaccagacaagagaccaggacagcctcctaggctgctatatttacgngggactacgttaccggtaacccggggtaacgtccccgggggtaccctacggacccgtagttcgagggtcggacgagggtccgggtctaggggacctagtactttaccactctacaactntcgagccagtccctgacgaggntagaagtgtggtgggattagtttatatagaactaattaattattattacgttacgttcgggtggtaaccggttcggacgtaaacggggttacgtaaagggtaggttaacttacgacgaacgggtaaccgtaacggttcggaggttcttcggaaccgtaacccg

SEQ ID NO: 429521 - DNA, 759 bp, Homo sapiens
  misc_feature: GZ8MTXP01BZVH5.19.71.G05.1.454.CMB.2.raw
  modified_base (253)..(253): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcagaccctctcgctcacctgtcgccagtcgtccgggganagagtcgctagcgactaggttgttcggcttggctacggtggtcacggtcctaacggtccccgaagttcccgggaaggtacggttaccgtaaggtacggggtttcggggaccggttaaggggggaaaaccggtactaaacttttaacgttttccgaaaacgtttaccggttaaccccgaaaacgggtaaacccgggttaaagggtaaaaacctttaaaccgttaaaaacggttttaacgtaccgtaaccctaaccgtacgttacgttagggttaggtaacggtacgtacgtaacgtacgaaactaacgtaacgtaaacgtaacgaacgtaacgtaacgtaaaccgtaaaccgtaacccgttaccgtttaccgtacccgtacgaccgtaccgtacctaccgttacccttcgtacggttaccgtacccgttaccggaacggtaaccgttacgggttacttacgttaagttacgtaagggtacggaaccggaccgtaacccgaagtaacg

SEQ ID NO: 429522 - DNA, 619 bp, Homo sapiens
  misc_feature: GZ8MTXP01DHAVZ.19.71.G05.1.454.CMB.2.raw
  modified_base (238)..(238): a, c, t, g, unknown or other
  modified_base (263)..(263): a, c, t, g, unknown or other
  modified_base (292)..(292): a, c, t, g, unknown or other
  modified_base (315)..(315): a, c, t, g, unknown or other
  modified_base (582)..(582): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgcaagtccagccataattctttanacagttaccaaacaatagaaaactntagcttaggaccagcagagaccaggacancctctaggctagctctatttacngggctatccgtaccgggaactcccggggttcccccagacgtattcgaggtcggcgaacggtcgggtcgtacggggaactacggtacttttccaacctccttacaccctaatacgacgcacgtcctagacgagtacgtagtagtagttgggttagttaacgtttaattttaattaacgttaactaactaaaattaaatttaatttaactttacgttacgttcggtggtaccgttacgggtaaccgaaagggaacgtaaggttagttanacgtaagaacgtaacggacgtgttcgcgttcgtaacg

SEQ ID NO: 429523 - DNA, 663 bp, Homo sapiens
  misc_feature: GZ8MTXP01DACPM.19.71.G05.1.454.CMB.2.raw
  modified_base (227)..(227): a, c, t, g, unknown or other
  modified_base (235)..(235): a, c, t, g, unknown or other
  modified_base (237)..(237): a, c, t, g, unknown or other
  modified_base (245)..(245): a, c, t, g, unknown or other
  modified_base (249)..(249): a, c, t, g, unknown or other
  modified_base (254)..(254): a, c, t, g, unknown or other
  modified_base (257)..(257): a, c, t, g, unknown or other
  modified_base (307)..(307): a, c, t, g, unknown or other
tcagtactctcgtgcacgaccggtgctcgatttagtgtcgtcgcaagagagaggggggaggtacaacaggcaggcaggggcagcaagatggtgttgaagacccaggtcttcatttctctgttgctctggatctctggtgcccacggggacatcgtgatgacccagtctccagactccctggctgtgtcctgtggcgacggcggcacagtcgaactgacagtcagcanatctttananactacaanatanaactntanctagacagacagacgacagacacgcctcgtagctcgtactatatttacgnggactacgtaccggtaacccgggtacgttcccgggtacctacgaccgtattcggaggtcggaacgacgggtccggggttacgtacggggacctaggtttacctttaccgacttccctaaccaaccgtactacgacgaccgtaccgtaccgtacgacgacggacgtacgtaacggtacgtaggttacggggtacgtttagtttaagtttacgttacgttaactaaacttaactttaatttaactttacgttacgttacggttacggttaacggttacggttacggtaacggttaacggtaacggtagttagttacgttacgtaacgtacgtaacgtcggtcgttacgtcgcgtaacg

SEQ ID NO: 429524 - DNA, 592 bp, Homo sapiens
  misc_feature: GZ8MTXP01C9D13.19.71.G05.1.454.CMB.2.raw
  modified_base (209)..(209): a, c, t, g, unknown or other
  modified_base (236)..(236): a, c, t, g, unknown or other
  modified_base (246)..(246): a, c, t, g, unknown or other
  modified_base (250)..(250): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggcttgtgtctcgtgggcgagcgggccacganacgactgacagtcagccatatctttanactatacaanatanaactctagctagacagcaagacgacagacacgcctacgagctcactactacgttacgcgctacgtaccggtaccggtacgtccccggtctcgacgtatcgagtcgcgtacggtcggtactagggactagtactcacttcacactacgagacgcgacgtacgacgacgacgacgtagaagtagtagtacggtacgtttagtttaagttagttacgtaactaacttaattaattattacgttacgttacggtacggtaacggtacggaacggaacggttaacggtaaggtaagttagttacgttacgtaacgtacgtaacgtacgtacgacgtcgaacgtaacg

SEQ ID NO: 429525 - DNA, 591 bp, Homo sapiens
  misc_feature: GZ8MTXP01EFJ53.19.71.G05.1.454.CMB.2.raw
  modified_base (239)..(239): a, c, t, g, unknown or other
  modified_base (250)..(250): a, c, t, g, unknown or other
  modified_base (291)..(291): a, c, t, g, unknown or other
  modified_base (311)..(311): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctcctggctgtgtctcgtgggcgagcgggccacgactacgactgacaagtcagcacatcttanacagtaccaanatacgaaactctagcttgaccagcagacgaccagacagccnctaggctgctctatttacgngacagtcgaccggactccggccctagacgtatcgagtcgcgcggtcgggtcgtacggactagttacttcactcacactacacacgacgacgtcgcgacgacgacgtagaagtagtacggggtaggtagttagtttaagttagttagtaactaattaaattaatttaatttaacgttacgttacggttaacggtacggttaccggtaacggttaacggtaacggtaaggttaggttagttacgtaacgtagtaacgtacgtacgttacgtcgttcgtaacg

SEQ ID NO: 429526 - DNA, 662 bp, Homo sapiens
  misc_feature: GZ8MTXP01BNXTJ.19.71.G05.1.454.CMB.2.raw
  modified_base (244)..(244): a, c, t, g, unknown or other
  modified_base (327)..(327): a, c, t, g, unknown or other
  modified_base (378)..(378): a, c, t, g, unknown or other
  modified_base (396)..(396): a, c, t, g, unknown or other
  modified_base (443)..(443): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtcgcccgacggggacatcgtgatcgacccagtctccagacctcctggctgtgtctcgtgggcgagccgggccacatacaactgacaacgtccagccaactaattcttttanactacgttaccaaacaatacgaaaactcttagcttggtaccagcagacgaccaggacacgcctctaggctgctctatttacgngggtacacgttccgtaacccggggagttccccggggtcccctggaaccgtntttacgaggtcgggaccnggggtcgggtcgtaggggaacaggttactttcacttcctacaacctntacgagctacgcgtcgacgacggacgtagagtcggtggggtacggttactttaagtttattacgttacgtaactaaacgttaatttatttaacttaacgtttacggttcgggtaacgggttacggttaccgggtaaccggttaaacgggtaaccgtaagggttacgttacgttacgaacggtaacggaacggttacgtgggttcgtaaccgttcgaacc

SEQ ID NO: 429527 - DNA, 727 bp, Homo sapiens
  misc_feature: GZ8MTXP01EK9XT.19.71.G05.1.454.CMB.2.raw
  modified_base (222)..(222): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctccacaaggtgtcctgtcacaagtacagctgcagcagtcaggtccaggactggtgaacgccctgcacgaccctntcgctcacctgtcgccagtccgtccggggacagacgtcgcgtagcgactagtgttgcgttggctacgtgggtcacggtcacgtcccagtccggaggacggtctaggaggtggacgtaggggaaggactagttactttcgaaagtacgttaaccaaacgtacggtaagggtaaaacttaacgtaaatttactacgacctaaaccgtaatttcggttaggtttaggaacgtaacggggttacccgtaaaccttagggaaacctaaaacgtaccgtaaaaacgggttaaccaaaccggggtaaactaacgtttaaaacccggggtaaaacgaaaaccccgttacggttttaccccgtccccgttaaagacccgtaacgggtccctttacggaaccccttggttcgttaacggtaccccggttaccgaaaggggtaacccgttacggggttatttacgtaattacggtaaggtacgggaaacgttacccggtaacccttaaggtaaccg

SEQ ID NO: 429528 - DNA, 628 bp, Homo sapiens
  misc_feature: GZ8MTXP01AMJ0W.19.71.G05.1.454.CMB.2.raw
  modified_base (226)..(226): a, c, t, g, unknown or other
  modified_base (235)..(235): a, c, t, g, unknown or other
  modified_base (246)..(246): a, c, t, g, unknown or other
  modified_base (308)..(308): a, c, t, g, unknown or other
  modified_base (369)..(369): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatccaactgcaagtccagccanaatctttanactagtccaanaatgaaaactctagctggtaccagcagagacctaggacagcctctaggctgctcatttacgngctactcgtaccggagtcccgggtctacgacctagttcgaggtggacgacggtcgggtcgngggactagtcttacacttctacactatcagcacgtcctagacgacggcgtaggaaagtgttggtacggggtacgttagttttaattacgttagtactaaacgtaattaactttaacgttaacgttaccgtttcggttaggtaacccggttccggaaccggtaaacggggttacccgtaaacgggttaggttaacgttacgttaccggtaacggtaaccggtaacgttcgggtacgttacgtaaccggttaactaacccg

SEQ ID NO: 429529 - DNA, 589 bp, Homo sapiens
  misc_feature: GZ8MTXP01CEZ25.19.71.G05.1.454.CMB.2.raw
  modified_base (205)..(205): a, c, t, g, unknown or other
  modified_base (223)..(223): a, c, t, g, unknown or other
  modified_base (532)..(532): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtnaagccctgcagacccctntcgctcacctgtcgccatcgtccggggacagagcgctagcgacagtgttgcttggcacgtgggtcaggcacgtccccatcgagaggtctagagtggcgtagggaggacatatttcaagtcgtaaccaaacgtacggtaggaaataactaaagttatagacaccattctaggttagagtagtacgacgtagaacaactaacgaacgtagaacgactatacgaacgaacctacgttacctacccgtgcgtaacgtctacgacccttcgtcgttcggacccgttacccggaacgggtaccgttaccgggttnttacgtaagttacgttaaggtacgggtaacggaccggtaacccccgttaagtaaccg

SEQ ID NO: 429530 - DNA, 653 bp, Homo sapiens
  misc_feature: GZ8MTXP01AOVLA.19.71.G05.1.454.CMB.2.raw
  modified_base (245)..(245): a, c, t, g, unknown or other
  modified_base (332)..(332): a, c, t, g, unknown or other
  modified_base (369)..(369): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctccctggctgtgtctcgtgggcgagccggccaccatcaactgacaagtccagaccataattctttanactacgttaccaaactaatacgaaaactactagcttaggtaccagacagacgaccaggacacgcctacgtagctgctactatttcgnggctacgtcccgtaaccgggacgtcccggggtccccnggacgtattcaggtcgctggcggttcgagggactagtacttaccacgtctacacctactacgacgcacgcctggaccgtaggcctaaggaaagtgtggggtacggtactttagtttaacgttattagaaacctaagttaaatttacgtttaactttaactacgtttcgggtaacggttaacgttccgggaaacccgaagggtaaacccgtaagggttacgttacgttaacgtaacggtaacgtaaccgggttaacgttggttacgggtaaccttcgtaaccccg

SEQ ID NO: 429531 - DNA, 611 bp, Homo sapiens
  misc_feature: GZ8MTXP01D1MIU.19.71.G05.1.454.CMB.2.raw
  modified_base (226)..(226): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcatgcccgtgctgggcctcccacaaggtgtcctgtcacaagtacagctgcagcagtcaggtccaggactggtgaacgccctcgcacgacccctntccgctcacctgtcgccagtccgtccggggacaggagtcgctagcgacagttgttgcttggctacgtgggtcaggcacgtccccagtcgagaggtctaggagtggccgtaggggaagtactattattacattcgtacccaaacgtacggttagaaacttaactaaagtttacacgacctaacctattcgtggttagaaggtacgtacgactagaactaatacaaacgtaaggaacacgtaactacgaaacgtaaccctagttccctacccgtgacctacggtcctcgtaacctcgttcgtaccgaccgttacccggaagggttaaccgttcggggttacttaagttacttaacggtaggtacgggaacgtcccggaacccctaag

SEQ ID NO: 429532 - DNA, 625 bp, Homo sapiens
  misc_feature: GZ8MTXP01DU6HF.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatcgtcgggacagacgcgctagcgactagtgttgcgttggcacgtggtcaggccacgtccccagtcgagaggtctaggagtggcgtacggggaaggactagttatttcaaagttcgtccgaaacacggtagggaaataactaaagttatacgacaacctattcgtagttagagtacgtacgaacgtagaactaaatacaaacgtacgaacgtaacaacgtaaccgaaaacgtaacctaacgtttcctacccgtacgactaacggtccttacgaacccttcgttcgttacggtaacccgttacccggaacggtaaccgttacggggttattaacgttaacgttacgtggtacgggaacggttaccggtaaccccttaagtaaaccg

SEQ ID NO: 429533 - DNA, 660 bp, Homo sapiens
  misc_feature: GZ8MTXP01DFEV9.19.71.G05.1.454.CMB.2.raw
  modified_base (220)..(220): a, c, t, g, unknown or other
  modified_base (240)..(240): a, c, t, g, unknown or other
  modified_base (250)..(250): a, c, t, g, unknown or other
  modified_base (254)..(254): a, c, t, g, unknown or other
  modified_base (261)..(261): a, c, t, g, unknown or other
  modified_base (311)..(311): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctcgtggggcaggccgggccacgatacgacgtnacaagtccgcacattcttanactatacaanatanaactatnctagacagacagacacagacacgcctacgtagctgactactagtttacgnggactacgtaccgacggtacgtccgggtacccctacggacgtgtacgaggtccgggagtcgggtccgggtcgtaacggggaactacggttactttacgacctacctaccgaacctacgtacgacgacgacgtcgtcgacgacgtacgtaagtaagtacgttagggtacggttagtttaacgtttaagtttagttaagttaactaaacttaaattaatttaatttaacgttacgttacggttaacggttacggttaccggtaaccggttaaacggtaaacggtaaggttacgttacgttaacgtaacgtaacgtaacggtaacgtacgttacgtaacgttaacgtaaccg

SEQ ID NO: 429534 - DNA, 654 bp, Homo sapiens
  misc_feature: GZ8MTXP01CCE9D.19.71.G05.1.454.CMB.2.raw
  modified_base (246)..(246): a, c, t, g, unknown or other
  modified_base (337)..(337): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacgatacgaactgacaagtccagccactaattcttttaanactacttaccaaataatacgtaaaactactagcgttacggacagacagacgaccgagacacgtcctacgtagctgtactactactttacgnggacctacgtaccgtaaccgggtacgtcccggggtcccctacggtaccgtatcgaggtcggacgtcgggtcggtacgtaggggactacgtacttcgactcctacactactacagcgtacgtccgtgacgacgacgtagaagtagtacggggtacggtacgttacgtttaagttaacgttacgttaacgtaaattaaacttaatttaattaacgttacgttacggttaacggtacggttacggtacggttaacggtaacggtaacggttagttagttacgtaacgtacgtaacgtacgtagttacgtcgttcgtaacg

SEQ ID NO: 429535 - DNA, 574 bp, Homo sapiens
  misc_feature: GZ8MTXP01EZBXS.19.71.G05.1.454.CMB.2.raw
  modified_base (381)..(381): a, c, t, g, unknown or other
  modified_base (423)..(423): a, c, t, g, unknown or other
  modified_base (523)..(523): a, c, t, g, unknown or other
tcagtactctcgtggcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcacgaccctctcgctcacctgtcgccatcgtccggggacagagtcgctagcgacagtgttgcttggcacgtggtcaggcacgtccccagtcgaggtaggtctagagtggcgtagggaaggactagtatttcaattcgtcccaaagacgtaggaaataactaaattncgcacatctgttagagtagtcgactagacaatacaaacgtanaacgactaagtacgaaacgtaacctacgttcctaccccgtagccaagtccttacgaccctcgtcgttacgaccgttaccggacggtaacgttacgggttnttacttaagtacgttaaggaacggaacggaccggaaccccttaagtaaccg

SEQ ID NO: 429536 - DNA, 604 bp, Homo sapiens
  misc_feature: GZ8MTXP01CC711.19.71.G05.1.454.CMB.2.raw
  modified_base (381)..(381): a, c, t, g, unknown or other
  modified_base (553)..(553): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctggcctccacaaggtgtcctgtcacaagtacagctgcagcagtcaggtccaggactggtgaacgccctcgcacgaccctctcgctcactgtcgccatccgtccggggacagacgtcgctagcgacagtgtgcttggcacgtgggtcaggccacgtccccagtcggagtaggtcgtaggaggtggcgtaggggaaggactatattcaattcgtccaaacgacgtagaataactaaattancgactacctattcgtagttagagtacgtcgacgttagaactaacttacgaaacgtaacgaactaacgtaagtaccgaaacgtaacccctagttccctaccgttacgaccgtagccttacggacccttcgttacggttcgacccgttccggaaacgggtacgttacggggttnttacgttaattacggtgttacgggaacgaccggtaaccccgaagtaaccgg

SEQ ID NO: 429537 - DNA, 656 bp, Homo sapiens
  misc_feature: GZ8MTXP01A1T65.19.71.G05.1.454.CMB.2.raw
  modified_base (316)..(316): a, c, t, g, unknown or other
  modified_base (598)..(598): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctccgctcacctgtcgccatccgtccggggacagacgtcgctagcgacaggtgttgcttggcacgtgggtcaggcacgtccccatcggagnggtctagagtggctggggaagactagttatttcgaattcgtcccaaacgtaccggttagggaaaacttaacgtaaaatttagtacgactaaccctaagttcgttaggttacggaagtaacgttacggaactacggaaactaaattaccgaaacgttacgaacaacaacgttaaccgaaacgtaaccctacgtttccctacccgtaggacctaaggtccgtacggtaaccccttgtacgggttacgtaaccccgttcccggaaagggtccgttaacggggttnttaacttaacgttacgtcgggtaagggaacgttacccgggaaccccttaaggtaaccg

SEQ ID NO: 429538 - DNA, 631 bp, Homo sapiens
  misc_feature: GZ8MTXP01EDUBL.19.71.G05.1.454.CMB.2.raw
  modified_base (205)..(205): a, c, t, g, unknown or other
  modified_base (238)..(238): a, c, t, g, unknown or other
  modified_base (250)..(250): a, c, t, g, unknown or other
  modified_base (586)..(586): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtnaagccctcgcacgaccctctcgcctcactgtcncatccggcgganagcgcgctagcgaactgtgtgtcgttgctaggtcggtacgacggacaccgtacccctagtcggaaggtacggtacgtaggaggtcggacggtaaggggaacgtactatttattacgaaagttaccgtaaccaaacgtacggtaaagtaaactaaacttaaattcgtacacctaactattcgtggttagacgttacggtctaacgtagaactaaatacgtaaacgtacgactaacgttagtaaaccggaaacgtaaccttcgttaccctcgtacgacgacgtccgtactacccgtgtcgttaccgtacccggttaacggagggtaccgttagggttnttaattaaccgtagtggaacggacgacccgtcccttaagtaaccg

SEQ ID NO: 429539 - DNA, 633 bp, Homo sapiens
  misc_feature: GZ8MTXP01CJYMD.19.71.G05.1.454.CMB.2.raw
  modified_base (243)..(243): a, c, t, g, unknown or other
  modified_base (533)..(533): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagacctccctggctgtgtctcgtgggcgagccgggccacatcaactgacaagtccagccaactaattctttaanactagttaccaaataatagaaaactacttagcttaggaccagacagagaaccaggacagcctacctaggctagctactatttaccgtggacctatacccgtaacccgggtaacgtccccgggggtcccctacggaccgtagttaccgaggtcgggctaacggggtccgggtcgtaggggacctacggtaactttccaaccttctaccaactacgtcgaacgcaacgcctgcgtaacggctagaaagtgttgggacgttataagtttattagtcgtaactaattaaatttnttaagttacttaacgttggtaacggtaaccgttcggtaacgacgggtaaacgaggttagattagtaaccgaagaacgtacgtgttcggtcaacggtaacc

SEQ ID NO: 429540 - DNA, 662 bp, Homo sapiens
  misc_feature: GZ8MTXP01DU8D9.19.71.G05.1.454.CMB.2.raw
  modified_base (382)..(382): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaacgccctcgcacgaccctctcgctcacctgtcgccatcgtccggggacagagtcgctagcgacagtgtgcttggcacgtgggtcaggcacgtccccagtcgagaggtctaggagttggcgtaggggaacgactagttatttcagttcgtaccaagtacgtaggaaacttaacgaaattntacggactaccgtaatcgtaggttagagtacgtacgattacgaactaagtacgaaacgttaacgaactaacgtaacgttaccggaaaacgtaaaccccgttagtttaccccgtacccgttagaacccgtacgtccgttaccggtaacccttccggttaacggttaccggttaacccgttacccgggaaagggtaaccggtaacgggggtttacttacgttaacgtttaaccggtgggtaacgggtaaccgaccgggttacccctaagttaaccgtaaccg

SEQ ID NO: 429541 - DNA, 590 bp, Homo sapiens
  misc_feature: GZ8MTXP01B3KKT.19.71.G05.1.454.CMB.2.raw
  modified_base (246)..(246): a, c, t, g, unknown or other
  modified_base (327)..(327): a, c, t, g, unknown or other
  modified_base (359)..(359): a, c, t, g, unknown or other
  modified_base (378)..(378): a, c, t, g, unknown or other
  modified_base (386)..(386): a, c, t, g, unknown or other
  modified_base (448)..(448): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccacgatacgaactgacaagtccagccactaattcttttanactagttaccaaataatagaaaactcttagcttaggaccagcagagaccaggacagcctacgtaggctagctcatttacgnggctataccgtacccggatcccggggtccccncggactatcgagtcggacnggcgggtntgggacaggtactttcaactctcaccatcacgcacgctgcagtcagagtagtcggggtaggnttaatttatattcgtacaaataattacttattacgttacgttcggtaacgtacggttcggaaacccggttaagggtaaccgaaagggttcggaaacttagtaacgaacgaaccggttaacgtgttccgggaattcggtaacc

SEQ ID NO: 429542 - DNA, 593 bp, Homo sapiens
  misc_feature: GZ8MTXP01AMOCB.19.71.G05.1.454.CMB.2.raw
  modified_base (230)..(230): a, c, t, g, unknown or other
  modified_base (241)..(241): a, c, t, g, unknown or other
  modified_base (265)..(265): a, c, t, g, unknown or other
  modified_base (268)..(268): a, c, t, g, unknown or other
  modified_base (320)..(320): a, c, t, g, unknown or other
  modified_base (390)..(390): a, c, t, g, unknown or other
tcagtactctcgtgcacgaccggtgctcgatttagtgtcgtcgcaagagagagggggacaacaggcaggcaggggcagcaagatggtgttgcagacccaggtcttcatttctctgttgctctggatctctggtgcccgacggggacatcgtgatgacccagtctccagactccctggctgtgtctcgtgggcgagccgggccacgatacgaactgacaagtccagccaanaattctttaanacagttaccaaataatgaaaactntanctggaccagcagagaccaggacagcctaccgtaggctgctacagttttacgngggactagtccgtaacccgggtatcccgggggtcctaggacccgtattcgaggtcgaacacggtcgggtntaggggactagtattccacttcctacaccatcagcagtcctgacagggactagaagtagtgggtacggggtactaaggttttattaacttgtaaacctaaataattaagttattagtaccgttgtggtaacgtcggaccggaaggaccgtaagggtgattacgttacaacgacgtaacgttaggcgttacgtcgaaccgtaag

SEQ ID NO: 429543 - DNA, 619 bp, Homo sapiens
  misc_feature: GZ8MTXP01B5JPG.19.71.G05.1.454.CMB.2.raw
  modified_base (240)..(240): a, c, t, g, unknown or other
  modified_base (326)..(326): a, c, t, g, unknown or other
  modified_base (391)..(391): a, c, t, g, unknown or other
  modified_base (446)..(446): a, c, t, g, unknown or other
  modified_base (457)..(457): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgagccggccacatcaactgcaagtccagccataattctttaanactattaccaaataatacgaaaactcttagcttaggtaccagcaagacaccaggacagcctaccgtaggctgctactagtttacgngggactacgtccgtaacccggggagtccccggggtaccccctaggacgtaattcgacggtggacncgggcgggtcgtagggacctagtacttcactctaccacatcagcacgctgaccgngtacagaaagngttggggtagtctttaagtttattagttagtaccaaattaattatttaagttattaaccgtggttaacggtaaccgttacggaccgaaagggtaaaccgtaagggttagttattaacgtcgaaaggtaacgtaaacgtcggttacggtcgttaaccgaaccg

SEQ ID NO: 429544 - DNA, 640 bp, Homo sapiens
  misc_feature: GZ8MTXP01CKLST.19.71.G05.1.454.CMB.2.raw
  modified_base (316)..(316): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctggcctccacaaggtgtcctgtcacaagtacagctgcagcagtcaggtccagcactggtgaagccctgccagaccctctcgctcacctgtgccatccgtccggggacagacgtcgctagcgacagtgttgcttggcacgtgggtcaggcacgtccccagtcgagaggtctaggngtggccgtaggggaaggactagttattacatcgacccaaacgacgttaggaaacttaacaaatttatacgactaaccctagttccttaggttggaagtacggttacgaacttaggaacaaatacgaaacggttaagaacaactaacgttaaccggaaacgaacccgtagtttccctaccccgttggaccctagtccttcggaaccttcgttaggttaccgacccgttaccccggaagggttaccccgttgggggtttacttaacgtttaacgtttaaccggtgggtaccggggttaaaacggtccccgggaacccccttaaagg

SEQ ID NO: 429545 - DNA, 595 bp, Homo sapiens
  misc_feature: GZ8MTXP01CC7QG.19.71.G05.1.454.CMB.2.raw
  modified_base (225)..(225): a, c, t, g, unknown or other
  modified_base (234)..(234): a, c, t, g, unknown or other
  modified_base (237)..(237): a, c, t, g, unknown or other
  modified_base (242)..(242): a, c, t, g, unknown or other
  modified_base (253)..(253): a, c, t, g, unknown or other
  modified_base (259)..(259): a, c, t, g, unknown or other
  modified_base (261)..(261): a, c, t, g, unknown or other
  modified_base (265)..(265): a, c, t, g, unknown or other
  modified_base (274)..(274): a, c, t, g, unknown or other
  modified_base (283)..(283): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccaggggacatcgtgatgacccagtctccagactccctggctgtgtctctgggcagcgggcacatcaactgcaagtcagccanaatctttanacntcaanatagaatatantgacananaganacagacacnctctagctnctactattacgtggacactacgtaccggtacgtccccggtccgtacgacgtactcaagtcgcgacgtcgggtcgtggacgtagtacttctactctacacactacacgacgacgtactacgacgacgtacgtagaagtaaggtaggtaggtacgttaagttttaagtttaagttacgttaactaaaactaaacttaaatttaaatttaacttaactttaacgttacggttacggttacggttaccgtaaacggtaacgaaacggttaggttaagtaatacgtaacgaacgtaacgttacgtcggttcgtaacg

SEQ ID NO: 429546 - DNA, 634 bp, Homo sapiens
  misc_feature: GZ8MTXP01DVA39.19.71.G05.1.454.CMB.2.raw
  modified_base (385)..(385): a, c, t, g, unknown or other
  modified_base (554)..(554): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatcgtaccggggacagacgtcgctagcgacagtgtgcttggcagtggtcaggcacgtccccagtcgagaggtctaggacgtggcgtggggaaggtactagtactttcgaattcgtaacaaacgtacggtagaaatacaaatttanacgactacgtatctgttgagtacgtacgactagaacaaatcgaacgtacgaacaacacgtacgaaacgtaaacctcgtttacctcccgtagcctaacgtcctacggtaacccctgtttacggacgtaaccccgttccgggaaacgggtacccgttaaaccgggggtttnttaaacctttaacgggttttaaaccgtggggttaaacgggaacccgggaacccggtaacccccgttaaagtttaacccgg

SEQ ID NO: 429547 - DNA, 559 bp, Homo sapiens
  misc_feature: GZ8MTXP01AKNRQ.19.71.G05.1.454.CMB.2.raw
  modified_base (229)..(229): a, c, t, g, unknown or other
  modified_base (240)..(240): a, c, t, g, unknown or other
  modified_base (318)..(318): a, c, t, g, unknown or other
  modified_base (351)..(351): a, c, t, g, unknown or other
  modified_base (365)..(365): a, c, t, g, unknown or other
  modified_base (448)..(448): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgcaagtccagccaanaattcttttanacagttccaaacaatagaaaactctagcttaggaccagcagacgaccaggacagccctccgtaggctgctctatttcngggctagtccgtaaccgggatccggggtccccngaccgatcagtgcnggcgggtctgggactagtctttcgactctcacatcagctacgcctgacgagctagaagtgtaggggtgactagtttattagtntacaaatatattattatacttggtaaggtaccgttacgggacccttaaaggggaacctaagggttgaagttactaagaacgtaacggtaactggttacgtcgttcgaaccg

SEQ ID NO: 429548 - DNA, 650 bp, Homo sapiens
  misc_feature: GZ8MTXP01BS1Q3.19.71.G05.1.454.CMB.2.raw
  modified_base (237)..(237): a, c, t, g, unknown or other
  modified_base (248)..(248): a, c, t, g, unknown or other
  modified_base (311)..(311): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacatcaactgacaagtccagccatattctttanacataccaaanatagaaaactctagctagaccagcagagaccaggacagcctcgaggctgcttctagtttacgngggactacgtccgtaacccggggtaacgtcccggggtcctacgaccggtattcgaggtcggacgacgggtcgggtcgtaggggacagtactttcacttctaccacactcgacgcagtcccgtgaccgagggtctaggaaacgtgttgggtacgggtactttaaaggttttaattaggtttacgtaacctaaattaaatttaactttaagtttaacgttaccgtttacggtacgggttaaccggttacgggaaccggtaaacgggttaccgtaaaggggttgaacttaggacgtaaggtaaccggtaacgttggtcgggacttaacggaaccgttaaccg

SEQ ID NO: 429549 - DNA, 588 bp, Homo sapiens
  misc_feature: GZ8MTXP01A2OZP.19.71.G05.1.454.CMB.2.raw
  modified_base (242)..(242): a, c, t, g, unknown or other
  modified_base (323)..(323): a, c, t, g, unknown or other
  modified_base (394)..(394): a, c, t, g, unknown or other
  modified_base (464)..(464): a, c, t, g, unknown or other
  modified_base (574)..(574): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgccccacggggacatcgtgatgacccagtctccagacctccctggctgtgtctcgtgggcgagccgggccaccatcaactgcaagtccagccactaatctttanacagttccaaacaatagaaaactacttagcttaggtaccagcagacgaccaggacagcctctaggctgctctatttaccgngggcctacgttccgtaaccccggggaatccccgggggtccccctaggaccgagttccgaggtcgggacccngggccggggttctaggggacctaggtactttcactcctacacccatccagccagcctgcaggctagaagntgggtggacttagtttatatcgaactaataattattattataccgttggtcggtacgttccggaccaaaggggtaccaagggttcgattacgaaccgagaaccgtatggngtaaccttgaaccc

SEQ ID NO: 429550 - DNA, 601 bp, Homo sapiens
  misc_feature: GZ8MTXP01C4GR8.19.71.G05.1.454.CMB.2.raw
  modified_base (242)..(242): a, c, t, g, unknown or other
  modified_base (322)..(322): a, c, t, g, unknown or other
  modified_base (370)..(370): a, c, t, g, unknown or other
  modified_base (378)..(378): a, c, t, g, unknown or other
  modified_base (387)..(387): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagccgggccacatcaactgacaagtccagccataattctttanacagttaccaaacaatagaaaactacttagcttaggtaccagcagacgaccagacacgcctctaggctgctcatttacgnggctagtccgtaccggagtcccgggtcccctgacgtatcgagtcggcnggcggtcngggacagtnttcactctacacatcagcacgctgcgtaggctagaagtagtggggtcggtactttaaggtttacttagttacgtaacctaaattaaattatttaacgttaattaccgtttcggtaacggttaacggttacgggaacccgttaaaggggtaacccgtaaggttcggttattacgtaacgaacgtaacgtaacgtgggttcgtcgttcgtaacccg

SEQ ID NO: 429551 - DNA, 564 bp, Homo sapiens
  misc_feature: GZ8MTXP01A3K2V.19.71.G05.1.454.CMB.2.raw
  modified_base (453)..(453): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatcgtccggggacagagtcgctagcgacagtgttgcttggcacgtgggtcaggcacgtccccatcgagaggtctaggagtggcgtagggaacggactatatttcaattcgtacccaacgtacgtaggaaattaactaaatttatacgactacctatctgttgagagtacgactagacaatacaacgtagacacgatacgaaacgaacctagttccnccgtgcagtctagacctcgtgtcgaccgtcccggaggtaccgtacgggttacgttattacgtttaacgtaggttaacgggaacgtaccgggacccctaagttaacgtaacg

SEQ ID NO: 429552 - DNA, 539 bp, Homo sapiens
  misc_feature: GZ8MTXP01DV2O0.19.71.G05.1.454.CMB.2.raw
  modified_base (470)..(470): a, c, t, g, unknown or other
tcagtactctcgtgcacgaccggtgctcgatttagtgtcgtcgcaagagagagggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatctccggggacagagtcgctagcgacagtgttgcttggcacgtgggtcaggcagtccccatcgagagtctagagtggctaggggaaggacatatttcaaattcgtccaaacacgtaggaatacaaattatgacacatctagttgagagtcgactgacaatacaaacgtagaacgaacaagttaccgaaacgaaccctacgttcctaccctcgcgtagctcgaccttctgngtaccgttccgacggacgttacgggttgttactaattactgtagggaacgacggtaaccccaagtaacg

SEQ ID NO: 429553 - DNA, 649 bp, Homo sapiens
  misc_feature: GZ8MTXP01BDDNS.19.71.G05.1.454.CMB.2.raw
  modified_base (365)..(365): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatcgtccggggacagagtcgctagcgacagtgttgcttggcacgtgggtcaggctacgtccccatcggagaggtctaggagtggcgtagggaaggactattatttcagtcggtaccaaacgacgtaggtaaactaacgtaaattacgngacctaaacctattccgttaggttacggaaggtacgtaccggaacttacgaaactaaagtacaaacggtacgaaacaacaaaggttaaccgaaaacggtaacctacggttaccctccgtacgactaacggtccttacgtacccgttcgtacgtacgaaccgtcccgggaacggtaccggtacgggttagttaacttacgttacggtggtaacgggaacggccggaccctaagaacgacgttacgcaaccctacgttcgtctacggttcgttcgttcgttaacgg

SEQ ID NO: 429554 - DNA, 564 bp, Homo sapiens
  misc_feature: GZ8MTXP01B3E1S.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccctcgcagacccctctcgctcacctgtgccatcgtccgggggacaggagtcgctagcgacagtgttgcttggcacgtgggtcaggcacgtccccatcgagaggtctaggagtggcgtgggaacggacagttatttcattcgtaccaacgacggtaggaaactaactaaatttatgaccactatctgttagagtagtacgactagacaatacaacgtagactacatacgaaacgacctacgttcctacccgtgaccagtcctacgtaccttcgtgtcggaccgtcccggaagggaccgtacggggttgttattagttaacgtgggtaaggaacggcggacccctaagttaacgtaac

SEQ ID NO: 429555 - DNA, 698 bp, Homo sapiens
  misc_feature: GZ8MTXP01ACXL8.19.71.G05.1.454.CMB.2.raw
  modified_base (132)..(132): a, c, t, g, unknown or other
  modified_base (353)..(353): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccccccanaaggtgtcctgtcacaagtacagctgcagcagtcaggtccaggactggtgaagccctgcagaccctctcgctcacctgtgccatccgtccggggacagagtcgctagcgacagtgtgcttggcactgggcaggcacgtcccatcgagaggtctagagtgcgtagggaagacattatttccgatcgtaccaaacgtacggtaggaaacttaaccaaaatttntacggaccaaccctaaattcgttgttacgaagggtaagttccgaacttggaaactaaacgtactaaacgtaacggaacgaactaacttacgaaacggtaaacccgtaacgtttaccctaccccgttagaccgaacggtccttacggggtaacccttccgttacgtaccgtacccgtacccggaacggtaaccggtaaccggggttacgttaagttaacgtttaccgtaggttaacgggtaaacgggttaccgggaccccccttaagttaaaccggaacttacgttccgaccccgtaacccgttccggtccgttcgttcggttacgtccgttaagtttaaccgggg

SEQ ID NO: 429556 - DNA, 673 bp, Homo sapiens
  misc_feature: GZ8MTXP01CC14E.19.71.G05.1.454.CMB.2.raw
  modified_base (249)..(249): a, c, t, g, unknown or other
  modified_base (333)..(333): a, c, t, g, unknown or other
  modified_base (402)..(402): a, c, t, g, unknown or other
  modified_base (469)..(469): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctcccgtggctgtgtctcgtgggcgaggccgggccaccatccaactgacaacgtccagccactaattctttanactagttaccaaacaatagaaaactacttagcttaggaccagcagacgaccaggacacgcctacgtaggctgctctatttacgngggactacgtaccggtacccggggacgttccccggggtcccctacggaccgtatccgaggttcgggcgngggtcgggtcgtaggggacagttactttacaccttaccgtccaacctactcgaacgtcaccgtccgnggacgaggtacgtaggaagtagtaggggtacgttacgtttagtttaacttagttacgtaactaaacttaatttactttaagtttacgttacgttacgggttaacgggtaaccggttaccgggaaaccggttaaagggtaaaccgtagggttacgttattacgtaacgaacgtaacgtacggtcggttacgtcgttaacgtaacc

SEQ ID NO: 429557 - DNA, 599 bp, Homo sapiens
  misc_feature: GZ8MTXP01B1HJ9.19.71.G05.1.454.CMB.2.raw
  modified_base (394)..(394): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctggacctcccacaaggtgtcctgtcacaagtacagctgcagcagtcaggtccaggactggtgaacgccctcgcacgaccctctcgctcacctgtcgccagtccgtccggggacagagtcgctagcgacagtgttcgcttggctacgtgggtcaggcacgtccccagtcgagtacggtctaggaggtggcgtaggggaaggactagttattcaagttcgtccaaacgacggtaggaaactaacgtaaattanacgacactatcgtgttaggagtacgtacgactagaacaatacgaaacgtaacgaacaacaacgtaaccgaaacgtaaccctacgttccctcccgtacgacctacgtcctcgtacctcgtcggttcgtacccgttcccggaacggtacgttacgggttgttacgttaacttacgtggtacggacgaccggtaaccccaagtaaccg

SEQ ID NO: 429558 - DNA, 641 bp, Homo sapiens
  misc_feature: GZ8MTXP01BHEWA.19.71.G05.1.454.CMB.2.raw
  modified_base (584)..(584): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctccacaaggtgtcctgtcacaagtacagatgcagcagtcaggtccaggactggtgaacgccctcgcacgaccctctcgctcacctgtcgccagtccgtaccggggacaggacgtcgcgtagcgacaggttgttgcgttggcacgtggtcaggcacgtccccagtcgagtaggtctaggagtggcgtaggggaaggtactattatttcaattacgtccaaacgtacgtaaggaaacttaactaaagttactacgactaacctagttacgttggtttaggaaggtaacggtaccggtaactacgaaactaacgtaacgtaaacgtacgaaccaacgtaacgttaaccgaaacgtaaccgtacgttaccctaccctcggactacggtcctaccggtactccgtgttccgtaccgttccggaacggacgttacggggttnttaacggttcgttacggtcgttacggggaacgttacccgggtccccttaagtaaccg

SEQ ID NO: 429559 - DNA, 618 bp, Homo sapiens
  misc_feature: GZ8MTXP01D33F8.19.71.G05.1.454.CMB.2.raw
  modified_base (233)..(233): a, c, t, g, unknown or other
  modified_base (243)..(243): a, c, t, g, unknown or other
  modified_base (257)..(257): a, c, t, g, unknown or other
  modified_base (326)..(326): a, c, t, g, unknown or other
  modified_base (445)..(445): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccacgatcgaactgacaagtccagccanaattctttanacacgttaccaaanaatagaaactacttagcttaggtaccagcagagaccaggacacgcctctaggctagctcagttttacgnggctagtcccgtaacccggggagtcccccggggtaccccctggaccgtagtttccgaggttcgggactaagggccgggttcgtcggggaactaggtactttccgaactcctacacctanacgagcacgcagcgagacgtagaagtgtggggtacgtactttagtttattactagtaactaaattaattacttatttacgttacgttcggtaacggttacggttacggacggaaacggtacggtaaggttagttaattacgaagacgtaacgtacgtgttaggtcgttcgaac

SEQ ID NO: 429560 - DNA, 766 bp, Homo sapiens
  misc_feature: GZ8MTXP01BCK3B.19.71.G05.1.454.CMB.2.raw
  modified_base (248)..(248): a, c, t, g, unknown or other
  modified_base (343)..(343): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtcctccagacctccctggctgtgtctcgtgggcgagccggccaccatcaactgacaagtccagccaactaattcttttaanactacgttaccaaactaatacgaaaactacttagcttacggaaccagacaagacgaccgaggacacgtccctacgtaggctgctactatttacgnggacacgtccggtaacccgggtacgtccccggggtacccctacggtaaccgtagttccgaaggtcgggaccgtaacggggtccgggggttaccgtacgggggaactacggttactttccgaacccttcctaccaacctatcgaacggtccaacggtccctacggaccgaacgggtaccgtaaggtaaaggtacggttcgggggtagggttaccgtttaaaggtttttaactttaagtttaacggtaaaccttaaactttaaaattttaattttaaacgtttaactttaaccgtttccgggtaaacggggttacccggtttaccggggaaacgttaaacgggggtaaccgtaaagggttacggttaattaacgtaacgtaaacggtaaccggttaagtgggttacggtaaccgttcgtaacccg

SEQ ID NO: 429561 - DNA, 682 bp, Homo sapiens
  misc_feature: GZ8MTXP01CTWJU.19.71.G05.1.454.CMB.2.raw
  modified_base (621)..(621): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtcgtccggggacagacgtcgctagcgacgagtgtcgcttggcacgtggtcaggcacgtccccagtcgagaggtctaggaggtggacgtaggggaaggtactattacgttcaaacttcgtaacccaaacgtaccgtaaggaaactaactaaattacgtacgaccctaaccgtaattccgttaggttaacggaacggtagtttacccgaaagttacggaaaacctaaacgtaccgtaaaaacggttacgaaacctaacgtaacgttaaccgaaaacggtaaacctaccggttccctacccgtacggacctaacgtccttaccggaaccttcgtaacgttacggtacccgaccggggtaaaggtacccgttaacggggttnttaacgttaacgttcggaacggttaacgggaacgttacccggaaccccttaagtaaacccg

SEQ ID NO: 429562 - DNA, 707 bp, Homo sapiens
  misc_feature: GZ8MTXP01CZS0K.19.71.G05.1.454.CMB.2.raw
  modified_base (244)..(244): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctcccgtggctgtgtctcgtgggcgagcgggccacatcaactgacaagtccagccactaattctttanactacttaccaaactaatagaaaacttacttagcttaggtaaccagcaagacgaccaggacacgccctaccgtaggctagtctactattttacgtgggacctacgttacccggtaacccggggacttcccccgggggtaccccctacggaccgtagttccgaggtcggacgaacgggtccgggtacgtaggggactaggtactttaccgaccttctaccaacctaatccgaaggccaacgtcccgtaggaccgaggacctaggaaagtacgttggggggttcgtagtttaagtttttacttagttacttaacctaaattaaatttaatttaacttaagttacccgtttgggttaacggtaccggtttaccgggaaccggaaacgggtaaacccgtaagggttacgggttaacttagtaacggtaagtaaccggtaaacggtggttacgggtcttaaccggtcc

SEQ ID NO: 429563 - DNA, 568 bp, Homo sapiens
  misc_feature: GZ8MTXP01AZMQN.19.71.G05.1.454.CMB.2.raw
  modified_base (239)..(239): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanacagttaccaaacaatagaaaactacttagcttggtaccagcagagaccaggacagccctccgtaggctagctctatttactgggcatctacgacgggtaactcccccgggggtccctagacccgattcgaaagtcggcgtaacgggtctaggggactagtactttcactctcaccatcagcacgctgcgagctagaagatgggtggtacttagtttattattcgtactaaactaattattattatacgttcggtggtacgttcggacgaagggaccgtaagggttggacttacgtcgagaacgtacgtggttacggtcttcggtaacc

SEQ ID NO: 429564 - DNA, 635 bp, Homo sapiens
  misc_feature: GZ8MTXP01EQKOL.19.71.G05.1.454.CMB.2.raw
  modified_base (224)..(224): a, c, t, g, unknown or other
  modified_base (294)..(294): a, c, t, g, unknown or other
  modified_base (393)..(393): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgcccctcgcagacccctntcgctcacctgcgccatcgtccggggacagacgtcgctagcgactagtgttgcgttggctacgtgggtcnggcacgtccccagtcggagaggtctaggagtggcgtagggaacggactagtatttcataacgtaccaacgtacggtaggaaacttaaactaaagtttanacgacctacctattctggtagagtagtacgtactagacaaagtaccgaaacgtagaacaacgtaacgtacgaaacgtaacctaacgttccctacccgtgaccgtagtccgttacgtaccctcgtcggttacgttaaccccggtacccggttaacgggtaccggttaacgggtttagttaacgttacgtttaacgtagggttaacgggaacggtaccgggaaccccctaagttaacgtaaccg

SEQ ID NO: 429565 - DNA, 579 bp, Homo sapiens
  misc_feature: GZ8MTXP01EP26K.19.71.G05.1.454.CMB.2.raw
  modified_base (239)..(239): a, c, t, g, unknown or other
  modified_base (318)..(318): a, c, t, g, unknown or other
  modified_base (366)..(366): a, c, t, g, unknown or other
  modified_base (427)..(427): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaatcttttanacagttaccaacaatagaaaactactagcttggtaccagcaagagaccaggacagcctacgtagctgctactatttacnggtcatcgtacccgggatcccggggtcccctcgacgattcagtcgcgnggcgggtctaggggacagtacttcactctacacatcagcacgcctagccaggctagaaagngtggggtaggtacttaagtttattattcgtaactaaattaaattattatttaacttacgtttggtaacggtacgttcgggaaccgttaagggaacgtaagggttggttattagtaacgaaggaaccgtaacgtgggttagtaacttcgaacc

SEQ ID NO: 429566 - DNA, 571 bp, Homo sapiens
  misc_feature: GZ8MTXP01BYLIM.19.71.G05.1.454.CMB.2.raw
  modified_base (236)..(236): a, c, t, g, unknown or other
  modified_base (245)..(245): a, c, t, g, unknown or other
  modified_base (249)..(249): a, c, t, g, unknown or other
  modified_base (255)..(255): a, c, t, g, unknown or other
  modified_base (258)..(258): a, c, t, g, unknown or other
  modified_base (277)..(277): a, c, t, g, unknown or other
  modified_base (301)..(301): a, c, t, g, unknown or other
  modified_base (342)..(342): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcaactgcaagtccagccacaatcttttaanacatacaanatanaaactntanctgacagcagagacagacncgcctcgagctgctctatttacgnggcacgtaccgtaccggacgtcccggggtcctacgaccgtnttacgagtcggacagggtcggtcgtacgggactagtactttacgacttcctaccgaccagtcacgcgacgccgtgacgaggcgtagaagtagttgtacggggtacttagtttaacttagttacgtaactaaactaattaagtttattaacttacgttcgtaggtaacgttcggacgtaaacgggacgtaagggtgacgttagcaagacgaacgtgtgttcgtcgcgtcg

SEQ ID NO: 429567 - DNA, 567 bp, Homo sapiens
  misc_feature: GZ8MTXP01CJ8Z0.19.71.G05.1.454.CMB.2.raw
  modified_base (227)..(227): a, c, t, g, unknown or other
  modified_base (235)..(235): a, c, t, g, unknown or other
  modified_base (245)..(245): a, c, t, g, unknown or other
  modified_base (249)..(249): a, c, t, g, unknown or other
  modified_base (304)..(304): a, c, t, g, unknown or other
  modified_base (336)..(336): a, c, t, g, unknown or other
  modified_base (348)..(348): a, c, t, g, unknown or other
  modified_base (358)..(358): a, c, t, g, unknown or other
  modified_base (553)..(553): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctcagactccctggctgtgtctcgtgggcgagcgggccacatcaactgacaagtccagccanatctttanactatacaanatanaaactctagctagacagcagacgacagacacgcctcgagctgctactatttacgnggctatccgaaccggactccggtcccagactntcgaggtcgcgnggcgggtcgngggacagtacttcactctacacagtacgagcacgctgacgagtctagaagtcgttaggggtgtacttagtttaattattacgaactaaattaattactttaagttacttacggtttcggtaacggtaccggttacggaaaccgttaaaggggtaacctaagggttagacttacgtcgaagtaaccgtagttcggngtaaccgttgaacc

SEQ ID NO: 429568 - DNA, 543 bp, Homo sapiens
  misc_feature: GZ8MTXP01DIEOW.19.71.G05.1.454.CMB.2.raw
  modified_base (242)..(242): a, c, t, g, unknown or other
  modified_base (254)..(254): a, c, t, g, unknown or other
  modified_base (315)..(315): a, c, t, g, unknown or other
  modified_base (419)..(419): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgacaagtccagccactaatcttttaanacagttccaaanaatagaaaactctagcttggtaccagcagagacaggacagcctctaggctgctcatttacngggcactccgtacccggggaatccccccgggggtccctagacccgtattcgaaggtggcgaggtccgggtctaggggaccagtacttcactctacaccatcacncacgcctgacagctagagagtgtgtactagtttattatgtacaaatattattattatacttcgtggttacgttcggacgtaagggaccgaaggttggataatacgaagacgtacttgtgcgtcg

SEQ ID NO: 429569 - DNA, 527 bp, Homo sapiens
  misc_feature: GZ8MTXP01EO48M.19.71.G05.1.454.CMB.2.raw
  modified_base (222)..(222): a, c, t, g, unknown or other
  modified_base (305)..(305): a, c, t, g, unknown or other
  modified_base (312)..(312): a, c, t, g, unknown or other
  modified_base (339)..(339): a, c, t, g, unknown or other
  modified_base (354)..(354): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctntcgctcacctgtcgccatcgtccggggacagagtcgctagcgacagtgttgcttggcacgtggtcaggcagtccccatcgagngtctagngtgctaggagacatattcaatcgtcanacgtgaatacaaatnagcactatctagtgagtagtcgatgaactaatacaaacgtagaactacgaattaaccgaataaccgcgttcctccctaggctagtctacggaccctcgtcgttacgaccgttccgaaggacttacgggttcttagttaacttacgtgtaggaacgacggccccttaagtaacg

SEQ ID NO: 429570 - DNA, 690 bp, Homo sapiens
  misc_feature: GZ8MTXP01B1C1Q.19.71.G05.1.454.CMB.2.raw
  modified_base (316)..(316): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgaccctctcgctcacctgtcgccagtccgtccggggacaggagtcgcgtagcgacagtgttgcgttggcacgtgggtcaggcacgtccccagtcgaggnggtctaggaggtggcgtaggggaacggtactagttacttacgaagttcgtaacccgaaacgtacggtagggtaaaacttaaccgtaaaatttacgtacgacctaaccttattacgttaggttaggaagtacggttacgaacgttagaaacaaacgtaccgaaacgttaacgaacctaaacgtaacgttaaaccggaaaacggtaacccttacggttaccctacccgtacgtaccgaacggtccttaaccgtacccgttcgtaacgggttccgtaacccgttaccgggaaacgggtaccgttacgggggttacttacgttaagttacggtaacgggttaacgggaacggacccggtaaccccgttaagtaaccgg

SEQ ID NO: 429571 - DNA, 660 bp, Homo sapiens
  misc_feature: GZ8MTXP01BM7WP.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactgggtcgaacgccctcgcacgaccctctcgctcacctgtcgccagtcgtccggggacagacgtcgctagcgactagtgttcgcgttggctacgtcggggtcacggctacgtccccagtcggaggtacgtcgtaggaggtggacgtagggaacgactagttacttcgatacgtaccaacgtacgtagggaaactaacgtaaattacgtcgacaccagttcgtgttacgagtacggtacgaaccttgaaactaatacgtaaacgtacgaacctaacgaaggtaaccgaaacgtaaccccgtagtttccctaccccgtagtaccgtaacgtccgttaaccgtcccgttcgtaacggtacttacccgggtaaccggacgggtaaaccgttacgggggttattacgttaacgttttaacgacgggttaacgggaaccggtaccgaccccgtaagttaaccggtaaccg

SEQ ID NO: 429572 - DNA, 697 bp, Homo sapiens
  misc_feature: GZ8MTXP01AXYF8.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtgtcctgtcacaagtcagctgcagcagtcaggtccaggactggtgaacgccctgcacgaccctctcgctcacctgtcgccacgtcgtccggggacagagtcgctagcgaactggtgttcgcgttggactacgtcgggtacacgggtcctaacgtcccccgagttcggaacggtaggttaccgtaggacggtgggacggtagggggaaacggtactagttaactttacgaaacttcgtaacccgaaacggtacgtaaggaaacttaactaaaagttactacgtacctaaaccgtagttacgttagggttaaggaacggttaacgggtaccgtaatacggaaacgtaaacttacaaaagttacgaaactaaccgaaagttaccgaaaacgtacctacgttaccctaccgtagacctacggtacctaaccgtcccgtaacgttacggttaccgaaacccggttccgggaaacggtacggttaacggtttagttaacttaagttcgtaagggtaacgaacggaccgttaacccaaggtaaccg

SEQ ID NO: 429573 - DNA, 680 bp, Homo sapiens
  misc_feature: GZ8MTXP01ADTNK.19.71.G05.1.454.CMB.2.raw
  modified_base (243)..(243): a, c, t, g, unknown or other
  modified_base (254)..(254): a, c, t, g, unknown or other
  modified_base (318)..(318): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgaggccggccacatacaactgcaagtccagccataattctttanacattaccaanaatagaaactatagcttaggaccagcagacgacgagacagcctcgaggctgctctagtttacgnggctacgtccgtaacccgggaacgtcccggggtacccctggaccgtagttccgaggtcggccgaagggtccggggtcgagggactagttacttccgacctactaccaaccacgtacgaacgcctaacgtcccgtggacgtacgggtacctaaggtaaagtgttacgggggtagtaccgtttaaagttttattaagttacgtaacctaaattaaattttaatttaacgttaacgtttaaccggtttcgggtaacggttaaccgggtttaccggaaaccggttaaacgggtaaccgtaagggttacggttattaacgtaacggaaggtaacccgtaacgtgggttacgtcccttgggtaacccc

SEQ ID NO: 429574 - DNA, 658 bp, Homo sapiens
  misc_feature: GZ8MTXP01B268B.19.71.G05.1.454.CMB.2.raw
  modified_base (248)..(248): a, c, t, g, unknown or other
  modified_base (341)..(341): a, c, t, g, unknown or other
  modified_base (604)..(604): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctcccgtggctgtgtctcgtgggcgagccgggccacatacaactgacaagtccagccaataattctttaanactagttaccaaataatacgaaaactctagcttaggaccagcaagacgaaccgaggacacgccctaccgtaggcctgtcttactatttaccgnggacctacgttacccggtaacccggggaacgttccccgggggtacccccctaggaccgtattccgaggtcggaccgtgggtcgggtacgtagggactagttacttccactctacaccatacacgacacgccgtagacgagacgtagaagtcgtggtaggtactttaagtttatattcgtaaactaattaaatttattaactttacgttacgttcggtaacgggtaccggttacgggaaccgttaaagggtaccgtaagggttnttaacgttaacgtccgaaaggaaccgttaacggtggttaccgtcgttaacgaac

SEQ ID NO: 429575 - DNA, 749 bp, Homo sapiens
  misc_feature: GZ8MTXP01CTA4I.19.71.G05.1.454.CMB.2.raw
  modified_base (246)..(246): a, c, t, g, unknown or other
  modified_base (260)..(260): a, c, t, g, unknown or other
  modified_base (302)..(302): a, c, t, g, unknown or other
  modified_base (330)..(330): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgaggccgggccacatcaactgacaagtccagccaactaattctttanactagttaccaaanatagaaaactcttagcttaggaccagacagacgaccaggacncgcctcgtaggctgctactagtttacgnggactacgttacccgtaacccggggtagttcccccgggggtccccctacggaaccgtatttccgaagggttcgggacctaaggggccggggttaccgtaggggaactaggttactttccaaccttcctaccaaccctataccgaaggtcccaacgtcccgtaggaccgaacgggtactaaggaaacggtgtttacgggggtacgggtaacttttaaggttttaaacttagtttaaccggtaacctaaaacgttaaatttatttaacctttaacgttaccgtttcggggtaacggttaacccgggttaccgggaaaccggttaaacggggttaacccgtaaggggttacggttaaaccttaagtaacccggaaagggtaacccgtaagggttcgggttacgggaacccttcggtaacccc

SEQ ID NO: 429576 - DNA, 710 bp, Homo sapiens
  misc_feature: GZ8MTXP01B6IMN.19.71.G05.1.454.CMB.2.raw
  modified_base (238)..(238): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgaccctctcgctcacctgtcncatcgtcgggacagacgtcgctagcgacagtgttgcttggcacgtgggtcaggccacgtccccagtcgagtacggtctaggaggtggcgtaaggggaaggtactaagttactttacgaaacgttacgtaacccgaaacgtaacgggttaacgggtaaaacttaaacctaaaagtttacacggtacctaacccgtaattcgttaggttaggaaggtacggttaccgtaacgttacggaaacctaaagtacccgtaaaacggttaaccgaaacctaaacgtaacgttaaacccggaaaacggtaaacccttacggtttacccctacccgtaggtacctacggtccttaccgtacccgttcgtacggttaccgtaacccgttccccggtaaagggtaaccggttacggggttattaacgttaacgttaccggtaaggtaacgggaacgttacccgggtaaccccttaagtaaccg

SEQ ID NO: 429577 - DNA, 714 bp, Homo sapiens
  misc_feature: GZ8MTXP01DELEU.19.71.G05.1.454.CMB.2.raw
tcagtactctcgtgcacgaccggtgctcgatttagtgtcgtcgcaagagagagggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccatcgagaggtctagagtggcgtaggggaaggactagtttatttcgattcggtaccaaactacggtagggtaaaacttaacgtaaaatttagtacgacctaaaccctattcgttaggtttaggaaagtacgggtaccgtaacgttacgaaacaaagttaccgaaaacggttaaggaaacctaaacctaaagtaaccgaaaacgtaaaccctaacggtttaccctccccgtagtacccgaacggtaccgttacggtaacccttcgttacggtccgtaacccgtacccgggaaggtaaacccggtaggggttacttaaagttacgtttaccggtaagggttaacgggaaacggacccggaccccgtaaagttaacgaacttcgttaccggaacccctaacccgttcgttcgtacggttacggtcggttaacttaacggg

SEQ ID NO: 429578 - DNA, 711 bp, Homo sapiens
  misc_feature: GZ8MTXP01EX14G.19.71.G05.1.454.CMB.2.raw
  modified_base (234)..(234): a, c, t, g, unknown or other
  modified_base (242)..(242): a, c, t, g, unknown or other
  modified_base (246)..(246): a, c, t, g, unknown or other
  modified_base (248)..(248): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctccacaaggtgtcctgtcacaagtacagctgcagcagtcaggtccaggactggtgaacgccctgcacgaccctctcgctcactgtncatcgcgngacngntcgcagcgtacgtgtcgtcgtcgtcgcgttacgcggacgacgtaccgtacgtaccgtagtacggtacgtacgtacgtaggtacggtacggtaacggtaacggtaataacgttacttaacgttaacgtaaccgtaacgtaaaccgtaaaggtaaacggtaaacgtaaactaacgttaaagtaccgacgtaacttacggtagtttaggaacgtacgtaacggtataccgtaaacgtaaacaacctaaacgtaacgaaacgaacgaacgtaaacggtaaaccgtaaacggtaacgttacccgttccgtttaacccgacgtaagtccgtaacgttacccgtacgtaaccgttacggaccggtaacccgttaaaccggtaacccggggtaaggttaccgttaaagggttactttaaacgtggttaaacgggtaaaccgggaccgaaaccgtaacccgttaactaaggg

SEQ ID NO: 429579 - DNA, 571 bp, Homo sapiens
  misc_feature: GZ8MTXP01BMCZU.19.71.G05.1.454.CMB.2.raw
  modified_base (313)..(313): a, c, t, g, unknown or other
  modified_base (368)..(368): a, c, t, g, unknown or other
  modified_base (398)..(398): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcacgtccccatcgagagtctagngtggcgtgggaacgcatatttcatacgtaccaacgacgtaggaaatacaaattancgacacctatctgttcgagagtacgactanaacgaatacaacgtagacaacgactaacgaaataaccgtaagttccctcccgtgaccgaagtcctacggacccttcgtaagtcgacccgtaccccggagggtaacccgtacggggttattacttacgttaacgtaggtaacggaacgaccggaccccgtaagttaaccggaac

SEQ ID NO: 429580 - DNA, 690 bp, Homo sapiens
  misc_feature: GZ8MTXP01B7HRH.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtcgaacgccctcgcacgaccctctcgctcacctgtcgaccagtccgtccggggacaggacgtcgactacgcgactaggtcgttgcgttggctacgtggtcaggccacgtccccagtcggagtaggtacgtaggagtggacgtaggggaaggactagttacttcaaacgttacgtaaccgaaacgtaccgggtaaggtaaaacttaaccgtaaaagtttacgtacggacctaaccgtaacgtttacgttaggttaggaacgggtaacgttaccggaaacttacggaaacctaaacgtaacccgtaaaacggttaaccgaaaccaaacttaacgttaaccgaaaccggtaaccttcgttaccctacccgtagactacgtccgtaccgtcgtccgtaggttaccgtacccgttacccggaaggtacgacggggtttattaacgtttaacgtacggtggtaacggacgttaccggtccccttaagtaaccg

SEQ ID NO: 429581 - DNA, 606 bp, Homo sapiens
  misc_feature: GZ8MTXP01EWLU5.19.71.G05.1.454.CMB.2.raw
  modified_base (243)..(243): a, c, t, g, unknown or other
  modified_base (258)..(258): a, c, t, g, unknown or other
  modified_base (327)..(327): a, c, t, g, unknown or other
  modified_base (457)..(457): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatacaactgacaagtccagccacaattctttanactagttacccaaanaatagaaaactacttagcttaggtaccagacagacgaccaggacagcctcaggctgctactatttacgngggacagttaccgtaacccggggtaactcccgggggtaccccctaggaccgtattcgaggtcgggactgggccgggtcgtggggactaggttacttcactctcacatcagcacgcctgcaggctagaagntggggtggtacttagtttatagttcgtaactaaataattattaattacttacgttggtaacggtaacggttccgggaccgaaagggtaccgtaagggttacggttattacgtaacgaggtaaccgagttggacgggtcttaagtaaccc

SEQ ID NO: 429582 - DNA, 755 bp, Homo sapiens
  misc_feature: GZ8MTXP01CS92M.19.71.G05.1.454.CMB.2.raw
  modified_base (246)..(246): a, c, t, g, unknown or other
  modified_base (342)..(342): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccacgatacgaactgacaagtccagccactaattctttaanactacgtacaataataactaaacttactagcttacggaaccagacaagacgaccgagtacacgtcctacgtagctacgacttactaagtttaccgnggacctacgtacccggtaacccgggtacgttcccccggggtacccctacggaccgtagttaccgaggtacgggaccgtaacggggtccgggtacggtacgggaactacgttactttaccgaccttcctaccaacctacgtaccgacgaccgtacgtcccgtagaccgacggtacgtaaggtaaagttccggttagggggtacggttaacgtttaaagtttaattaacgttaacctaaacgttaaacgtttaaactttaacttttaacttaaccgggttaccggttacgggttaacggggttaacccggttaccggggtaaaccggaaacgggtaaccggttaaggttaacggttaacttaacgtaacgggaacgtaaccgtaaggttcggttacggtaaccgttcggtaaccc

SEQ ID NO: 429583 - DNA, 660 bp, Homo sapiens
  misc_feature: GZ8MTXP01AI924.19.71.G05.1.454.CMB.2.raw
  modified_base (271)..(271): a, c, t, g, unknown or other
  modified_base (324)..(324): a, c, t, g, unknown or other
  modified_base (477)..(477): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacagacgtcgctagcgacgngtgtgcgttggctacggtgggtcaggcacgtcccagtcggagaggtcgtaggnggtggcgtaggggaacgactagtatttacgattaacgtacccgaacgtacgggtaacggtaaattaaacgtaaatttacgacgacctaaccgtaattcggttaggttacgaaggttacgtacgtacgtagaacctaagtaccgaaacggtaanaaccgaacgtaacgttaaccgaaacgtaaccccgtaacgttttcccacccgttagaccgacgtccgtaccgtaacccgttcgtaagtccggttacccgtacccgggaacggtaaccggtacgggttattacgttacgtttaacgagggtaacggaacggaccggacccctaagaacggtaacc

SEQ ID NO: 429584 - DNA, 610 bp, Homo sapiens
  misc_feature: GZ8MTXP01DAQFR.19.71.G05.1.454.CMB.2.raw
  modified_base (251)..(251): a, c, t, g, unknown or other
  modified_base (331)..(331): a, c, t, g, unknown or other
  modified_base (445)..(445): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtggggcgaggccgggccacgatacgaactcgactaagtccagccataattctttaanactactacaataataactaaactactagctacgacagacagacgacgagacacgcctacgagctgactactagtttacgnggactacgtaccggtaaccgggtacgtcccgggtaccccacggactagtcgaggtcgacgcgggtcggtacgtacgggactagtacttacacctctacactatacagcacgtcngacgagtacaagaagtgtggggtacgtagttaagtttatagtactaactaaattaattaagtttattacgttacgttgggtaacggtacgttacgggaaacgttaaacgggtacgtaaggttgttaacttacgaacgagtaacgtacggtgttacgcttcgtaac

SEQ ID NO: 429585 - DNA, 616 bp, Homo sapiens
  misc_feature: GZ8MTXP01A0ZY6.19.71.G05.1.454.CMB.2.raw
  modified_base (498)..(498): a, c, t, g, unknown or other
  modified_base (563)..(563): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaacgccctcgcacgaccctctcgctcactgtcgccatccgtcggggacaggacgtcgctacgcgactaggttgttgcttcggctacgtgggtcaggcacgtccccagtccggagacggtctaggagtcggcgtacgggaaggtcagttacttcaagtacgtccaaacgtacgtaggaaactacaaaattctagacctaacacgttagtagtttagagtaacgttacgaacttagaaaccaattccgaaaacgtcgaactaacgaattacgaaacgtaaccacgttccgtacccngacctaaggtcctaacggtccctgtcgttcgtacccgttcccgggaaggtaccggttacgggttnttaacgtaatttaccgaaggttacggaaccgaccgggtcccttaaggtaaccg

SEQ ID NO: 429586 - DNA, 549 bp, Homo sapiens
  misc_feature: GZ8MTXP01D6AS3.19.71.G05.1.454.CMB.2.raw
  modified_base (205)..(205): a, c, t, g, unknown or other
  modified_base (310)..(310): a, c, t, g, unknown or other
  modified_base (333)..(333): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtnaagcccctcgcagacccctctcgctcacctgtcgccatccgtccggggacagagtcgctagcgacagtgttgcttggcacgtggtcaggcagtccccatccgagnggtctagagtgcgtgggacgacngtattcaatcgtccgaacacgtagaaatacgtaaattatgacactatctaggttgagtagtcgtactgaacaatcaaagtacgaactaactagtaccgaaagaacctacgttcctccctagcctagcctacgtacctcgtgttacgaccgttaccggacggtacgttacggttgttaactaattacgtgtaggtacgaccgtccccgaagtaaccg

SEQ ID NO: 429587 - DNA, 634 bp, Homo sapiens
  misc_feature: GZ8MTXP01BQY8M.19.71.G05.1.454.CMB.2.raw
  modified_base (244)..(244): a, c, t, g, unknown or other
  modified_base (266)..(266): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctcctggctgtgtctcgtgggcgagccgggccacgatacgactgacaagccagcactaattcttaanactactacaatatacgaaactntagctagacagacaagacgtacgagactacgtcctcgagctacgtactacgttacttacggcggtactacgtacccggtaacccgggtacgttccccgggtaccctacggtaacctagtcgacggtacggacgtcggggtccgtacgacggtaactagtacttacactcgacacacgtacgacgtacgacgtctacgcgacgtacgagagtagtacggtagtacgttagttagttagtactaactaacttaattaattattacgttacgttacgtaacgtacggttacggtaacggaacggtaacgtaacggttagttacgttacgtaacgtaacgtaacgtacgtacgttacgtcgttaacgtaacg

SEQ ID NO: 429588 - DNA, 790 bp, Homo sapiens
  misc_feature: GZ8MTXP01BWI1U.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgacccctctcgctcacctgtcgccatcgtccggggacagacgtcgctagcgacagtgtctgtcgtgcacggtggtcgacgccaccgtacccctagtacggaggtacggtacgtaggtacgggtcggtacgggtaagggggaaacgtacgtaagttttacgtttacgtacgttaccgtaaacccgtaaacgtaacggttaaacgtaaaacgttaaacgttaaaagtttaacgtaaccgtaaaaccttacgtttaacgttacgggttaaggaaacgttaacggtcgttaaacgtaacgtaaaactaacgtttaaaccgaaaacccggttaacaaaccgtaaacgtaaaccggttaaacccggtaaaacccttaacccgtttaccgttaccccgtaccgtacgtaccgtaaccgttccgttaaccgttacccggttgtaccggtaacccgtacccggtaacggtaacggtacggttaaggttacttaacgttacgtacggtaacgggaacggaccgtaccccgttacgtaagacgacgttccgttaccccgtccttcccgttgttccgttacgttaccgttaagttcgggttaaccggg

SEQ ID NO: 429589 - DNA, 597 bp, Homo sapiens
  misc_feature: GZ8MTXP01DNREX.19.71.G05.1.454.CMB.2.raw
  modified_base (235)..(235): a, c, t, g, unknown or other
  modified_base (245)..(245): a, c, t, g, unknown or other
  modified_base (258)..(258): a, c, t, g, unknown or other
  modified_base (327)..(327): a, c, t, g, unknown or other
  modified_base (365)..(365): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgaggggacatcgtgatcgacccagtcctccagacctccctggctgtgtctcgtgggcgaggccgggccacatcaactgacaagtccagccanaattctttanacagttaccaaanaatagaaactacttagcttaggaccagacagacaccgaggacacgcctctaggctgctactatttacgnggctacgtccgtaacccggggatccccggggtcccccnggtaccgattccgaggtcgcgaaggtcgggtcgtagggacagtactttcactctacacatcagcacgctacgcgacggctaggaagtagttggggtagtacgttaagttttatagttagaactaataaattattattaacttacgttgtaaggttacgttcggaaccttaagggtaacgaaggttaggattacgtaacgtaagaaccgtaagtggttacgaacgttcgaacc

SEQ ID NO: 429590 - DNA, 613 bp, Homo sapiens
  misc_feature: GZ8MTXP01BE0J4.19.71.G05.1.454.CMB.2.raw
  modified_base (240)..(240): a, c, t, g, unknown or other
  modified_base (323)..(323): a, c, t, g, unknown or other
  modified_base (455)..(455): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgacaagtccagccaacatctttanacagttccaaacaatagaaaactacttagcttaggaccagacagacgaccaggaccagccctctaggctgcctcatttaccgngggacacgtaccgtacccggggaagtcccggggtcccccctggaccgtagttccgaggtcgggcctaagggtcgggtctagggggactagtatttccactctcaccatcagcacgcctgccgagctagaagntggggtagtctagtttacttattgtacaaactaaattagttattaattacgttcggttaagggtaaccgtttaccgggaccgaaaggggtacccgaaagggttcggaattacgttaacggagtaacccggaaattgggttacggtccttggtaacccc

SEQ ID NO: 429591 - DNA, 672 bp, Homo sapiens
  misc_feature: GZ8MTXP01C0C2P.19.71.G05.1.454.CMB.2.raw
  modified_base (310)..(310): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttctcctgccgtgctggcctccacaaggtgtcctgtcacaagtacagctgcagcagtcaggtccaggactggtgaacgccctcgcacgaccctctcgctcactgtcgccagtccgtccgggacacgagtcgctagcgacgtagtgttgcgtgcacgtggtcaggcacgtcccagtcgagtacgtntaggagtggtcgaggaacggactagttacttcagtaacgtaccaacgtacggtaagaaaacttaactaaaattacgacgtactaacctaattcgtagttagaacgtacgtacgaacttacggaaactagtaaccgaaacgtaacgaacccaagaaacgttaacggaaacgtaaaccctacggtttcccctaccgagtaaccgtccgtacctacggtaacccctttcgtaacggttaccggacccggttacccgggaaacgggttaaccggtaacggggttattaacttaaccgttttaacggggacggtttaacgggaaacccggtaccggttaacccccttaaggttaaacccggtaaccg

SEQ ID NO: 429592 - DNA, 656 bp, Homo sapiens
  misc_feature: GZ8MTXP01AEVFY.19.71.G05.1.454.CMB.2.raw
  modified_base (271)..(271): a, c, t, g, unknown or other
  modified_base (613)..(613): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccagtccgtcggggacagagtcgctagcganagtgtgcgttggcacgtggtcaggcacgtccccagtcggagaggtctaggagtggcgtagggaaagactagttattcaattcgtaaccaaacgacgtaggaaataactaaattatacgactaaccagttacgtagtttaggaagtaggtacgtaacgttacggaaacaaacttaaccgaaacgttacgaaaccgtaactaacgtaaccggaaaacggtaaaccctacggtttaccctacccgttacgaccgtacggtccttaccgacccgtttaactcgggttacgaacccgttcccggaaacgggtaacgttacggggttacgttagttaacgtttaacgngggttaacggaaaccggaccggtaacccccgttaagtaacccg

SEQ ID NO: 429593 - DNA, 600 bp, Homo sapiens
  misc_feature: GZ8MTXP01ESU3Y.19.71.G05.1.454.CMB.2.raw
  modified_base (243)..(243): a, c, t, g, unknown or other
  modified_base (255)..(255): a, c, t, g, unknown or other
  modified_base (326)..(326): a, c, t, g, unknown or other
  modified_base (434)..(434): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgccccacggggacatcgtgatgacccagtctccagacctccctggctgtgtctcgtggcgagccgggccaccatcaactgcaagtccagccactaattctttaanacattaccaaanaatagaaaactacttagcttaggtaccagacagacgacccaggaccagccctcaggctgctctatttacgngggtacacttccgtacccgggaacgtcccggggtcccccctaggtaccgattccgaggtcgggccaagggtccgggtcgtggggactagtactttcacctctacaccntcagcacgcctagcaggtctaggaaagtgtggggtgtacgttatttagttatacgtacaaactaattatttaattacgtacgttcggtaaggtaccgttgggacccttaaagggacctaagggttgattgtaacgaagtaaccgtaatggttacgtcttaagaacc

SEQ ID NO: 429594 - DNA, 562 bp, Homo sapiens
  misc_feature: GZ8MTXP01BCKUX.19.71.G05.1.454.CMB.2.raw
  modified_base (239)..(239): a, c, t, g, unknown or other
  modified_base (253)..(253): a, c, t, g, unknown or other
  modified_base (320)..(320): a, c, t, g, unknown or other
  modified_base (377)..(377): a, c, t, g, unknown or other
  modified_base (401)..(401): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgcaagtccagccataatctttanactagttaccaaanaatagaaaactactagcttaggtaccagcagacgaccaggacagcctcctaggctgctcatttacgnggcatccgtaccgggaatcccggggtcccctgatcgtattcaagtggcaggcgggtntgggacagtatttcactctcaccntacagacacgcctgcgagctagaagtgtggtaggtactagtttattagtgtacaaactaattattattactacttcgtcgggttacgttccggaccgtaaaggggtacccttaagggttggttaataactcgaagtacggaacttggtaacggttctaacg

SEQ ID NO: 429595 - DNA, 544 bp, Homo sapiens
  misc_feature: GZ8MTXP01AGSR8.19.71.G05.1.454.CMB.2.raw
  modified_base (371)..(371): a, c, t, g, unknown or other
  modified_base (428)..(428): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaagccctgcagacccctctcgctcacctgtcgccatcgtccggggacagagtcgctagcgacagtgttgcttggcacgtgggtcaggcacgtccccatcgagaggtctagagtggcgtggggaacgacattattcatacgtaccaagacgtaggaaattaacaaattancgacacctatctgtagagagtacgatgaacaatacaaacgtagacacgatacgaaanaacctagttcctccctgcagtctacgaccctgtgtcgaccgtcccggaggacggtacgggttgttattacgttaacgtggtaacggaacggtccggacccctaagttaacggaacc

SEQ ID NO: 429596 - DNA, 585 bp, Homo sapiens
  misc_feature: GZ8MTXP01C13SE.19.71.G05.1.454.CMB.2.raw
  modified_base (130)..(130): a, c, t, g, unknown or other
  modified_base (256)..(256): a, c, t, g, unknown or other
  modified_base (317)..(317): a, c, t, g, unknown or other
  modified_base (335)..(336): a, c, t, g, unknown or other
  modified_base (360)..(360): a, c, t, g, unknown or other
tcagtactctcgtgcacgaccggtgctcgatttagtgtcgtcgcaagagagagggggaccagggcagtcaccagagctccagacaatgtctgtctccttcctcttcttcctgcccgtgctggcctcccanaaggtgtcctgtcacaagtacagctgcagcagtcaggtccaggactggtgaagccctcgcagaccctctcgctcacctgtgccatctccggggacagagtcgctagcgacagtgttgcttggcacngggtcaggcagtccccatcgagaggtctagagtggctggaagatatatttcatgtccaaangtggaaatacaaatttannacaacatctgtgagagtacgacanaacaactaacaacgtaacgaacaacgaacgtaacgaaacgaaactaacgtacctacctacgacgacgacgtacgtaccgtacgtacgtacgtaccgtaccgacggtaacgtaacggtagtaacgttaacgttaacgtaaggtaacggaacggtaaccggacccgtaacgtaacgacgacgttaccgtaacctaccgtccgtccgtcgttacgtcgttaacgtaag

SEQ ID NO: 429597 - DNA, 612 bp, Homo sapiens
  misc_feature: GZ8MTXP01CVARB.19.71.G05.1.454.CMB.2.raw
  modified_base (334)..(334): a, c, t, g, unknown or other
  modified_base (343)..(343): a, c, t, g, unknown or other
  modified_base (348)..(348): a, c, t, g, unknown or other
  modified_base (367)..(367): a, c, t, g, unknown or other
  modified_base (400)..(400): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgcccagtccgtccggggacagagtcgctagcgacagtgttgcttggcacgtggtcaggcagtccccagtcgagaggtcagagtggctgggaagacntattcaatnccaanacgtagaataacgaattangactaacatctgtactaggagtacgtacagtanaactaacgtaacgtaaacgagaaccaagtaacaaacgtaaacgtacccttacgttaccctaccgtacgaacgcttacccgtaaccgttccttacggttaccggtaaccggttccccgttaaaccggggacgggttaaacccgggttgtttaacgtaattaacccgttggttaaacgggacggttaaaccgggtaaccccttcccgttaaaag

SEQ ID NO: 429598 - DNA, 512 bp, Homo sapiens
  misc_feature: GZ8MTXP01CTQNF.19.71.G05.1.454.CMB.2.raw
  modified_base (258)..(258): a, c, t, g, unknown or other
  modified_base (319)..(319): a, c, t, g, unknown or other
  modified_base (335)..(335): a, c, t, g, unknown or other
  modified_base (379)..(379): a, c, t, g, unknown or other
  modified_base (397)..(397): a, c, t, g, unknown or other
  modified_base (439)..(439): a, c, t, g, unknown or other
  modified_base (476)..(476): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacngggtcaggcagtccccatcgagaggtctagagtggctgggaagacatatttcatgtccaancgtgaactacaaattntgcaaccatctgttgagtagtcgactagacatcaacgtagacanatacgaagaaccagttcnccctgcagctgacctctgtcgacctcccgaggacgacgggtntatattctggtacggaaggacggccccaagtcgacgnttccgcctacctcgtctcgttgggtcgttcgttaag

SEQ ID NO: 429599 - DNA, 654 bp, Homo sapiens
  misc_feature: GZ8MTXP01AM4ZF.19.71.G05.1.454.CMB.2.raw
  modified_base (248)..(248): a, c, t, g, unknown or other
  modified_base (344)..(344): a, c, t, g, unknown or other
  modified_base (395)..(395): a, c, t, g, unknown or other
  modified_base (441)..(441): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctcccgtggctgtgtctcgtgggcgagccgggaccacatacaactgacaagtccagccactaattcttttaanactacgttaccaaactaatacgtaaaactacttagcttacggaccagacagaacgaccgaaggacacgtccctacgtaggcctgctctagtttacngggcacgtccgtaccgggagtcccgggtccccagaccgtatcgagtcgacnggtcgggtcgtgggaacctagtactttccgactccgtacacctacncgacgcacgtcgtcgacgacgacgtaagagtacgtgggtacgtacgttagtttaattacgttacgtaactaaagttaaattattaagttacgttacgttcggtaacggttaccggttaaccggtaaccggttaaacgggtaaaccggtaaggttacgttaacgttacgtaacgtaacggtaaccgttaggtaggttacgtcgttaacgaaccc

SEQ ID NO: 429600 - DNA, 541 bp, Homo sapiens
  misc_feature: GZ8MTXP01A7I9G.19.71.G05.1.454.CMB.2.raw
  modified_base (229)..(229): a, c, t, g, unknown or other
  modified_base (239)..(239): a, c, t, g, unknown or other
  modified_base (315)..(315): a, c, t, g, unknown or other
  modified_base (370)..(370): a, c, t, g, unknown or other
  modified_base (515)..(516): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcaagtccagccanaatcttttanacagttccaacaatgaaaactacttagcttggtaccagcagagaccaggacagcctctaggctgctctatttacgngggacatccgtacccggggaatcccggggtcccctagaccgattcgagtcgggcnggccgggtctgggacagtactttcactctacaccagtcagcagcctggcaggctagaagagtggtacggctaagtttattattgactaaataattattattatacttcggtgtacgttggaccttaagggaccaaggttgattannaagtaacgaactgttagcttgaacc

SEQ ID NO: 429601 - DNA, 691 bp, Homo sapiens
  misc_feature: GZ8MTXP01EWWFY.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcgggccctcccacaaggtgtcctgtcacaagtacagctgcagcagtcaggtccaggactggtgaacgccctcgcacgaccctctcgctcacctgtcgccagtccgtaccggggacaggacgtcgcgtagcgactaggtcgttgcgttggctacgtgggtcagggcctacgtccccagtccggaagtacgggtctaggaggtgggacgttagggggaaacggtactattactttcgaaacgttcggtaacccgaaaacgtaccggttagggtaaaactttaaacctaaaagtttacgtacgtaaccctaacctaacgtttcgttagggttagaacgggttaacgtacgtaactacggtaaaccaaacttaaccgaaacgtaacgaaaccaacgtaaagtaaccggaaactaaaccgtacgtttaccctaccgtagcgttaacgctacgtacctcgtcgttaccgtaccgttaccggaacggtacgttacgggttcttaagttaagttacgtaacggtacgggaacgaccggaaccccttaagtaaccg

SEQ ID NO: 429602 - DNA, 597 bp, Homo sapiens
  misc_feature: GZ8MTXP01DB9XM.19.71.G05.1.454.CMB.2.raw
  modified_base (228)..(228): a, c, t, g, unknown or other
  modified_base (236)..(236): a, c, t, g, unknown or other
  modified_base (245)..(245): a, c, t, g, unknown or other
  modified_base (249)..(249): a, c, t, g, unknown or other
  modified_base (255)..(255): a, c, t, g, unknown or other
  modified_base (301)..(301): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagactccctggctgtgtctcgtgggcgagcgggccacgatcaactgcaagtccagccanatctttanacatacaanatanaaactntagctagacagcagagacagacagcctcgagctgctatatttacgnggactagtaccgtaaccgggacgtcccggggtacccctacggacgtattcgaggtcggacgtcgggtccgggtacgtagggaactagtactttacactcctacacctatcagacacgtcctgacgaggactagaagtagtgggtaggtacgttaagtttaattattagtaactaaactaaattaattaattaattacgttacggttaacggtacgttacggtaccgaacggtaaacggtaaggttaggttagttagtaacgaacgaacgtaacgtacgttacggtcgttcgtaacg

SEQ ID NO: 429603 - DNA, 560 bp, Homo sapiens
  misc_feature: GZ8MTXP01AU3GK.19.71.G05.1.454.CMB.2.raw
  modified_base (374)..(374): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccatcgtccggggacagagtcgctagcgacagtgttgcttggcacgtgggtcaggcacgtccccagtcgagaggtctaggagtggcgtaggggaaacgactatatttcatcgtacccaacgacgtaggaaatacaaattngacactatcgtgtagagagttcgactagaacaatacaaagtagaacaacgaatacgaaacgaacctagttcctcccgtgacagtctacgacctctaacgtcgaccgtcccgaggtacgtaacgggttagttacttacgttaacggtaggtaacggtaacgaccggacccctaagttaacgtaaccg

SEQ ID NO: 429604 - DNA, 738 bp, Homo sapiens
  misc_feature: GZ8MTXP01ALZJG.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcagtccccatcgagaggtctaggagtggcgtaggggaaggacattactttcagttcgtacccaaacgacgtaggaaacttaacaaatttatcggaccaaaccctaattccttagggtttagaacgggtacggtaccgaacgttacgaaacccgtaaacttaccgaaaaccggttaacgaaacctaaaccgtaacgttaaccggaaaacggtaaacccctaacggtttaccccttacccccgttacggacctaacggtccggttacgtaaccccgttccgttacggtaccgtaaccccggttaccccggaacgggtaaccggtaaccggggttagttaaacgttaacgtttaaccggtaagggtaacgggttaaacggtacccggacccccgtaaagttaaccggaaccgttaacgttccgaaccccgtacccgtccgttccgtccgttcgggttcgttaacgtttaacgg

SEQ ID NO: 429605 - DNA, 652 bp, Homo sapiens
  misc_feature: GZ8MTXP01A2MGG.19.71.G05.1.454.CMB.2.raw
  modified_base (321)..(321): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtcgaacgccctcgcacgaccctctcgctcacctgtcgccagtccgtccgggacagagtcgctagcgatagtgtgcgttggctacgtggtcaggcacgtccccatcgagtacgtcgagngtcggcgtaggggaagactagttagttcaacgttacgtaacccaaacgtacggtaaggaaacttaactaaagttactacgtacctaaccgtagttcgtaggtttaggaacgtacggtacgtacgtagaaaccctaataaccgtaaacgtacgaacgactaacgtaacgaaacgtaacctacgttccgtacctacgctacgtacctacggtccctcgttacgttaccgtacccgttacccggaaggtaaccggttaccgggttagtttaacgttaacgtttacgtaacgggttaaggaaccgggttacccgtaaccccgttaaggtaacccg

SEQ ID NO: 429606 - DNA, 519 bp, Homo sapiens
  misc_feature: GZ8MTXP01EQJ6T.19.71.G05.1.454.CMB.2.raw
  modified_base (223)..(223): a, c, t, g, unknown or other
  modified_base (232)..(232): a, c, t, g, unknown or other
  modified_base (244)..(244): a, c, t, g, unknown or other
  modified_base (306)..(306): a, c, t, g, unknown or other
  modified_base (487)..(487): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccanattctttanacagttccaaanaatgaaaactacttagctggaccagcagagaccaggacagcctcctaggctgctcatttacngggcatctacccgggaatccggggcctgaccgatcagtggacaggcgggtctggggacagtactttcacttctacaccatcagcagcctgcaggctagaagatgtggggctagtttatattgtcaaatattattatatacttcgtgtcgttcggacaaagggaccgtaaaggtggaagttnttacgaagacgtaatggtggcttaagctaacg

SEQ ID NO: 429607 - DNA, 704 bp, Homo sapiens
  misc_feature: GZ8MTXP01CZJG0.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgaccctctcgctcacctgtcgccatcgtccggggacagagtcgctagcgacgagtgtgcttggctacgtgggtcaggccacgtccccagtcggagaggtctaggacggtggcgtaggggaacggactagttactttcaagttcgtaaccaaacgacgggtaggaaataacaaatttatacgacctaaccgtattccgttaggttagaacggtaggttaccgtaaccttaggaaacctaaacgttacaaaaccggttacgaacctaacgtaaagttaaccggaaaacggttaaaccctacggtttacccctaccccgttacggaacctacgtaccctttaccgtaaccccgttcggttaacggttacccggtaaccccggttacccgggaaacggggtacccgggttaacggggtttacgttaacgtttaaccggttacgtaagggtaacgggtaacgggaccccggtaaccccgttaagttaacccg

SEQ ID NO: 429608 - DNA, 569 bp, Homo sapiens
  misc_feature: GZ8MTXP01AF1F8.19.71.G05.1.454.CMB.2.raw
  modified_base (228)..(228): a, c, t, g, unknown or other
  modified_base (236)..(236): a, c, t, g, unknown or other
  modified_base (247)..(247): a, c, t, g, unknown or other
  modified_base (259)..(259): a, c, t, g, unknown or other
  modified_base (310)..(310): a, c, t, g, unknown or other
  modified_base (376)..(376): a, c, t, g, unknown or other
  modified_base (384)..(384): a, c, t, g, unknown or other
  modified_base (428)..(428): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgcaagtccagccanatctttanacagttccaanaatagaaaactntagctggtaccagcagagaccaggacagcctctaggctgctctatttacgngggctagtccgtaaccccggggaatccccgggggtccctgacccgattcgaggtggcaggcgggtntggggacngtactttcactctacaccagtcagcagccctgcaggctagaagngtgtggggtctaagttttatagttcgtacaaataatttaattattattacgtttcggtgggtaactttcgggacgtaaacggggacctaaaggggtgaattcacgaaggacgtaacgtggtcgggacttggcccgtaaccg

SEQ ID NO: 429609 - DNA, 569 bp, Homo sapiens
  misc_feature: GZ8MTXP01A7C6K.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctacagcagtcaggtccaggactggtgaagccctgcagacccctctcgctcacctgtgccatctccggggacagagtcgctagcgacagtgttgcttggcacgtgggtcaggcagtccccatcgagaggtctagagtggctggggaacggactatatttcagtacgtaccaacgacgtaggaaatacaaattatgcaccatctagtgagagtacgactagacaatacaaacgtagaacactaatacgaaacgaacctacgttccctacccgtgacagtccgtagtaccctcgtaagtcgacccgttcccggaagggaccgtaccgggttacgttattacgtttaaccgtaggttaacggaaggacccggaccccctaagttaacggaaccg

SEQ ID NO: 429610 - DNA, 910 bp, Homo sapiens
  misc_feature: GZ8MTXP01DRWDI.19.71.G05.1.454.CMB.2.raw
  modified_base (242)..(242): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgacaagtccagccactaattcttttaanactagttacccaaacaatagaaaacttactagcgtaggtaaccaggccaaaggacgaaccaggacacgaccccgtcgtaggctcggtaccttactaagttttacgtcgggggtactaacggttaccccgtaaaccccgggggtaaacgttccccgggggttaccccctaggaaccccgtattttacccggaaggttccggggaaccaacggggtcccgggggttacgttacgggggaacctaacggttacttttcccgaactttcctaccctaaccctacttaccgaaacgtccgaacccggtccgttacggaccgtaaagggccgttaaagggaaacgttaacggtttaggggttacggggggttaaaccctttaaaggggttttttttaaactttaaagggttttaccgttaaaacccgttaaaacgtttaaaagttttttaaaagtttttaacctttttaaaagtttttaaccccggttttaacggggggttaacccggggttttaaacccggggttttacccgggaaaacccggggttaaaaacccggggttaaacccggtttaaaacgggggtagggtttaaaaccttagttaaacccgggaaacgttaaacccggggtaactttggggaccggttacggtaaccgttaaccttaaaccccgg

SEQ ID NO: 429611 - DNA, 654 bp, Homo sapiens
  misc_feature: GZ8MTXP01B79GH.19.71.G05.1.454.CMB.2.raw
  modified_base (234)..(234): a, c, t, g, unknown or other
  modified_base (247)..(247): a, c, t, g, unknown or other
  modified_base (312)..(312): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactcctggctgtgtctcgtgggcgagcgggccacatcaactgacaagtccagccatatctttanacagttaccaaanaatagaaaactctagctgaccagcagagaccaggacacgcctacgtaggctgctactatttacgngggcagtccgaaccgggatcccggggtcctacgaccgtattcgaggtcggacgtagggccgggttctacggggactagtactttccaacttcctacccaaccctataccgaacgcctacggtccccgtagccgaagggccttagaaagtagttggttagggggtactttaaggttttaatagtttacgaacctaaaattaatttaatttattaacgttacgtttcggtacgggtaaaccggtttccggaaacccggtaaagggacccgtaaagggtcggaaatttagaccgtaagggtaaaccgtaagttacgggtcgggttacctaacggaaccgtaaccg

SEQ ID NO: 429612 - DNA, 655 bp, Homo sapiens
  misc_feature: GZ8MTXP01BT3HD.19.71.G05.1.454.CMB.2.raw
  modified_base (248)..(248): a, c, t, g, unknown or other
  modified_base (262)..(262): a, c, t, g, unknown or other
  modified_base (338)..(338): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagacctcctggctgtgtctcgtgggcgaggccgggccacgatacgacgtgacaagtccagccactaattcttttaanactacgttaccaanaatacgaaaactacttagcttaggaccagacagacgaccaggacacgcctaccgtaggctcgactactatttacgnggactacgtaccgtaacccgggagttcccgggggtacccccctaggaccgtagttcgacggttcgggaccgtaacggggtccgggtaccgtagggggtaaccctaaggttctttaaccgcttaccctacaccgtaacacgacgcgacgtcgtacgacgagtacgagtaagtgtcggggtagttacttagttagttatacgtaactaaattaattattacttacgttacgtcggtaacggttacgttacggaacgttaacggaacgtaggttagacgttacgtaacgacgtaacgtcgtcgttacgtcgttcgaaccg

SEQ ID NO: 429613 - DNA, 620 bp, Homo sapiens
  misc_feature: GZ8MTXP01AR3WH.19.71.G05.1.454.CMB.2.raw
  modified_base (342)..(342): a, c, t, g, unknown or other
  modified_base (385)..(385): a, c, t, g, unknown or other
  modified_base (423)..(423): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaacgccctcgcacgaccctctcgctcacctgcgccatccgtcggggacagacgtcgctagcgactagtgttgcttggccacgtcggtcaggccacgtccccagttcgagtaggtctaggagtggcgtagggaaggtanattatttcaattcgcaaacgtacggtagaaataactaaattancgacaacctatctagtcgagtaacggtatacgtacganaactaacgtaacgaacgtacgaactaacgacgtaaacgaaaccgtaacttcgttacccctaccgtgaacctacgtcgtaccgtaacgttcgttacgtaccgttacccgaccggtaacgggttaccggttacgggttaattaagttaccgtttaaggtcgggaaacgggacccgtaaccccgggttaaccctaaaggg

SEQ ID NO: 429614 - DNA, 523 bp, Homo sapiens
  misc_feature: GZ8MTXP01B1D20.19.71.G05.1.454.CMB.2.raw
  modified_base (244)..(244): a, c, t, g, unknown or other
  modified_base (254)..(254): a, c, t, g, unknown or other
  modified_base (256)..(256): a, c, t, g, unknown or other
  modified_base (265)..(265): a, c, t, g, unknown or other
  modified_base (291)..(291): a, c, t, g, unknown or other
  modified_base (293)..(293): a, c, t, g, unknown or other
  modified_base (299)..(299): a, c, t, g, unknown or other
  modified_base (301)..(301): a, c, t, g, unknown or other
  modified_base (313)..(313): a, c, t, g, unknown or other
  modified_base (332)..(332): a, c, t, g, unknown or other
  modified_base (337)..(337): a, c, t, g, unknown or other
  modified_base (361)..(361): a, c, t, g, unknown or other
  modified_base (372)..(372): a, c, t, g, unknown or other
  modified_base (374)..(374): a, c, t, g, unknown or other
  modified_base (376)..(376): a, c, t, g, unknown or other
  modified_base (382)..(382): a, c, t, g, unknown or other
tcagtactctcgtgcacgaccggtgctcgatttagtgtcgtcgcaagagagaggggggaggtacaacaggcaggcaggggcagcaagatggtgttgcacgaccaggtcttcatttctctgttgctctggatctctggtcgccgacggggacatcgtgatcgaccagtctccagacctcctggctgtcgtctcgtgggcgaggcgggctacggactaacgacgtcatacgcagcactattcttanactactacananacactactnctcgacacacacgacgacacgacacncncgcgcncnctctatcgcgcncacgacgacgcgccgcgcnctcgngcgcgcgcgcgacgacactactcnctacacacacncncncacgcncgacgacgacgagagtacgtcggtcgtacgttattagttactactactaactacttacttatactacgtcgtcgtacgttacggtacggacgtacgtagttacgacacgtaacgtacgtaacgtacgtcgcgtcgcgtaac

SEQ ID NO: 429615 - DNA, 716 bp, Homo sapiens
  misc_feature: GZ8MTXP01DR7EN.19.71.G05.1.454.CMB.2.raw
  modified_base (240)..(240): a, c, t, g, unknown or other
  modified_base (251)..(251): a, c, t, g, unknown or other
  modified_base (315)..(315): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagactcctggctgtgtctcgtgggcgagcgggccacgatcaactgacaagtccagccactaatcttttaanactactacaanaatagaaactatagctagacagacagacaccgagacacgcctacgtagctgctctagtttacgnggtactacgttaccgtaaccggtacgtcccgggtacccctacggtaaccgtacgttaccgacggtcggaccgtaacgggtccgggtttaccgtacgggaactaacggttactttaccacccttacccgtaacctaaccgtacgtaccgaacgtaccgtaaccggtcctaggaccgtacggtacgtaaggtaacgtacggttcggggtacggttaacgtttaaagttttaactttaacgttacgtaaactaaaacgttaaatttaactttaatttaacgttaccgttcgggttaacggtaccggttaccgggtaaccggaaacgggtaaccggttaaggttacgttaacgttacgtaaccgtaagtaaccgtacgttacggttcggtaacgttcggtaaccg

SEQ ID NO: 429616 - DNA, 618 bp, Homo sapiens
  misc_feature: GZ8MTXP01BDVZF.19.71.G05.1.454.CMB.2.raw
  modified_base (224)..(224): a, c, t, g, unknown or other
  modified_base (238)..(238): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcacgaccctntcgctcacctgtcncccatccgtccggggacagagtcgctagcgacagtgttgcttggcacgtggtcaggccacgtccccatccggagtaggtctagagtggacgtaggggaaggtactattattcaaagttcgtaaccaaagtacgtaggtaaactaactaaattagtcgacacctagtctggttagagtagtcgaatgaaacaagtacaaacgtagaacaactaagtaaccgaaagaacctcggttcctcccttaggcctagtacgtaccgaacccttcgtacgttccggtaaccttccccgggaaagggtacccgttagggggtttacttaacgtttaacgttacgttaacgggtaacgggaacgttacccgggtccccttaagtaacccg

SEQ ID NO: 429617 - DNA, 754 bp, Homo sapiens
  misc_feature: GZ8MTXP01B5NBE.19.71.G05.1.454.CMB.2.raw
  modified_base (239)..(239): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactgggtcgaacgccctcgcacgaccctctcgctcactgtcnccatcgtcgggacagagcgactagcgacgtagtgttgtcgttggcgtacgtcggtcgacggcctacgtccccagtcggaggtacggtacgtaggtaggtgggtacggtaagggggaaacggtactaagtttaactttacgtaacgttaccgtaacccgtaaacgtaacgggttaaagggtaaaactaaaaccgttaaaagttaacgttaccggaacctaaacccttagttaccgtttagggtttaacggaacggtttacggttaccgtaacgttaacgaaacctaaacgttaccaaaacggttaacgaactaacgtaacgtaaaccggaaacgtaacccgtacgtttacccctaccgttacgaccgtacgtccgtaccgtaccgttcgtacggttacccgtacccgaaccgggtaacgggtacccgttaacggggtttgttaaacgtttaacggtttaaccggtgggttaaaccggggaacccgttacccgggaacccccttaagttaaacccgg

SEQ ID NO: 429618 - DNA, 649 bp, Homo sapiens
  misc_feature: GZ8MTXP01DRUO3.19.71.G05.1.454.CMB.2.raw
  modified_base (248)..(248): a, c, t, g, unknown or other
  modified_base (338)..(338): a, c, t, g, unknown or other
  modified_base (393)..(393): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctccctggctgtgtctcgtgggcgagccggccaccatcaactgacaagtccagccaactaattcttttaanactacgttaccaaactaatacgtaaaactacttagcttaggtaccagcaagacgaccaggacacgcctccgtaggctgctctatttacgnggcagtccgtaacccgggagtcccgggtccccctgaccgtattcgaggtcggcgngggcgggtcgtagggactaggtactttcactcctcacccgatcagcacgcctgccgaggctaggaagtagttggggtcggtacttaagttttattagttagtaacctaaattaaatttatttaattaaacgtttacgttcgggtaacgggttaacccggttaccgggaaacccgaaaggggtaacccgtaaagggttgggttaaacttacggtaacgaaacggtaaccgtaagtgggttacggtcttaacgaaccc

SEQ ID NO: 429619 - DNA, 791 bp, Homo sapiens
  misc_feature: GZ8MTXP01AUL3V.19.71.G05.1.454.CMB.2.raw
  modified_base (239)..(239): a, c, t, g, unknown or other
  modified_base (726)..(726): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcnccagtccggtccggggacaggacgtcgactacggccgacgtaggttcgttcggtcgtttcggccgtacggtcggggtacgacggtccgtaccggtaccccgagtacgggtaggtacggttacgtaaggtcgggtacgggtaccggtaagggggaaacgtacgttaacgtttaacgtttccgaaacgttaccgtaacccgtaaacgggtaacggttaaaggtaaaacttaacgttaaaattacgtacgacctaacgtaagttcgtaggttacggagtacgtacgtaagtacgaactaaacgtaacgtaaacggtaacgaacctaacgtaaccggtaaacgtaaaacccgggtaacctttacccggttacccctaacccgttacggaacccgtaacgggttcccttaaccggtaacccgttcggttaccggggttaacccgtaaccccgggttaccggaaacggggttaaccgggttaaccggggtttnttaaacggtttaacgttacgggtaacgggaacggaaccggaccccgtaacccgttaagtaacccg

SEQ ID NO: 429620 - DNA, 524 bp, Homo sapiens
  misc_feature: GZ8MTXP01AXSMT.19.71.G05.1.454.CMB.2.raw
  modified_base (482)..(482): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatctccggggacagagcgctagcgacagtgttgcttggcacgtgggtcaggcagtccccagtcgagaggtctagagtggctgggaagacatattcaatcgtccaaacgacgtaggaatacaaattatgacacatctgttagagtagtacgactagacaatacaaacgtagaacgacaagtacgaagaacctagtcctccgtgcagtctcgacctctgttcgaccttccggagacacggggttnttacgttaatacgtggtacgacgttaccggccccaagtaacg

SEQ ID NO: 429621 - DNA, 599 bp, Homo sapiens
  misc_feature: GZ8MTXP01DLR4O.19.71.G05.1.454.CMB.2.raw
  modified_base (202)..(202): a, c, t, g, unknown or other
  modified_base (374)..(374): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtnaagccctcgcacgaccctctcgctcacctgtgccatcgtccggggacagagtcgctagcgactagtgttgcttggcacgtgggtcaggcacgtccccatcgagaggtctagacgtggcgtgggaacggactagtatttcatacgtccaacgacgtagaaataacaaatttanagacacctatactgttagagtaacgtacgtacgtagtaacaacttacgtaaacgaacgtaacaacaacgttaaccgtaaaacggaaaccctaaacgttcccgttcccttacgaccgaagtccgtacgtaccgtctaacgtcgttacccgtaccgacggtacgtacgggttagttagttaacgtttaacgtgtaagggaacgaccggacccctaagttaacgaacg

SEQ ID NO: 429622 - DNA, 655 bp, Homo sapiens
  misc_feature: GZ8MTXP01DPLT6.19.71.G05.1.454.CMB.2.raw
  modified_base (234)..(234): a, c, t, g, unknown or other
  modified_base (593)..(593): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttctcttctcctgccgtgctgggcctccacaaggtgtcctgtcacaagtacagctgcagcagtcaggtccaggactggtgaagccctcgcacgaccctctcgctcacctgtcnccatcgtcgggacagcgtcgctagcgactagtgttgcttggcacgtgggtacacggcctacgtccccagtcggagacggtctaggaggtggcgtaggggaacggactagttacttcaactcggtaaccaaacgtacggtaggaaactaacaaattagtacgactaacctagttcgtaggttacgaaggtacgttacgtacttacggaaacaacttaacgaaaacgttacgaaacgtaactaaggtaaaccgaaaacgtaacccttacggttccctacccgtagaccgtacgtcccttacggtaccctttgtacggttaccgtaacccgttaccgggaacgggtacggttaacggggttnttaaacgttaacgttaacggttcggtaacgggacggttacccggtaaccccaaggttaaccg

SEQ ID NO: 429623 - DNA, 531 bp, Homo sapiens
  misc_feature: GZ8MTXP01BKYD6.19.71.G05.1.454.CMB.2.raw
  modified_base (310)..(310): a, c, t, g, unknown or other
  modified_base (370)..(370): a, c, t, g, unknown or other
  modified_base (397)..(397): a, c, t, g, unknown or other
  modified_base (406)..(406): a, c, t, g, unknown or other
  modified_base (429)..(429): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctcacctgtcgccatcgtccggggacagagtcgctagcgacagtgttgcttggcacgtggggtcaggcacgtccccagtcgagngtctagagtggctgggaacgactatattcatcgtaccaacgacgtagaaatacaaattangcacatctgtgagagtacgactgacanacaacgtanacacgatacgaagaccagttccncctgcacgtctcgacctgtcgtcgaccgtcccgaaggaccgtacgggttacgttattacgttaacgtcggtaaggaacggcggacccctaagttaacgaacg

SEQ ID NO: 429624 - DNA, 720 bp, Homo sapiens
  misc_feature: GZ8MTXP01EGTJD.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacagagtcgctagcgacgtagttgttgcgttggcacgtgggcacggccacgtccccagtcgaggagtcgtaggagttgggacgtagggggaaacggtactaagttacgttttacaaacgttacggtaaccctaaacgtaaccgggttaaagggtaaaactttaaacctaaaaagtttaacgttccggaacctacccgtaatttccgttaggtttacggaaggttaacggttaccggtaacttacggaaactaaacgttaaccgaaaacggtttaacggaaaccgtaaacgttaaacgttaaaccgggaaacgtaaacccgttagtttcccttacccgttaggaccaacggtccttacgtaccctcgttcgttacgacccgttacccgggaagggtacgttacggggttcttaagtaacgtttacggtggttacgggaacggacccgggtaaccccttaaggtaaccg

SEQ ID NO: 429625 - DNA, 712 bp, Homo sapiens
  misc_feature: GZ8MTXP01DOHDD.19.71.G05.1.454.CMB.2.raw
  modified_base (229)..(229): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttctcttctcctgccgtgctggcctcccacaaggtgtcctgtcacaagtacagctgcagcagtcaggtccaggactggtagaacgccctcgcaacgccctctcgctcnctgcgccagtccgtcgggacagacgtcgactacgcgaactaggttcgttcgtcgttggcgtacggtgggtacacggcctaacgtccccagtcggaggacggtgtaggaggtcggacggtaggggaacgtacgtatttacttactaacgtacgtaaccgaaacgtaacggttaaaggtaaacttaaaacgttaaactttacgtcgtaaccctaaaccgttagtttaccgttagggtttaggaaacggttaaccggttaccgtaaacgtacgaaaccttaaacgtaccgaaaacgttacggaaacctaaacgtacgtaaaccggaaactaaacccgtacgttcccttacccgaagccctaagtccgtaccgttaaccgttcgtacggttaccgtacccggttacgggaacggtaaccggttacggttgtttaacgttaacgttaagcgggtaacggaccgttacccgtaacccttaagtaacccg

SEQ ID NO: 429626 - DNA, 576 bp, Homo sapiens
  misc_feature: GZ8MTXP01ETD3R.19.71.G05.1.454.CMB.2.raw
  modified_base (229)..(229): a, c, t, g, unknown or other
  modified_base (240)..(240): a, c, t, g, unknown or other
  modified_base (359)..(359): a, c, t, g, unknown or other
  modified_base (389)..(389): a, c, t, g, unknown or other
  modified_base (395)..(395): a, c, t, g, unknown or other
  modified_base (399)..(399): a, c, t, g, unknown or other
  modified_base (406)..(406): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagccgggccaccatcaactgacaagtccagccanaattcttttanacattaccaaacaatagaaaactcttagcttaggtaccagcagagaccaggacagcctctaggctgcttcatttacgggcatccgtacccggatcccggggtcccagacatcaggtgcngtcgggtctgggactagtattcactctacnccgtancacncgacgcncgcgacgcgagagtagtgggtgtagttagtttagttattagtaactaaacttaaattaattaattacgttacgttcggttaacggtacggttacggtacggaacggtaacgtaggttaggttacgttacgtaacgtacgaacggtacgtacggttacgtcgttcgtaacg

SEQ ID NO: 429627 - DNA, 610 bp, Homo sapiens
  misc_feature: GZ8MTXP01CNCNE.19.71.G05.1.454.CMB.2.raw
  modified_base (240)..(240): a, c, t, g, unknown or other
  modified_base (254)..(254): a, c, t, g, unknown or other
  modified_base (320)..(320): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccaggggacatcgtgatgacccagtctccagactccctggctgtgtctcgtgggcgagccgggccacgatcgaactgacaagtccagccacaattctttaanacagttacccaaanaatagtaaaactacttagctggtaccagcagagaccaggacagccctcgaggctgctacatttcgngggacagtccgtaacccgggaagttcccggggtccctagacccgtattcgaggtcggacctaggcggggtactggggactagtacttcgactctactacatcagcagcctgcaggctagaagtgtaggtgggacgttagttttattacgtgttaaccaaattaattactttaagttacttacgtttaccgggtagggttaacccgttacggttaacccgtaaaggggaccgaaagggtaggttaattacgttcgaacggtactaacgtggtagccttaacggcctaaccg

SEQ ID NO: 429628 - DNA, 679 bp, Homo sapiens
  misc_feature: GZ8MTXP01ETVY3.19.71.G05.1.454.CMB.2.raw
  modified_base (289)..(289): a, c, t, g, unknown or other
  modified_base (295)..(295): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctcacctgtcgccatcgtccggggacagagtcgctagcgacagtgttgcgttggctacgtgggtcaggcacgtccccatcgagngtcagngtggcgtagggaagactagtactttcatgtaccaacgacggtaggaaactaactaaaattactgacctaacccgaattcgtgggttagagtacgtacgactagaactaagtacgaaacgtagaactaaccgaagttaaccggaaacgtaaacctacggttccctacccgtacgacgtacgtaccgttacggtaacccgttcgttacggtaccgtaacccgttacccggggacggtaaccggttacgggggttacttaaacgttagtttacccggtaagggttacgggaaacgacccgggttacccctaaagtaccgggttaacttcgttaccgggtaacccctaccgttccggttaccttcggttcgggtcgttccgttaaggg

SEQ ID NO: 429629 - DNA, 581 bp, Homo sapiens
  misc_feature: GZ8MTXP01DIWQL.19.71.G05.1.454.CMB.2.raw
  modified_base (237)..(237): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcactgtcnccatcgtccggggacagagcgctagcgacagtgttgcgttggcacgtggtcgaggcacgtccccagtcgagaggtctagagtggcgtagggaagacgtatattcaattacgtccaaacgtacgtaggaaataactaaagttatcgacactatctgttagagtagtacgatagaacaagtacaaacgtagaacaacgtaatacgaaacgtaacctgttccacccgtgacctagtcctcgtacccttcgtcgttacgacccttccgggtaaacggccgttacggggttattacgtttaagttacgtggttacggaaacgggttacccgaaccccttaaggtaaccg

SEQ ID NO: 429630 - DNA, 619 bp, Homo sapiens
  misc_feature: GZ8MTXP01B6VUR.19.71.G05.1.454.CMB.2.raw
  modified_base (246)..(246): a, c, t, g, unknown or other
  modified_base (320)..(320): a, c, t, g, unknown or other
  modified_base (453)..(453): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagactcctggctgtgtctcgtgggcgaggcgggccacgatacgaacgtgactaagtccagccactaattctttanactactacaatatataaactctagctacgacagcagacgacgagacacgtcctacgtagctcactctatttcgnggcctacgtacccggtaacccggtacgtcccgggtacctacggtacgtagttcgaggtcgaccgtcggggtcgggtacgacgggtactacgtacttcacctcctacaactatcgacgcgtacgtcgacgacgngagagtagtagtcgggtacgtagttagttattatagtaactaactaattaattattacttacgttcgtaacggtacggttacggtaccggaacggtaacggtaacggttaggttacgttacgtaacgtacggtaacgtacggtacggttacgtaacgttcgtaacg

SEQ ID NO: 429631 - DNA, 612 bp, Homo sapiens
  misc_feature: GZ8MTXP01AJWUS.19.71.G05.1.454.CMB.2.raw
  modified_base (247)..(247): a, c, t, g, unknown or other
  modified_base (263)..(263): a, c, t, g, unknown or other
  modified_base (448)..(448): a, c, t, g, unknown or other
tcagtactctcgtgcacgaccggtgctcgatttagtgtcgtcgcaagagagagggggggaccagggcagtcaccagagctccagacaatgtctgtctccttcctcttcttcctgcccgtgctgggccctcccacaaggtgtcctgtcacaagtacagctgcagcagtcaggtccaggactggtgaagccctcgcagaccctctcgctcacctgtcgccatcgtccggggacagagtcgctagcgacngtgttgcttggcacgngggtcaggcacgtccccatcggagaggtctagagtggcgtaggggaagacagttatttcatgtaccaaacacggtaggaaactaactaaattatcgacaaccctatctgttagagacgtcgactagaactaactactaaacgtagaacaacacgtaacgaaacgtaaccctagtttcctacccgngacgtagtcgtacgtaccttcgtacgtaccgtacccgtacccgggtaacggtaaccggtacgggttagtaacttacgttacggtaaggtaacggaacggaccgaccccgtaagtaacgacgcgttccgtaaccctcgtcgttcgtcgttcggtcgttcgtaagg

SEQ ID NO: 429632 - DNA, 570 bp, Homo sapiens
  misc_feature: GZ8MTXP01EFG9Z.19.71.G05.1.454.CMB.2.raw
  modified_base (250)..(250): a, c, t, g, unknown or other
  modified_base (335)..(335): a, c, t, g, unknown or other
  modified_base (361)..(361): a, c, t, g, unknown or other
  modified_base (366)..(366): a, c, t, g, unknown or other
  modified_base (375)..(375): a, c, t, g, unknown or other
  modified_base (396)..(396): a, c, t, g, unknown or other
  modified_base (400)..(400): a, c, t, g, unknown or other
  modified_base (409)..(409): a, c, t, g, unknown or other
  modified_base (428)..(428): a, c, t, g, unknown or other
  modified_base (451)..(451): a, c, t, g, unknown or other
  modified_base (455)..(455): a, c, t, g, unknown or other
  modified_base (555)..(555): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctcctggctgtgtctcgtgggcgaggccggccaccatccaactgacaacgtccagccaactaattccttttanacacgttaccaaactaatacgaaaactcttagcttaggaaccagacaagacgaccaggacacgcctcgaggctgctctatttcgnggcagtccgaccggagtccggtcccngacgntcgagtgcnggcgtgagggactagtcttcnctcncacagcagntacgctgcgagtcagaagngtggggtgacgtttatttaagtnttanaactaaattaaattatttattaaacgttcgttggtaaggtccggttacgaaccggaaaggtaaccgtaaagttggaaacttcgtaacgagaaccgttagnggttacgcttgaacc

SEQ ID NO: 429633 - DNA, 575 bp, Homo sapiens
  misc_feature: GZ8MTXP01CBO69.19.71.G05.1.454.CMB.2.raw
  modified_base (241)..(241): a, c, t, g, unknown or other
  modified_base (401)..(401): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctcgtgggcagcgggccacgatcaactgacaagtccagccacaattctttanacagttccaaacaatagaaaactactaagctaggtaccagcagagaccaggacagcctaccaggctgctctaatttactgggacacgtcgtacccgggaatcccccggggtccctgaccgtatcaagtgcgagcgggtctaggggacagtactttcactntacaccattagcagcctgcaggcagaagtagtggtgtcgtaagtttattattcgtactaaataaattattaattatacgttcgtaaggtaacgttggacccgaaagggtaaaccaagggttaggttaattaagttccgaaagtaacgaaacgtacggttgaacggttgaacccg

SEQ ID NO: 429634 - DNA, 582 bp, Homo sapiens
  misc_feature: GZ8MTXP01EQ3YL.19.71.G05.1.454.CMB.2.raw
  modified_base (245)..(245): a, c, t, g, unknown or other
  modified_base (255)..(255): a, c, t, g, unknown or other
  modified_base (257)..(257): a, c, t, g, unknown or other
  modified_base (259)..(259): a, c, t, g, unknown or other
  modified_base (265)..(265): a, c, t, g, unknown or other
  modified_base (303)..(303): a, c, t, g, unknown or other
  modified_base (314)..(314): a, c, t, g, unknown or other
  modified_base (360)..(360): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgccccgaggggacatcgtgatgacccagtctccagacctcccgtggctgtgtctcgtgggcgagccgggccacgatacgactgacaagtccagccactattctttanacactacaanananaaactntagctacgacagcagacacgagacacgcctacgagctnctactattcgnggactacgtccggtacccgggtacgtcccgggtcccctagtacgtntcgaggtacgcgcggtcggtcgaggactagttctcactcacacatcacgacacgcgtcgacgacgacgtagagtagtagggtgtagttagttattattacgtaactaactaattattattacgttacgttacggtaacggtacggttaccggtacggaaacggtaacggtagttagttacgttacgtaacgacgtaacgtacgtcggttgtcgttcgtaacg

SEQ ID NO: 429635 - DNA, 628 bp, Homo sapiens
  misc_feature: GZ8MTXP01D7K00.19.71.G05.1.454.CMB.2.raw
  modified_base (312)..(312): a, c, t, g, unknown or other
  modified_base (373)..(373): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttctcctgcccgtgctgggcctccacaaggtgtcctgtcacaagtacagctgcagcagtcaggtccaggactggtgaagccctcgcagacccctctcgctcacctgtcgccatctccggggacagagtcgctagcgacagtgttgcttggcacgtgggtcaggcagtccccatcgagagtctagngtggctagggaagctatagtttcaattcgtccaaatacggtaggaaattaccaaaagtttntcgacacctattctagtttagagtaggtcgaacttgaacaaatacaaacgttagaacgaactaacgttaaccgaaacgtaaacccgtacggtttaccctaccctagtacccgaacgtaccgtaccggtacccttaacgtcggttacgtaacccggttacccgaaacgggtaaccgttaccggggttgttaaacggttaactttaaccgtggttacgggtaaacggacggtaaccccccgttaagttaaaccccgg

SEQ ID NO: 429636 - DNA, 633 bp, Homo sapiens
  misc_feature: GZ8MTXP01BRLDC.19.71.G05.1.454.CMB.2.raw
  modified_base (242)..(242): a, c, t, g, unknown or other
  modified_base (256)..(256): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagctccctggctgtgtctcgtgggcgagccgggccaccatcaactgcaacgtccagccactaattcttttanactagttaccaaanaatagaaaacttctagctacggaccagcagacgaccagacacgcctacgtaggctgctctaacgtttacgcgggactacgtaccgtaacccggggaacgttcccccccgggggtaccctaggacccgtattccgaaacgggttcgggcgacgggtccggggttacgtacggggaaccttagggtacttttacaccttcctacacccataccaaggcctaacgtcctcgacgtagggcttaagaacgtgttggtacggtattagtttatgttagtactaaatatttattacttagtacgttggtacgttacgttacgggaccgtaaaggtacgaagggttgattaacacgaagtaacgtagttgtaacggttctaacg

SEQ ID NO: 429637 - DNA, 724 bp, Homo sapiens
  misc_feature: GZ8MTXP01BBEIE.19.71.G05.1.454.CMB.2.raw
  modified_base (674)..(674): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtccggtaccggggacaggacgtcgacgtacgcgtaacgtaggttgttcgtcgttcggcgtacggtcgggtcgacggccgtaccgtcccccgagtccgggaaggtacggtacgtaaggacggtcggacggttaaggggaaacggtacttaagtttacttttaccgaaagttaccgtaacccgtaaacggtaacggttaaggtaaaacttaaacgtaaactttacgtacgtacctaaccgtaagtttcgttaggttaaggtacggtaacgttcccggtaaatacgtaaacctaacttaaaccggaaaacgttaacgaacctaaacgtaacgttaaaccgaaacgtaacccgttacgttccctccgttacgacgtacgtacctcgaccttcgttacgacggtaacccgttccgggaaaggtacccgttaggttnttaacgttaagtacgtaacggaacggacgacccgtcccgttaagtaaccg

SEQ ID NO: 429638 - DNA, 636 bp, Homo sapiens
  misc_feature: GZ8MTXP01EJ2UB.19.71.G05.1.454.CMB.2.raw
  modified_base (241)..(241): a, c, t, g, unknown or other
  modified_base (252)..(252): a, c, t, g, unknown or other
  modified_base (256)..(256): a, c, t, g, unknown or other
  modified_base (262)..(262): a, c, t, g, unknown or other
  modified_base (265)..(265): a, c, t, g, unknown or other
  modified_base (375)..(375): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccaggggacatcgtgatcgacccagtctccagactccctggctgtgtctcgtgggcgagcgggccacgactacgactgacaagtccagccacaattctttaanacactacaaanatanaaactntanctagacagacaagacgacagacacgtcctcgtagctcgtctacgtacgtttacgcggtactacgtccggtaaccgggacgttcccggggtacctacggacctacgttcgnggtcggaacgtacgggtcgggtacgtacgggactagtacttacgacttctacactagacacgacgacgacgtcgacgacgacgtagaagtagtgtacgggtacgttaagtttattagttactaactaacttaaattaatttaacttacttacgttacgttacggtaacggttacggttacggtaacgggttaacggtaacggtagttagttacgttacgtaacgtacgtaacgtacgtacgttacgtaacgttaacgtaac

SEQ ID NO: 429639 - DNA, 776 bp, Homo sapiens
  misc_feature: GZ8MTXP01ERMQW.19.71.G05.1.454.CMB.2.raw
  modified_base (242)..(242): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagccgggccacatcaactgcaagtccagccactaattctttanacacgttaccaaataaatagaaaacttactagcttaggaccagacagacgaccagaccagcctcgtaggctgctactagttttacgcgggctacgttacccgtaaccccgggggtaagtcccccgggggttccccctacggtaccgtagtttccgaagggttcgggaccgtaacggggttccgggggttactacgggggtaacctaagggttaccttttccgacccttactaccaaccctaattccgaacggcccaacggtcccgttacgacgaacggggtcctaaggaaaagtcgttacggggggttacggtttaactttaaagggttttttaactttaacggtttaagtaaccttaaaaactttaaattttaaagttttaaacgtttaaaacgtttacccgtttggggttaaccggggttaaccgggtttacccggggaaaccgggttaaaacggggtaaaccgtaaagggggtttaagaacttacggtaacgaacgttaaccggtaagtcgggttacgtcgttaacgtccg

SEQ ID NO: 429640 - DNA, 553 bp, Homo sapiens
  misc_feature: GZ8MTXP01DBZTC.19.71.G05.1.454.CMB.2.raw
  modified_base (307)..(307): a, c, t, g, unknown or other
  modified_base (521)..(521): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttaacagttcccaaacaatagaaaactacttagctggtaccagcaagagaccaggacagccctctaggctgctanatttacgtgggcagtcgtacccgggaatcccggggtcccctggaccgtagtcgaggtcggcgaagggtcgggtctcggggacagtactttcgactctcacatcagcacgctgcgagctagaagagtcgtaggggtactagtttatagttcgtaacaaataattaattattatacttcgtggtaacgttcgacgtaaggactaaagggtgaattnactaaggaactaacgtgtacggctgaactaac

SEQ ID NO: 429641 - DNA, 570 bp, Homo sapiens
  misc_feature: GZ8MTXP01BP6XK.19.71.G05.1.454.CMB.2.raw
  modified_base (203)..(203): a, c, t, g, unknown or other
  modified_base (390)..(390): a, c, t, g, unknown or other
  modified_base (421)..(421): a, c, t, g, unknown or other
  modified_base (438)..(438): a, c, t, g, unknown or other
  modified_base (443)..(443): a, c, t, g, unknown or other
  modified_base (469)..(469): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtnaacgccctcgcacgacccctctcgctcacctgtcgcccatcgtccggggacagacgtcgcgtagcgacgagtgttgcgttggcacgtgggtcaggccacgtccccagtcgaggtagtcgtagagtggcgtaggggaacgactattacttcagtcgtaacccaacgacgtaggaaattaacgaaattntcgacactatctgttgagtagtacgacgtanacaaatacgaaacgtanacganaatacgaagaacctacgtcctaccgngcacgtctcgccttgtcgttacgaccgtaccggaggacgtacgggttattacgttaagttaaccgtggtaacggaacggccgaccctaagttaacgaaccg

SEQ ID NO: 429642 - DNA, 652 bp, Homo sapiens
  misc_feature: GZ8MTXP01BPWEN.19.71.G05.1.454.CMB.2.raw
  modified_base (599)..(599): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtccgtccggggacaggagtcgctagcgactagtgttgcgttggctacgtgggtcacggcacgtccccagtcggagtacgggtctaggaggtgggacgtacggggaaggactagttatttcgaaacttcggtccaaacgtaaccgggtagggtaaaacttaacgtaaaagtttactacgacctaaccgtaattcgttaggttagaaggtacgtcggtactaggaacaaactacgaaacgtacgaaccaacgtaacgtaacgaaacggtaacctcgtttaccctccgtacgctacggtcctacgtaccctcgtcggttaccgtacccgttacccggaaggtaaccggttacggggttnttaagttaacgttagtaagggtacggaacgaccggtaaccccttaagtaaccg

SEQ ID NO: 429643 - DNA, 622 bp, Homo sapiens
  misc_feature: GZ8MTXP01AKZDF.19.71.G05.1.454.CMB.2.raw
  modified_base (236)..(236): a, c, t, g, unknown or other
  modified_base (244)..(244): a, c, t, g, unknown or other
  modified_base (254)..(254): a, c, t, g, unknown or other
  modified_base (263)..(263): a, c, t, g, unknown or other
  modified_base (288)..(288): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtcctccagacctccctggctgtgtctcgtgggcgagccgggcctacgatacgactgactaagccagccanaatcttanacactacaanatagaactntagctagacagcagacgacgagacncgcctacgtagctctctactacgttacgtcggtacgtacgtaccgtaccggtacggtccggtccccgtacgtacgtacgtcgtacggtacggcgcggtcgggtacggtacgggtacgtacgtacgttactactacctacctactactacgacgcgacgtcgtcgcgacgtacgtacgagtagtaggggtcgtacgttagttagttacgttacgtactaactaattacttattacttacgttacgtcggtacgttaccggtacggaacggtaacggtaaggttagttacgttacgtaacgtacgtaacgtacgtacggttacgtcgttcgtaacg

SEQ ID NO: 429644 - DNA, 670 bp, Homo sapiens
  misc_feature: GZ8MTXP01C0S6E.19.71.G05.1.454.CMB.2.raw
  modified_base (236)..(236): a, c, t, g, unknown or other
  modified_base (253)..(253): a, c, t, g, unknown or other
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgccgtgctgggcctccacaaggtgtcctgtcacaagtacagctgcagcagtcaggtccaggactggtgaacgccctcgcacgacccctctcgctcacctgcnccatccgtaccgggganaggagtcgctagcgactagtgttgcgttgcacgtgggtcaggcacgtccccagtcgagacggtcgaggaggtcggcgtaggggaaacggactagttactttacagttacgtaacccaacggtacgtaaggtaaacttaaacgtaaattacgtacgacctaaccgtatacgttagttagaagtacgtacgtaactacgaactaaacgtacgaaacgtacgaaaccaacgtaaacgtaacggtaaacctaaaccgttacgttaccctcccgttacgaccgtacgtactaccgtaccgtcgttaacgtaccggttacccgttaccgggaacgtaaccggtacgggttaacgttagttaacggttaacggtacgggttaacgggaaccggacccggttaaccccctaagaacccgtaaccg

SEQ ID NO: 429645 - DNA, 563 bp, Homo sapiens
  misc_feature: GZ8MTXP01A1QV5.19.71.G05.1.454.CMB.2.raw
  modified_base (259)..(259): a, c, t, g, unknown or other
  modified_base (288)..(288): a, c, t, g, unknown or other
  modified_base (342)..(342): a, c, t, g, unknown or other
  modified_base (388)..(388): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgngggtcaggcagtcccatcgagagtctagngtggctagggagactatatttcaatcgtaccaacacgtggaactacaaatttangacaaccattctgtgagagtcgactagaactatacaacgtagacanaatacgaagaaccagttacctcctgacacgctcgtacctctcgtacgaccgtcccggaggaccgtacggtgtacgttacttacgtggtacggaacggtaccggaccccctaagtaacggaccttacgttccggtaacccaacccgttcgtcctacgttggtcgttaacgttaacg

SEQ ID NO: 429646 - DNA, 583 bp, Homo sapiens
  misc_feature: GZ8MTXP01CE5HB.19.71.G05.1.454.CMB.2.raw
  modified_base (236)..(236): a, c, t, g, unknown or other
  modified_base (246)..(246): a, c, t, g, unknown or other
  modified_base (256)..(256): a, c, t, g, unknown or other
  modified_base (362)..(362): a, c, t, g, unknown or other
  modified_base (387)..(387): a, c, t, g, unknown or other
  modified_base (411)..(412): a, c, t, g, unknown or other
  modified_base (422)..(422): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagactccctggctgtgtctcgtgggcgaggccgggccacgatacgaactgacaagtccagccanattctttaanacactacaanataactaaactatagctagacagcagacgacgagacacgcctacgagctgactactagttacgcggactacgtaccggtaccgggacgtccggtcccctagacgtntcgaggcgacgcgggtcgggtacgngggacacgttctcacctctacacnncacgcacgcngcgacgagagagtgtgggtagtacttaattatagtacgataaattaattattaacttacgtacggttcggtaacggttaaccgttacggaaaccggaaacgggtaacgtaaggttagttacttacgtaacgaagtaacgtagtcgttacgtaacttcgaac

SEQ ID NO: 429647 - DNA, 636 bp, Homo sapiens
  misc_feature: GZ8MTXP01B9II2.19.71.G05.1.454.CMB.2.raw
  modified_base (246)..(246): a, c, t, g, unknown or other
  modified_base (260)..(260): a, c, t, g, unknown or other
  modified_base (322)..(322): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgaggccgggccaccatacaactgacaagtccagccataattctttanactattacccaaanaatagaaactactagctgaccagcagacgacagacagccctactagctgctactatttacgnggactagtcccgtaaccgggacgtcccggggtaccccctggaccgtattccgaggtcggactgggtcgggtctacgggggaactagtctttaccgactcctacacctactcgaacgcccgacgtccctagaccgaggtctaaggaaagtgtaggggtacggtactttaagtttattatagttaaccaaattagttatttagttacttacgtcgggttaacgtaaccggtttcgggaaaccggaaacgggtaacgtaagggttattagttaactaaccgaaagtaaccgtaaggtggttcgtaacgttcgaaccc

SEQ ID NO: 429648 - DNA, 707 bp, Homo sapiens
  misc_feature: GZ8MTXP01CS747.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgcccagtccgtccggggacaggacgtcgctaggcgacaggtgttgcttggcacgtgggtcaggcacgtccccagtcggaggaggtctaggagtggcgtaggggaaaggactagttatttcaaattcgtaacccaaacgtacggtaggtaaaataacgtaaaatttacgtacgacctaacctaagttcgttaggtttacggaaggtaacggttaccggtaacgttacggaaacctaaacgtaaccgtaaacggttaacggaaaccgtaaacgtaaacgttaaccggaaaaccgtaaacccgttaacggtttaccccttacccgttacggacctaacggccttacggtaaccccttcgtacggttaccggaacccgttacccgggtaacgggtaccgttaacggggttcgttaagtttaacgtaccgttgggttaagggaacggacccggaacccccgttaagtaacccg

SEQ ID NO: 429649 - DNA, 726 bp, Homo sapiens
  misc_feature: GZ8MTXP01DD4PF.19.71.G05.1.454.CMB.2.raw
  modified_base (323)..(323): a, c, t, g, unknown or other
  modified_base (334)..(334): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttctcttctcctgcccgtgctgggcctcccacaaggtgtcctgtcacaagtacagctacagcagtcacggtcaggactggtagaacgccctcgcacgtaccctctcgctcacgtgtcgccactccggtccggggacaggacgtcgctagcgacagttgtgcgttggcacgtgggtcagggccacgtaccccagtacggaggnggtacgtaggnggtagggccgtaaggggaaccgtactaagttacgtttacacgttaaccgtaacccgaacgtacggtaaacgggtaaaacttaactttaaaacttacgtacgtacctaacgtattccggttaaggttacggaaggttccggttaaccgtaacttacggaaaccttaaacgttaaccgaaaacggtaacgaaccctaaacggtaacgttaaaccggaaaaccgttaacccggtactttccctacccgttcgaaaccgtcgtccggttacgtaaccctcggtaacgttcccgaaacccggtcccgggttaaagtacccggttaacgggttgttaagttacccgttaaggtggtaacgggacggtaccccggaacccttaaggttaacccgtaacg

SEQ ID NO: 429650 - DNA, 551 bp, Homo sapiens
  misc_feature: GZ8MTXP01CF5B5.19.71.G05.1.454.CMB.2.raw
  modified_base (241)..(241): a, c, t, g, unknown or other
  modified_base (297)..(297): a, c, t, g, unknown or other
  modified_base (323)..(323): a, c, t, g, unknown or other
  modified_base (376)..(376): a, c, t, g, unknown or other
  modified_base (433)..(433): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccacatcaactgcaagtccagccaactaattctttanacacgttaccaaacaatacgaaaactcttagcttaggaccagcagagaccaggacngccctcgtaggctgctctatttacgnggctagtccgtacccgggatcccggggtcccctggaccgtattcgagtcggcngggcgggtcgtgggactagtctttcactctcaccatcagcacgctggcagctaggangtggggtgtacttagtttatattgactaatattattatattacgtgtaaggtacgttcggaaccgaagggtacctaagggttgattacgaacgagtaacggtatggcggtcttgaacc

SEQ ID NO: 429651 - DNA, 645 bp, Homo sapiens
  misc_feature: GZ8MTXP01CXCZD.19.71.G05.1.454.CMB.2.raw
  modified_base (258)..(258): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgccacgaccctctcgctcacctgcgccagtccgtccggggacaggngtcgctagcgacagtgttgcgttggcacgtgggtcaggcacgtccccagtcgagtaggtctaggagtggcgtaggggaacgtactattattcagtacgtacccaagacgtaagaaactaactaaattcagaccacctattcgtgtagagtacgtacgactagaacaactacgaaacgtacgaaccaacgtaacgtaacgaaacgtaaccgtacgtttaccctcccgttagacctacgtaccgtacgtacccgttgtaaccggttacgaccccgtaaccggggaacggtaaacccgggtacgggtttaacgttacgtttaaaccgtttaacggtacgggtttaacgggaaaccgtacccggttacccccgtaagttaaccgtaacccg

SEQ ID NO: 429652 - DNA, 622 bp, Homo sapiens
  misc_feature: GZ8MTXP01DVSNN.19.71.G05.1.454.CMB.2.raw
  modified_base (408)..(408): a, c, t, g, unknown or other
  modified_base (573)..(573): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctcttctcttctcctgccgtgctggcctcccacaaggtgtcctgtcacaagtacagctgcagcagtcaggtccaggactggtgaacgccctgcacgaccctctcgctcacctgtcgccactcgtccggggacagacgtcgctagcgacagtgttgcgttggctacgtggtcacgcaccgtccccagccgagtaggtctagacggtggacgtaggggaaggtactagtttacttacaattacgtaacccaaagtaaccggtaagggtaaaataaccgtaaaagttacgtacncctaacctattacgtagtttacgagtaacgttccgattacgaactaagtacgaaagtacaacggtaactaacgtaccgaaacgaacccttcgttacccttcccaagcgacgtacctcggaaccttcgtgttacgacccgttaccggaaaggacccgttagggttnttaacgttaatacgttgggacgaacggacccgtcccttaaaggtaaccg

SEQ ID NO: 429653 - DNA, 615 bp, Homo sapiens
  misc_feature: GZ8MTXP01AS2NP.19.71.G05.1.454.CMB.2.raw
  modified_base (242)..(242): a, c, t, g, unknown or other
  modified_base (323)..(323): a, c, t, g, unknown or other
  modified_base (377)..(377): a, c, t, g, unknown or other
  modified_base (399)..(399): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccacatcaactgacaagtccagccaataattctttanacagttaccaaacaatagaaaactctagcttaggtaccagcagacgaccaaggacagcctcctaggctgctctatttacgnggctatccgtacccgggaatcccggggtcccctggaccgtattccgagtggccnggcggtcagggacagtacttcnctctcacatcagctacgcctgacgacggtactagaaagtgtgggtaggtacttaagttttattaacgttgtacctaaaacttattaactttaattaacctttacgtttacggtaacgggtaaccggtttccgggaacgttaaacggggtaaccgtaagggttacgttaattacgtaacgaaagtaacgtaaacgtggttacgtcgttcgtaacccg

SEQ ID NO: 429654 - DNA, 655 bp, Homo sapiens
  misc_feature: GZ8MTXP01DPJ4I.19.71.G05.1.454.CMB.2.raw
  modified_base (225)..(225): a, c, t, g, unknown or other
  modified_base (238)..(238): a, c, t, g, unknown or other
  modified_base (313)..(313): a, c, t, g, unknown or other
  modified_base (316)..(316): a, c, t, g, unknown or other
  modified_base (554)..(554): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcacgaccctcncgctcacctgtcnccagtccgtcgggacagacgtcgctacgcgactaggttgtgcttggctacgtggtcaggcacgtcccagtcgagngtnagagtggacgtaggaagtactagttactttacgaacgttacgttaaccccaaagtaaccgggttaaacggtaaaaacttaaaccgtaaaatttacgtacgaacctacctaagttcgtagttagaagtacgttacgagttacgaaactaacgtaaccgaaacggtacaaccgaactaacgtaaaccggaaacgtaacctacgtttcccaccgttacgctaacgtcctcgtaacccgttntacggttaccgtaccgttacccggaaggtaccggttagggttacttacgttaatttcggtaagggtaacggaacgttaccggtaaccccttaaggtaaccg

SEQ ID NO: 429655 - DNA, 639 bp, Homo sapiens
  misc_feature: GZ8MTXP01CWR8O.19.71.G05.1.454.CMB.2.raw
  modified_base (218)..(218): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctcttcctcttcttcctgccgtgctgggcctccacaaggtgtcctgtcacaagtacagctgcagcagtcaggtccaggactggtgaacgcctgcacgaccctntcgctcacctgtgccagtcgtccggggacagacgtcgctagcgactagtgtgcgttggcacgtgggtacacggcacgtcccagtcggaggtagtctaggagtcggacgtaggggaacgtactattacgtttaccagttaacggtaacccaacgtacgtaaggtaaaacttaactaaagttgtacacctaactatcgttaggttagaaggtacggtacgaactacggaacaaacgttacgaaacgtaacgaactaacgaacgttaacgggaaacaaaccgttcgttaccctccgtagaccgtaagtccgtacgtacccgtgtaacggtcgttaaccggtccgggaaggtaaaccggtacgggttaattcgttaacgttaacggtaggtaacgggaacgtaccggaccctaaggttaacaacg

SEQ ID NO: 429656 - DNA, 613 bp, Homo sapiens
  misc_feature: GZ8MTXP01BRS0U.19.71.G05.1.454.CMB.2.raw
  modified_base (392)..(392): a, c, t, g, unknown or other
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtccggtccggggacaggacgtcgctaggcgactaggtgttcgcgttggcacgtgggtcaggcacgtacccagtcggagtaggtctaggagtggacgtaggggaacgactagttattcagtacgtaccaagacgtagaaatactaaattancgacactatctgtagagtagtcgatgaacatacgaaagtacgacaacgtagtaacggaaacgtaacccgtgttccccgtcccgagtaccgacgtccttacggtccttacggtcgttaccggacccgttacccggggaaggtacgtaacggggtttattacgttaacgtttaacggtagggtaacgggaacggtacccggttaccctaagttaaccgaaccg

SEQ ID NO: 429657 - DNA, 713 bp, Homo sapiens
  misc_feature: GZ8MTXP01B86LG.19.71.G05.1.454.CMB.2.raw
  modified_base (223)..(223): a, c, t, g, unknown or other
  modified_base (513)..(513): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaacgccctgcacgaccctntcgctcacctgtcgccagtccgtccggggacagacgtcgactagcgactaggttgttcgcgttggacctacgtggggtacacgggaccacgtcccccagtccggaaggtacggtctaaggaggtgggtccgtaaggggaaggtactagttactttacgaaagttacgtaacctaaacgaacgggttaacggaaaataaacctaaatttacgacgtaccaacgttatcgttaggttacgaaggtaacggtcgtaacgttaacggaaactaaacgtaacgaaacgggtaaanaaccggtaaacgtaaagttaacccggaaaacggtaaacctaaccgtttccctaccccgtaggtccctaaacggtcctaaccgttccttcgtacggttaacccggtacccgttacccgggaaagggttacccgttaacgggggtttattaagttaacgttacgtaaggggtacggaaccggacccggtcccaaagtaaccg

SEQ ID NO: 429658 - DNA, 775 bp, Homo sapiens
  misc_feature: GZ8MTXP01DRXFK.19.71.G05.1.454.CMB.2.raw
  modified_base (243)..(243): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgagcggccacatcaactgacaagtccagccaactaattctttanactagttaccaaataatagaaaactctagcttaggaccagacagacgaccgagacacgccctacctaggctcgcttactatttacgcgggacctacgttacccggtaacccggggaacgttcccccgggggtaccccctacggaaccgtaatttccggaacggttccgggcgaacgggggtccgggttacgttacgggggaaacctaagggttacttttaccaaacccttccctaccgtaacccagtacccgaagggacccaacgggtcccctggaccgaagggaccttaagggaaaaggtgttggggggttacggtaaccgtttaaaggtttttaaattaacggtttaagtaacccttaaaaacttaaattttaacggtttaaatttaacgtttaaacgtttccgggttaaacgggttaccggtttaaaccgggaccccggttaaaaggggtacccgtaaaggggttacggttaattaacggtaacgaaacggtaacgttaaccgtgggttacgtcgttaacgtaaccccg

SEQ ID NO: 429659 - DNA, 590 bp, Homo sapiens
  misc_feature: GZ8MTXP01BYYL6.19.71.G05.1.454.CMB.2.raw
  modified_base (239)..(239): a, c, t, g, unknown or other
  modified_base (261)..(261): a, c, t, g, unknown or other
  modified_base (313)..(313): a, c, t, g, unknown or other
  modified_base (374)..(374): a, c, t, g, unknown or other
  modified_base (416)..(416): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccggccacagtcaactgacaagtccaagccaatattcttttaanactactacaatatacgaaactntagctagacagacagacgacgagacacgcctacgagctgacttctattacgngactacgtaccgtaaccgggacgtcccgggtacccctacggtacgtatcgaggtacgacgngggtccgggtacgacgggactagtcttacgactctacactanacagacgacgcctagacgagcgtagaagtgtaggggtacgtattaagtttattagtacgtaactaaattaattattaattacgttacgttaggtaacggtacgttcggaaccgaaggaaccgtaaggttagattacgtaacgacgtaacgtacgtgttacggtcgaacgtaacc

SEQ ID NO: 429660 - DNA, 611 bp, Homo sapiens
  misc_feature: GZ8MTXP01EHO1H.19.71.G05.1.454.CMB.2.raw
  modified_base (243)..(243): a, c, t, g, unknown or other
  modified_base (317)..(317): a, c, t, g, unknown or other
  modified_base (326)..(326): a, c, t, g, unknown or other
  modified_base (407)..(407): a, c, t, g, unknown or other
  modified_base (417)..(417): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatcgacccagtctccagacctcctggctgtgtctcgtgggcgaggccgggccacgatacaactgacaacgtccagccaactaattctttanactagttaccaaataatagaaaactacttagcttacggaccagacagacgaccaggacagcctctaggctgctntatttacgnggactagttccgaccggggactccggggtccccaggacctagttcagtggcaacgggcgggtctagggactaggtcttacnctcacactancacgcgacgtccgtgacgagacgtagtaagtagtagggtagtagttagtttaagttagttagtaactaaacttaattaattaatttacgttacgttcggttaacggtacggttacggtaacggaaacggtaaacggtaacggttagttacgttacgtaacgtacgtaacgtacgtagttacgtcgttcgtaacg

SEQ ID NO: 429661 - DNA, 682 bp, Homo sapiens
  misc_feature: GZ8MTXP01EMKAC.19.71.G05.1.454.CMB.2.raw
  modified_base (251)..(251): a, c, t, g, unknown or other
  modified_base (345)..(345): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccgatacgaactgactaagtccagccaactaattcttttaanactacgttaccaaactaataacgtaaaacttactagtacgttacggaccagacaagacgaccgagacacgtcctacgagctgctactagttcgnggactacgtaccggtaacccgggtacgtcccggtaccccacggtactagtaccgaggtcggacgtcgggtccgggtacgacgggtaactacgtacgtttaccacctcctaccaacctacgacgacgaccgtacgcctagacgacgtactagaagtgtgggtagtacgttaagtttaattacgtacgtaactaaattaactttatttaacttaacgttacgttgggtaacggttaaccggttaccggaaacggttaaacgggtaaccggtaaggttaacgttaacttacgtaacgtaacggtaacggttaacgtcggttacgtaaccgttaacgaacc

SEQ ID NO: 429662 - DNA, 741 bp, Homo sapiens
  misc_feature: GZ8MTXP01ALR1P.19.71.G05.1.454.CMB.2.raw
  modified_base (244)..(244): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccgatcgaactgacaagtccagccactaattcttttanacagttaccaaacaatagaaaactcttaagcttaggaccagcaagacgaaccgaaggaaacgccctacctaggctcgcttactaattttacgcgggacctacgtacccggttaaccccgggggtaacttcccccggggggtacccttaccgggaacccggtatttcccgaagggttcggaccgtacggccggggttccgtaggggacctaggttaactttccaacttccaccaccctaactacgacgcgacgccgtgacgacggtacgtaggaagtacgttaggtacgggtacgtttaaggtttattaacgttacgtaactaaacttaatttaacgtttaactttaacgttaccgttacggtacgggttaacccggttaaccgggaaaccgggtaaaccgggttaaaccggtaagggttaacggttaacgttacggttaaccggaacgggttaaacgtaacggtcgggtacggttcgtaacggttaacccgtaaccg

SEQ ID NO: 429663 - DNA, 639 bp, Homo sapiens
  misc_feature: GZ8MTXP01CBXKD.19.71.G05.1.454.CMB.2.raw
  modified_base (250)..(250): a, c, t, g, unknown or other
  modified_base (312)..(312): a, c, t, g, unknown or other
  modified_base (339)..(339): a, c, t, g, unknown or other
  modified_base (403)..(403): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctcccgtggctgtgtctcgtgggcgagccggccacatcaactgacaacgtccagccaactaattcttttaanactacgttaccaaataatacgaaaactcttagcgttaggaccagacaagacgacccaggacncgcctcgaggctgctactagtttacgnggctacgtacccgtaaccggggtacgtccccggggtacccctggaccgtattcgaggtcggccngggtcgggtacgtagggactagtactttcacttcctacaccatcacgcacgcctgacgaggcaggaagtgttggggtcgtagttagtttattcgttaactacctaaattaatttacttaatttactacggtttcggtaacgggttacgttaccggaaccggttaaagggtaccgtaggttagttacttacgtaacgtacggtaaccgtaacgtgggttacgtccgttcgtaacccg

SEQ ID NO: 429664 - DNA, 605 bp, Homo sapiens
  misc_feature: GZ8MTXP01A7VO3.19.71.G05.1.454.CMB.2.raw
  modified_base (241)..(241): a, c, t, g, unknown or other
  modified_base (318)..(318): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactcctggctgtgtctcgtgggcgagcgggccacgatacgactgactaagtcagccactaatctttaanactactacaatatacgaaactactagctagacagacagacgacgagacacgcctacgagctgtactatacgttacgngtactacgtaccggtaaccggtacgtcccgggtccctacgacgtagtcgaggtacgacgcggtcgggtacggtacggtacgtacgtacttactactacctacacactacgacgacgacgtcgtacgacgacgtacgtagagtagtagggtgtagttagttagttattacgtaactaattaattattattacgttacgtacggtaacggtacggttacggtaacggaacggtaacgtaagttagttagttacgtaagacgtaacgtacgtacgttacgtcgttcgtcg

SEQ ID NO: 429665 - DNA, 641 bp, Homo sapiens
  misc_feature: GZ8MTXP01DC7ZQ.19.71.G05.1.454.CMB.2.raw
  modified_base (353)..(353): a, c, t, g, unknown or other
  modified_base (592)..(592): a, c, t, g, unknown or other
  modified_base (633)..(633): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttctcttcttcctgccgtgctcgggcctcccacaaggtgtcctgtcacaagtacagctgcagcagtcaggtccaggactggtcgaacgccctcgcacgaccctctcgctcacctgtcgccagtccgtccggggacaggacgtcgcgtagcgacgtagttgttgcttggcacggtcggtcacggccacgtccccagtcggagacggtctaggagtggcgtagggaaggtactnttacgtttcaacttacgtaaccaaacgtaggtaaggtaaactaacaaatttacacgtacctactagttcgtaggttagaagtagttacgagttacgaacctaaagtaccgtaaacggtagaaccaaacgtaacgtaaaccggaaacgtaaacccttacgttccctacccgttaggacctacggtactaccgtcccttaagtcgttacgtacccgcgggtaaacgccggttaacgggttnttaaacgtttgtaaccgtggtacgggaacgccggtaacccnggtaaccg

SEQ ID NO: 429666 - DNA, 724 bp, Homo sapiens
  misc_feature: GZ8MTXP01B3AR6.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacagagtcgctagcgacagtgttgcttggcacgtgggtcaggcacgtccccagtcgagaggtctaggagtggcgtaggggaaggactagttactttcgaaagttcgtaacccaaacgtaacgggttagggaaaacttaaacgtaaaatttacgtacggacctaaccctaacgttacgttaggtttaggaaggtaacggttaccgtaaccgttacggaaaccgtaaactaccgtaaaaccggttaacgaaaccgtaaaccgtaacgttaaacccggaaaccggtaaacccctacgtttacccgtaccccgttacgtaccgtaacggtccttaccggtacccttccgttcggttacccggtaacccgttacccgggaaacgggtaacccgttacggggttacgttaacgtttaacgtttaccggttaagggttaacgggaacggttacccggaacccccgttaagtaacccgg

SEQ ID NO: 429667 - DNA, 596 bp, Homo sapiens
  misc_feature: GZ8MTXP01B48UD.19.71.G05.1.454.CMB.2.raw
  modified_base (249)..(249): a, c, t, g, unknown or other
  modified_base (339)..(339): a, c, t, g, unknown or other
  modified_base (398)..(398): a, c, t, g, unknown or other
  modified_base (409)..(409): a, c, t, g, unknown or other
  modified_base (460)..(460): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgaggccggccaccatacaactgacaagtccagaccactaattcttttaanactacgttaccaaataatacgtaaaactacttagcttaggaccagacagacgaccaggacacgccctacctaggctgctactatttacgnggacacgtccgtaacccggggactccccggggtcccctaggacgtatccgaggtcgcgnggtcgggtcgngggacagtacttcactctacaccatcacgcacgcctgcgaggcgtagaagngtggggtcggtactttagtttattagtagtaacaattaattattattactacgttggtaacggtacgttcgggacgaaagggtaccgaaggttagttattacgtaacgacgaacgtacgtgttagtcgttcgaacc

SEQ ID NO: 429668 - DNA, 746 bp, Homo sapiens
  misc_feature: GZ8MTXP01A48OD.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcacgacccctctcgctcacctgtgccagtccgtccggggacagagtcgctagcgacaggttgtcgtcttggcacgtcgggtcacgggtcacgtaccccgatccgggagacgggttcctaggtaggtcggacgttaggggaagtactagtttacgtttcaagttacgtaacccaaacgtaacggttagggaaaacttaaccgtaaaagtttacgtacggtaccctaaacctaacgtttaccgttaggtttaacgggtaacggtaacggttaccggtaacgttacggtaaaccgttaaacttaccgaaaaccggttaacggaaacctaacgtaaacgttaaccggaaaacgtaaaccgttaaccgtttacccgttacccgttacggaccgtaaccggtacgttacccgtaaccgttaaccgtacggttaccggtaacccgttacccggtaaacgggtaccgttacccgggttgttaaacgttaacgttacgtaaggttacgggaacgttaccgggtaaccccttaagtaacccg

SEQ ID NO: 429669 - DNA, 669 bp, Homo sapiens
  misc_feature: GZ8MTXP01DJSID.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgaccctctcgctcacctgtcgccagtccgtaccgggggacaggacgtccgcgtagccgacgtaggttggttgcgttggctacgtgggtcaggcacgtccccagtcggagaggtcgtagaggtggacgtaggggaaggtactagttatttcaaagttcgaaccaaacgtacggtaaggtaaactaactaaaattcgtacgacctactagtcgttaggttaggaagtaacgtacgtaactacgaactaaacgtaccgtaaaacgtacgaaccaacgtaaagtaaaccggaaacgtaaaccctacggttccctcccgtaggacctaaggtccttacgtacccgttgtacggttaccggacccgttccgggtaaacgggacggttaacggggttctttaagttaacgtttaacggttgggtaacggaacggttacccggtaaccccaaggtaaccg

SEQ ID NO: 429670 - DNA, 598 bp, Homo sapiens
  misc_feature: GZ8MTXP01DEML1.19.71.G05.1.454.CMB.2.raw
  modified_base (242)..(242): a, c, t, g, unknown or other
  modified_base (325)..(325): a, c, t, g, unknown or other
  modified_base (367)..(367): a, c, t, g, unknown or other
  modified_base (379)..(379): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccacatcaactgacaagtccagccaactaattctttanactagttaccaaataatagaaaactacttagcttaggaccagcaagacgaccaggacagcctctaggctgctactatttacgnggcactccgtacccgggatccccggggtcccctaggaccgtnttcgaggtcgcnggcgggtcgagggacagtacttcactctcaccatcagcagcctgacgaggctagaagtgtggggtaggtacttaagtttattagttagtactaaataattatttaattaactcgttacggtaacggtaaccggttccgggaaaccgaaaggggtaaccgtaagggttcgaaattacgtaacgaaaggaaccgtaagtggttacggtcgttcgtaacccg

SEQ ID NO: 429671 - DNA, 655 bp, Homo sapiens
  misc_feature: GZ8MTXP01CXCFE.19.71.G05.1.454.CMB.2.raw
  modified_base (339)..(339): a, c, t, g, unknown or other
  modified_base (379)..(379): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgacccctctcgctcacctgtcgcccatcgtccggggacagagtcgctagcgacagtgttgcttggcacgtggggtcaggcacgtccccatcgagaggtctagagtggctagggaacggactatntttcatcgtaccaagtacgtagggaaattacgaaattacngacacctatctaggttagagtacggtacgacttaggaacaaacttacgaaacggttaacgaaccgtaactaacgttaccggaaaacgtaaccccgttaaaggtttccccgttaccccttacggggtaccaacgggtcctttacgaacccgtttccgtaacgggtacgttaccccggttccgggaaacgggtacccgtaagggggtttacttaacggttatttaacgttcggggaacgggtaacggacccggggttaccccaaggttaaccgaaccg

SEQ ID NO: 429672 - DNA, 597 bp, Homo sapiens
  misc_feature: GZ8MTXP01ELKE8.19.71.G05.1.454.CMB.2.raw
  modified_base (237)..(237): a, c, t, g, unknown or other
  modified_base (314)..(314): a, c, t, g, unknown or other
  modified_base (344)..(344): a, c, t, g, unknown or other
  modified_base (518)..(518): a, c, t, g, unknown or other
  modified_base (528)..(528): a, c, t, g, unknown or other
  modified_base (590)..(593): a, c, t, g, unknown or other
  modified_base (595)..(595): a, c, t, g, unknown or other
  modified_base (597)..(597): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaattcttttatacagttaccaacaatagaaaactacttagcttggtaccagcagagaccaggacagcctcctaggctgctctatttacgnggcagtccgtacccgggatcccggggtccctgaccgtattcgagtggcgaggcgggtctgggacagtatttcactcncacctatcagcagcctgcaggctagaaagntgtaggtctagttttatattgtactaaaataattaatttatttatacgttcggtaggtaccgtttacgggaaccgtaaagggggacctaaagggttgattaacgtacgaaaggtacgtaacgtggtagccttagacctacctaggttcttagttccttcaacttcccgttcccnctactcgtanaccgaacggtgaaacggttcagggacgggttcggtacgtccgggagacggggcctaagagtnnnngngn

SEQ ID NO: 429673 - DNA, 604 bp, Homo sapiens
  misc_feature: GZ8MTXP01EDVEJ.19.71.G05.1.454.CMB.2.raw
  modified_base (243)..(243): a, c, t, g, unknown or other
  modified_base (332)..(332): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccggccaccatcaactgacaagtccagccaataattcttttanactagttaccaaataatacgaaaactacttagcttaggaccagacaagacgaccaggacacgccctacgtaggctgctactatttacgnggctacgtaccgtacccgggacgtcccggggtcccctaggacgtattcgaggtacggacgtcgggccgggtacgtaggggactaggtactttacaccgtctaccactatcagctacgcctgcgtaggactagaaagtgtggggtgtacttaagtttatatcgtaactaaattattattaattacgtacttgggtaacgtacgttacgacgttaaagggacgtaaggttacgattacgtaacgagtaacgtaacgtggttcgtcgttgaaccc

SEQ ID NO: 429674 - DNA, 709 bp, Homo sapiens
  misc_feature: GZ8MTXP01BKOUC.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactgggtgaacgccctcgcacgacccctctcgctcacctgtcgccagtccgtccggggacaggacgtcgctagcgactagtgttgcgttggcacgtgggtcacggccacgtccccagtcggaggtacggtcgtaggaggtcggacgtaggggaaggactattatttacaagttcgtaaccaaacgtacggtaggaaacttaacgtaaatttactacgaccaaccgtattcgtaggttaggaagtaacggtacgtaacgtagaaactaaagtaccgaaaacgtaacgaactaacgtaaacgttaaccggaaaacggtaaaccctaacggtttccctaccccgttacggaccctaacggtccgttacggtaccccttaacggttcggttaccggtaacccggttacccgggaaacgggtaccggttaaccgggggtttgttaaacgtttaagttaaccggtaagggttaacggggaaacccggttaccggtaacccccgttaagttaacccgg

SEQ ID NO: 429675 - DNA, 722 bp, Homo sapiens
  misc_feature: GZ8MTXP01BEPV4.19.71.G05.1.454.CMB.2.raw
  modified_base (619)..(619): a, c, t, g, unknown or other
  modified_base (678)..(678): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtcgaacgccctcgcacgaccctctcgtctcctcctcgtcgtccactccgtccgggacggagacggtcgacgtacgtacgacgtaggttggttcgtcgttcggtcgaccgtacgggtcggtacgacggtaccgtaccccgtaccgtacggtacggtacgggtacgtacggtacgggtcgggtaccggtacgggggtaaacggggtaacgtaacgtttacgtttacgtaacgttacgtaaccgtaaaccgtaaacgggtaacggtaaaagtaaacttaaaacttaaagtacgtacccgaaactaaccgttgttcgggtttaaggaacggtaacggtccgttaacgaacgtaaacaaacttacggaaacgttaacgaacacgtaataaccggaaacggaaaccttccggttcctaacccngacgtacgtcctacgtcctcgttcgacgtacccgttccggaaggtacggttacggtttnttaacttaagttcgtaaggaacggacgacccgtcccgaagtaag

SEQ ID NO: 429676 - DNA, 664 bp, Homo sapiens
  misc_feature: GZ8MTXP01AMICC.19.71.G05.1.454.CMB.2.raw
  modified_base (329)..(329): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgcgccagtccgtccggggacaggacgtcgctacgcgacaggtcgttgcgttggcacgtgggtcaggcacgtccccagtcggagtaggtctaggngtggcgtagggaaggactatacttcaatcgtaaccaacgtacggtaggtaaactaacgtaaagttactacggacctaacctagttaccgttggttacgaaggtacggttaccgtaacttaggaaacctaaacgttaccgaaacggttacgaacaacgtaagttaaccgaaacgtaaccctacgtttcccacccgttaggacctacggtcctaccggtaacccttcgtcggttccggaacccggttaccccgggaagggtacccgggttacgggttgttaacgttaacgttacgtaacgggtacggaaccggttacccgggccccttaagtaaccg

SEQ ID NO: 429677 - DNA, 597 bp, Homo sapiens
  misc_feature: GZ8MTXP01A2NO5.19.71.G05.1.454.CMB.2.raw
  modified_base (432)..(432): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccagtccgtccggggacagagtcgctagcgacagtgttgcttggcacgtgggtcaggcacgtccccagtcgagagtctaggagtggcgtagggaagactattattcatcgtaccaagtacgtagaaactactaaattatcgactaaactattcgtagtagagtacgtacgactagaactaatacgaaacgtagacacatacgaaacacctacgttcncctgactacgctacgtaccttcgtacgtaccgaccgtaccggacggtaaccggtcgggttagtaacttacgttacgtaaggtaacgggaacggtaccgaccccgtaagtaacgacttcgttccgaaccctccgtcgtctcggttcggtcgttaacgtttaacggg

SEQ ID NO: 429678 - DNA, 559 bp, Homo sapiens
  misc_feature: GZ8MTXP01B7ZI0.19.71.G05.1.454.CMB.2.raw
  modified_base (242)..(242): a, c, t, g, unknown or other
  modified_base (254)..(254): a, c, t, g, unknown or other
  modified_base (319)..(319): a, c, t, g, unknown or other
  modified_base (348)..(348): a, c, t, g, unknown or other
  modified_base (355)..(355): a, c, t, g, unknown or other
  modified_base (365)..(365): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacatcaactgacaagtccagccactaattcttttanacagttaccaanaatagaaaactctagcttaggaccagcagagaccaggacagcctcgtaggctgctctatttacgnggcatcgtaccgggatcccggggtccccngaccgtntcagtcggcnggcgggtctgggacaggtactttcactctcaccatcagcagcctgcagctagagagtcggtgcttagtttatagtgactaataattattacttagtaccttggtcggtacgttcgggaccgttaaagggtacccgtaagggttcggttaattacgtcgaacggtaacgtaacgtggttacggtcttcgtaaccc

SEQ ID NO: 429679 - DNA, 728 bp, Homo sapiens
  misc_feature: GZ8MTXP01EV0KV.19.71.G05.1.454.CMB.2.raw
  modified_base (657)..(657): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtccggggacagagtcgctagcgacagtgttgcttggctacgtggtcaggcacgtccccagtccgagtaggtctagagtggcgtaggggaagactaattatttacgaagttacgtaacccgaaacgtacgggtaggtaaaacttaaaccgtaaaatttacgtacgaaccctaacctagtttaccgttagggtttagaacgggttaaacggttccggtaaacttacgggtaaaccaaaccgttaacgaaaaccgggttaaccaaccgtaaacgtaaaccgttaaccggaaaaccgtaaccccgttacgtttccctaccccgttaggccctaacggtcctacggtaaccccttcggtttacggttaccggtaacccgttacccgggaaacgggttaacccgttacgggggtttnttaacgtttaacggtttaccggtaaggggtaacgggaacccggttacccgtaaccccgttaaagtaaccgg

SEQ ID NO: 429680 - DNA, 541 bp, Homo sapiens
  misc_feature: GZ8MTXP01D4PXC.19.71.G05.1.454.CMB.2.raw
  modified_base (225)..(225): a, c, t, g, unknown or other
  modified_base (235)..(235): a, c, t, g, unknown or other
  modified_base (314)..(314): a, c, t, g, unknown or other
  modified_base (458)..(458): a, c, t, g, unknown or other
  modified_base (480)..(480): a, c, t, g, unknown or other
  modified_base (512)..(512): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaattctttanacagttccaaacaatagaaaactctagctggaccagcaagacgaccaggacagccctcctaggctgctactatttacgngggcagtccgtaccccggggaatcccgggggtcccctacggaccgtagttccgaggtcggacagggcggggtctggggaacagtactttcaacttctacacactcagcagtcctgcaggctagagactgtggggctagtttatnttgacaatatattatatcttgngtaacgttcgacgtaagggactaaggtgattnttcgaagtaccgaatcggagctggctaac

SEQ ID NO: 429681 - DNA, 592 bp, Homo sapiens
  misc_feature: GZ8MTXP01AWVZL.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagacgcgctagcgacaggtgtgcttggcacgtggtcaggcacgtccccagtcgagaggtctagaggtggcgtaggggaagactatattcaatcgtccaaactacggtaggaaataacgaaattactacgacactatcgtgttagagtagtacgacgtagtaacaatacgaacgtagaacaactaacgtacgaaacgaacctacgttacctacctcgtacacgtacgttcgaacccttaagtcggttacgacccgttacccggaaggtaaccgttacgggttgttaacgttaacgttacgtaagggtacgggaacggaccggaaccccgttaagtaaccgg

SEQ ID NO: 429682 - DNA, 612 bp, Homo sapiens
  misc_feature: GZ8MTXP01DPRY6.19.71.G05.1.454.CMB.2.raw
  modified_base (230)..(230): a, c, t, g, unknown or other
  modified_base (240)..(240): a, c, t, g, unknown or other
  modified_base (273)..(273): a, c, t, g, unknown or other
  modified_base (403)..(403): a, c, t, g, unknown or other
  modified_base (466)..(466): a, c, t, g, unknown or other
  modified_base (490)..(490): a, c, t, g, unknown or other
  modified_base (515)..(515): a, c, t, g, unknown or other
  modified_base (574)..(574): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcggccacatacaactgacaagtccagccanaattctttanactacgttaccaaactaatagaaaactacttancttggaaccagacaagacgaaccgtaggaccaacggtccctactagggcctgacctcgtaacttttacgtgggactaacgttcccgtaaaccccggggaattcccccgggggtaccccctaggaaccgtnttcccgaggtcggactaaggtcggggtccttaggggactagtatttccactctcacatccganccagccctagccgaggcagaagtntggtcggattaagtttatactgtanaaatattattatacgttacgtcgtaaggtacgttcggaaccaagggacctagggttagnttaacggctaaacgaagtacgtgttacgtcttgaaccc

SEQ ID NO: 429683 - DNA, 681 bp, Homo sapiens
  misc_feature: GZ8MTXP01AVREY.19.71.G05.1.454.CMB.2.raw
  modified_base (308)..(308): a, c, t, g, unknown or other
tcagtactctcgtgcacgaccggtgctcgatttagtgtcgtcgcaagagagagggggcagagtctgctgaattctggctgaccagggcagtcaccagagctccagaaaatgtctgtctccttcctcttcttcctgcccgtgctgggcctcccacaaggtgtcctgtcacaagtacagctgcagcagtcaggtccaggactggtgaacgccctcgcagacccctctcgctcacctgtgccatctccggggacagagtcgctagcgacagtgttgcttggcacgtgggtcaggcacgtccccagtcgagnggtctagagtggctaggggaaggactagtatttcagttacgtacccaacgtaccggtaagggaaaactacgtaaaagtttacacggtacccaaccctaattccgttagttacggaaaggtacggttaccggaaaccttaggaaaccctaaagttaccgaaaaccggttaacgaactaaacgggaacttaacgggaaaacgtaaacccctaaggtttcccctacccctggaccctaaggccttacggacccctttgcggttaccgaccgtacccccgggaagggtaacccgtaacgggggtttacgttaacgttacgttaaccggttacgggtaacgggaacggacccggttaccccgtaagttaacgtaaccg

SEQ ID NO: 429684 - DNA, 651 bp, Homo sapiens
  misc_feature: GZ8MTXP01DQ8I9.19.71.G05.1.454.CMB.2.raw
  modified_base (244)..(244): a, c, t, g, unknown or other
  modified_base (260)..(260): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgagccgggccacatcaactgacaagtccagccataattctttaanactactacaataatanaaactatagctagacagacagacgacgagacacgcctacgagctcgcttactagtttcgaggactacgtacccgtaacccgggtacgtccccggggtacccctacggacgtagttcgacggtacggacgcgggtcgggtacgtagggactagtacttaccactcaccacatcgacgcacgcgtagacgacggtactaggtaagtagttcgggtacgttacgtttagtttaattaacttagtaaactaaattaaagtttatttaacttacgttacgttcggtaacggttaacccggttacgggtaaaccggttaaacgggtaaccggtaaggttagttaacttacgtaacgaacgtaacgtacgttcggttacgtaaccgttaacggaaccc

SEQ ID NO: 429685 - DNA, 749 bp, Homo sapiens
  misc_feature: GZ8MTXP01BXEXB.19.71.G05.1.454.CMB.2.raw
  modified_base (701)..(701): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttctcttcttcctgccgtgctgggcctccacaaggtgtcctgtcacaagtacagctgcagcagtcaggtccaggactggtgaacgccctgcacgaccctctcgctcacctgtcgccagtccggtccggggacaggagtccgcgtagcgaactaggttgttcggtcgttcggacctacggttggggtaccacggggtcctaaccggtcccccaggtacccgggaaggtacgggttacttaagggaggtcgggtaccggttagggggaaacggtactagtttactttacgaaacttaccggtaacccgtaaacgtaaccgggttaagggtaaaacttaaacctaaaagtttacgtacccgtacctaaccctaagttccgttaggtttaacggaacggtaaacggttccggtaaacgttacggaaaccttaaacgtaaccgtaaaacggttaaccggaaactaaacgtaacgttaacccgggaaaacttaacccgtacggtttacccttacccgttagacctaacggtcctcggtacccttaagtcgttacgtacccgttacgaacggtacgttacggggttnttacgttaagttacgtggtacggaacggaccggtaacccaagtaaccg

SEQ ID NO: 429686 - DNA, 644 bp, Homo sapiens
  misc_feature: GZ8MTXP01AVNM9.19.71.G05.1.454.CMB.2.raw
  modified_base (243)..(243): a, c, t, g, unknown or other
  modified_base (328)..(328): a, c, t, g, unknown or other
  modified_base (393)..(393): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacatcgaactgcaagtccagccactaattcttttaanactacttaccaaataataataaactactagcttagacagacagacgaccgagacacgcctacgagctcgtactactagtttacgnggactacgtaccgtaacccggggtacgtcccgggtcccctaggaccgtagtacgaggtcggacgngggtcgggtacgtacgggactagttacttcactccacacatcgagcacgcgtcgacgaggactaaggaagtagtggggtacggtactttaagtttaattagttacgtaaactaaaacttaatttaactttaagttacgttacgttcgggtaacggtaaccggttacgggaaccggttaaacggggaaacgtaagggttcgttaattacgaacgtaacggtaaccgtaagtcggttacggtcttcgtaaccg

SEQ ID NO: 429687 - DNA, 597 bp, Homo sapiens
  misc_feature: GZ8MTXP01E16PT.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgtgcttggcacgtggggtcaggcacgtccccatcgagagtctagagtggcgtgggaacgactagtatttcatgtacccaacgacgtaggaaatacaaattatcgacacctatcttagttgagtagtacgactagaacaatacaaacgtagacaacgatacggaaacaacctacgttcctccccgttaggaccagtcctacggacccttcgtcggttacgacccggtaccccggaagggtacccgtaacgggggttacgtttaaacgttaagtttaaccgtacggttaaggggaaaccggaccgggacccccctaagttaaccggaacccg

SEQ ID NO: 429688 - DNA, 599 bp, Homo sapiens
  misc_feature: GZ8MTXP01CJ01O.19.71.G05.1.454.CMB.2.raw
  modified_base (223)..(223): a, c, t, g, unknown or other
  modified_base (378)..(378): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctntcgctcacctgtcgccagtcgtccggggacagacgtcgctagcgacagtgtgcttggcacgtggtcaggcacgtccccatcggagaggtctagagtggcgtaggggaagactatatttcaattcgtaaccaaacgacgtaggaaatacaaagttntcgaccactatcgtgttacgagtagtcgactagacaaatcgaaagtagaacactaatacgaaaacgtaaccctacgttcctacccgtagaccgtaacgtccttacggaacccttcgttacggaccgtaaacccgttccccggaaagggtacccgttacggggttattaacgttaagttaccgtggtaacgggaacgacccgggttaaccccaagttaaccg

SEQ ID NO: 429689 - DNA, 662 bp, Homo sapiens
  misc_feature: GZ8MTXP01A3A8R.19.71.G05.1.454.CMB.2.raw
  modified_base (248)..(248): a, c, t, g, unknown or other
  modified_base (261)..(261): a, c, t, g, unknown or other
  modified_base (330)..(330): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtcctccagacctccctggctgtgtctcgtgggcgagccgggccaccgatcgaactgacaagtccagccaataattctttanacagttaccaaanaatacgaaactctagcttaggaccagcagacaccaggacacgcctcaggcctgacttactagtttacgnggacctacgtaccgtaacccggggacgtccccggggtaccccctacggaccgtagttccgaggtcgggacctaacggggtccggggtctaggggactacggttatttaccacttccaccacctactacgacgcaccgtaccgtgaccgtaggactacggaaagttgtagggggttacgtatttaagtttactagttacaactaaattaaatttattaacttacgttacgttcggttaacggtaacgttccggaacggttaaacgggtaaccgtaagggttagttaccgttatcccgaagtaacgtaacgtggttacgtaacgttcgtaaccc

SEQ ID NO: 429690 - DNA, 642 bp, Homo sapiens
  misc_feature: GZ8MTXP01DCT3W.19.71.G05.1.454.CMB.2.raw
  modified_base (584)..(584): a, c, t, g, unknown or other
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgccgtgctgggcctccacaaggtgtcctgtcacaagtacagctgcagcagtcaggtccaggactggtagaacgccctgccacgaccctctcgctcacctgtcgccacgtcgtccggggacaggacgtcgctagcgactagtgttgcgttggcacgtgggtcaggcacgtccccagtcggagaggtctaggagtggcgtaggggaaacggtactatttactttcaacgttacggtaaccctaacgtacggtaagggtaaaactaacgtaaaattacgtacgaccaccctaatcgttaggttgaagtacggtacgtaacgtagtaaacaaactaccgaaacgtaacgaacgtaacaagttaaccggaaaacgtaaaccgtacgttaaccctccgtcggtacctacggtctaccgtacctcgtaacgtccgacccgttaccggagtaaccggngggttagttacttacgttaagtggtaacggaacgccggttaccccaagttaacgaacc

SEQ ID NO: 429691 - DNA, 582 bp, Homo sapiens
  misc_feature: GZ8MTXP01DNUSU.19.71.G05.1.454.CMB.2.raw
  modified_base (244)..(244): a, c, t, g, unknown or other
  modified_base (258)..(258): a, c, t, g, unknown or other
  modified_base (328)..(328): a, c, t, g, unknown or other
  modified_base (448)..(448): a, c, t, g, unknown or other
  modified_base (473)..(473): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgagcgggccacatcaactgacaagtccagccaactaattctttanacacgttaccaaanaatagaaactactagcttagaccagacagacgaccaggacacgcctcgtaggcctgctactatttaccgnggctacgtaccgtaacccggggatccccggtacgtcccctagacccgtattcgaagtcgcgaggtcgggtactgggaactgtactttcactctacacatcagcagctgcgagctagaagnggtggtgtacttagtttattattanaactaaatattagttaattacttacgttcgtcggttacggttacggaaccgtaaagggtaccttaagggttgttaataagtacgaagtaacgagttaggtcggaactcg

SEQ ID NO: 429692 - DNA, 614 bp, Homo sapiens
  misc_feature: GZ8MTXP01CHUHU.19.71.G05.1.454.CMB.2.raw
  modified_base (563)..(563): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtccgtaccggggacaggacgtcgctagcgacagtgtgcttggcacgtggtcaggcacgtccccagtccgagacggtctaggaggtggcgtaggggaagactattatttcaaattcgtaaccaaagtacggtaaaggaaataaacgtaaatttatcgactaacctaattcgttggttagaagtacgtacgaactacgaaacaagtacgaaacgtacgaacaactaacgtaccgaaacgtaacctacgttccacccgtagactacgtactacgaccttcgtacgttacgaacccgttccggaaacggtacgttacggggttnttaacttaacgttacgtggtaacggaacgacccggtaaccccaagtaaccg

SEQ ID NO: 429693 - DNA, 616 bp, Homo sapiens
  misc_feature: GZ8MTXP01C5572.19.71.G05.1.454.CMB.2.raw
  modified_base (241)..(241): a, c, t, g, unknown or other
  modified_base (252)..(252): a, c, t, g, unknown or other
  modified_base (256)..(256): a, c, t, g, unknown or other
  modified_base (313)..(313): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctcagactccctggctgtgtctcgtgggcgagcgggccacgatacgaactgacaagtccagccaacaatctttaanactactacaanatanaaactctagctagacagacagacgacagacagcctacgagctgctactagtttacgnggactacgtaccgtaaccgggacgtcccgggtacccctaggtacgtattcgaggtacggcgtaacgggtcgggtagtacgggtactagttacttacacgtctacgaacctacgtcgacgacgacgacgtcgacgagtacgtagaagtagtagggtacgtacgttagttagttagttagtaactaataattaattaacttacttacgttcgttaacggtacggttacggtaccggaacggtaacgtaacggttacgttagttacgtaacgtagtaacgtaacgtacgttacgtcgttcgtaacg

SEQ ID NO: 429694 - DNA, 648 bp, Homo sapiens
  misc_feature: GZ8MTXP01CSXU9.19.71.G05.1.454.CMB.2.raw
  modified_base (247)..(247): a, c, t, g, unknown or other
  modified_base (262)..(262): a, c, t, g, unknown or other
  modified_base (305)..(305): a, c, t, g, unknown or other
  modified_base (335)..(335): a, c, t, g, unknown or other
  modified_base (393)..(393): a, c, t, g, unknown or other
  modified_base (455)..(455): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagccgggccaccatcaactgacaacgtccagccaactaattctttaanactacgttaccaaanaatagaaaacttatagcttaggaccagacaagacaccaggacncgcctaccgaggctcgctactagtttacgnggactacgttacccgtaacccggggacgttccccgggggtaccccctaggtaaccgtnttaccgaggtcgggcgaacgggtcgggtcgtacggggactaggtactttcacctctacaccntacagcacgtcctgcgagctagaagtgtggggtacggtattagtttatagttacgaactaaataaagtttatttattaacttccgttcgggtaacggtacggttaccgggaacgaaacggggtaaaccgtaaggggttacttaagttacgtaaccgtaaaggtccgtaagtggttcggtaaccttcggtaacc

SEQ ID NO: 429695 - DNA, 648 bp, Homo sapiens
  misc_feature: GZ8MTXP01DC5UB.19.71.G05.1.454.CMB.2.raw
  modified_base (220)..(220): a, c, t, g, unknown or other
  modified_base (226)..(226): a, c, t, g, unknown or other
  modified_base (229)..(229): a, c, t, g, unknown or other
  modified_base (236)..(236): a, c, t, g, unknown or other
  modified_base (246)..(246): a, c, t, g, unknown or other
  modified_base (250)..(250): a, c, t, g, unknown or other
  modified_base (267)..(267): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgaggggacatcgtgatcgacccagtctccagacctcctggctgtgtctcgtgggcgagcggccacgatacgactganacgcancanatcttanacactacaanatanaactatgctagacaganagacgacgacgacacgctcgtacgtctctctactacgttacgtcggacgtacgtaccgtaccggtacggtccggtccccgtacgtacgtacgtacgtacggtacggcgcggtcgggtcggtacggacgtacgtacttactactactaccactacgtacgacgacgacgcgtacgacgacgtacgtacgtagtaggttacggggttacggttacgtttaagtttaagtttagttacgttaacttaaacttaaactttaatttaagtttaacgtttacgttacggttaacggttacggttacggtaacggttaacgggtaacggtaacggttagttacgttacgtaacgtaacgtaacggtacgtcggttacgtcgttcgtcg

SEQ ID NO: 429696 - DNA, 516 bp, Homo sapiens
  misc_feature: GZ8MTXP01AOV0N.19.71.G05.1.454.CMB.2.raw
  modified_base (402)..(402): a, c, t, g, unknown or other
  modified_base (440)..(440): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctgggaagacatatttcatgtaccaacacgtggaactacaaattatgcaaccatctgttgagagtcgactgacaatacaacgtagacacatacgaagaaccagttccncctgcagctgacctctgtgacctccgaggacgcgggtntatattacgtggtacggaagtaccgggacccctagtacgaccattcgcccactcgtctcgttggtcgcgtttaagg

SEQ ID NO: 429697 - DNA, 691 bp, Homo sapiens
  misc_feature: GZ8MTXP01A92CQ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcgggccctcccacaaggtgtcctgtcacaagtacagctgcagcagtcaggtccaggactggtgaacgccctgccacgacccctctcgctcacctgtcgccagtccgtccggggacagagtcgcgtagcgacaggttgttcgtcgttcggactacgttggggtaccaggcctacggtcccccaagtccggaaggtacgggtacgtaggaggtgggccggtaaggggaaggtactaagttacgttttaccgaaacgttacgtaacccgaaacgtaaccgggttaaaggtaaacttaaaccgtaaaatttagtacgacctaacctattcgtgttaggagtaagtcgactagactaaatacaaacgtacgaactaacaacgtaaccgaaagtaaccctacggttccctacccgtagacgtaccgtacgtacccggtaccttcgtcggttaccgtaccccgttaccggtaacggacgttacgggttgttaactttaaggttacgttaacgggtcgggtaaaccgttacccgggtaaccccttaagtaaccgg

SEQ ID NO: 429698 - DNA, 734 bp, Homo sapiens
  misc_feature: GZ8MTXP01C56YF.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgcctcacctgtcgcccatcgtccggggacagagtcgctagcgacagtgttgcgttggcacgtgggtcaggccacgtccccatccggagaggtctaggagtggcgtaggggaaggactagttactttcgaattcgtcccaaacgtaccggtaagggtaaactaacctaaaatttacgtacggtacctaaccctaattccgttaggtttacgaaggtaacgtacgacgttacgaaacgtaaatacgtaaaacgttaacggaacgtaaaccaacgtttaaccggaaaacgtaaacccttacgttacccgttacccgttagtaccgacgtcccgttaaccggtaaccctttccggttacgtttacccgggaaccccgtttaccccgggaacgggggtaacccgttaaacggggggtttccctttaaagttaaccggtttaaaaccggttgggggttaaaccgggaaaccgggttaaccccgggtaaccccccgttaaaggtttaaaccccggg

SEQ ID NO: 429699 - DNA, 698 bp, Homo sapiens
  misc_feature: GZ8MTXP01EIV3H.19.71.G05.1.454.CMB.2.raw
  modified_base (243)..(243): a, c, t, g, unknown or other
  modified_base (262)..(262): a, c, t, g, unknown or other
  modified_base (317)..(317): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccacgatcaactgacaagtccagccactaatctttaanacatacaatatagaaactntagctagacagcagacacgagacacgtcctacgtagctcgactactagtttacgnggactacgttacccgtaacccgggtacgttcccggggtacccctaggtaaccgtagttccgaggtacgggacgtcggggtccgggttacgtacggggtaactaggttacctttccaacttcctacaacctacgtacacggtacaacgtccgtacgacgacggtacgtacgtaagtagttacggggtacggtacgtttaagtttaacgtttaacgttacgttaacgttaaacgttaaacttaactttaacgtttaacgttacgttacggttaacggttaacggttaccgggtaaccggttaaacgggtaaacggtaacggttacggttaacgttacgtaacgtacggtaacgtacgtacggttacggtcgttaacgtaaccg

SEQ ID NO: 429700 - DNA, 552 bp, Homo sapiens
  misc_feature: GZ8MTXP01CBWWO.19.71.G05.1.454.CMB.2.raw
  modified_base (360)..(360): a, c, t, g, unknown or other
  modified_base (378)..(378): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacaggagtcgctagcgacagtgttgcttggctacgtgggtcaggccagtccccagtccggagaggtctaggaggtggcgtaggggaagactatattcaatcgtccaanacgtagaatacgaaattngacactatctagttgagagtcgatgactatacaagtagaacactatacgaaacgaaccacgttccaccgttgctagtctcgaccttcgtagttcgaccgttccggaaggacgttacgggttgttacttaagttacgtaaggttcgggaacgttacgaaccccgttaagtaaccg

SEQ ID NO: 429701 - DNA, 588 bp, Homo sapiens
  misc_feature: GZ8MTXP01DX7DN.19.71.G05.1.454.CMB.2.raw
  modified_base (242)..(242): a, c, t, g, unknown or other
  modified_base (255)..(255): a, c, t, g, unknown or other
  modified_base (264)..(264): a, c, t, g, unknown or other
  modified_base (294)..(294): a, c, t, g, unknown or other
  modified_base (301)..(301): a, c, t, g, unknown or other
  modified_base (312)..(312): a, c, t, g, unknown or other
  modified_base (402)..(402): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacgatacgacgtgactaagtccagccataatcttttanacattacccaaanatgaaactntagctgacagcagagaccaggacagtcccnctagctnctatattacgnggctacgtaccgtaccgggtacgtcccgggtcctacgacgtatcgagtcggaccgtagggcggtacgagggactagtctcactcacacanacacgcacgacgtcgacgacgacgtagtagtagtagtacgggtagttatttattagtataataataattaattattacgttacgttacgtacggtaacgtacggttacggtaacggttaacgtaaggtaagttagttacgttacgtaacgtaacgtaacgtacgtcgttacgtaacgttcgtaacg

SEQ ID NO: 429702 - DNA, 555 bp, Homo sapiens
  misc_feature: GZ8MTXP01BVRSE.19.71.G05.1.454.CMB.2.raw
  modified_base (380)..(380): a, c, t, g, unknown or other
  modified_base (480)..(480): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccatcgtaccggggacaggacgtcgctagcgacagtgttgcttggcacgtgggtcaggcacgtcccagtcgagaggtctaggagtggcgtggggaacgactatacttcatacgtaccaacgacgtagaaataacgaattagngacactatcgtgttagagagtacgaactagaacaactacgaacgtagaacacgatacgaaactaaccgtacgttcctccgtgacacgtctcgtaccgttntcgtacgccgtccggaggtacgtacggttagttcttagttaacgtgtaacggaacgccgaccctaagttcgaacg

SEQ ID NO: 429703 - DNA, 742 bp, Homo sapiens
  misc_feature: GZ8MTXP01AWS7L.19.71.G05.1.454.CMB.2.raw
  modified_base (240)..(240): a, c, t, g, unknown or other
  modified_base (328)..(328): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgcaagtccagccataattcttttaanacagttaccaaacaatagaaaactcttagcttaggtaaccagacaagacgaaccaggacagccctacgtaggctgctactatttacgnggacactccgtaaccgggaactcccggggtacccctaggaccgtattcgaggtcgggctaacgggcggggtacgtacggggactacggtaactttccaaaccttccctacgaaaccctaattccgaacgacgaacgtcccgttagacccggaaggttccgtaaggaaacgtagttcggggggttacggggtaactttaaagggtttttaaacgtttaatttacggtaaacctaaaacgttttaaaactttacgttttaaaagtttaactttaaaccggtttcgggttaaacgggttaaccggtttacccgggaaacccgttaaaacgggggtaaacccgtaaaggggttacgttaagtttaacaaccggaaagtaacccggtaaagttccggttgggtaaccttcggtaacccc

SEQ ID NO: 429704 - DNA, 695 bp, Homo sapiens
  misc_feature: GZ8MTXP01B4OS3.19.71.G05.1.454.CMB.2.raw
  modified_base (237)..(237): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctggcctcccacaaggtgtcctgtcacaagtacagctgcagcagtcaggtccaggactggtgaacgccctcgcacgaccctctcgctcacctgtnccagtcgtcgggacagagtcgctagcgactagtgtgcttggcacgtggtcgacggctacgtccccagtcggaggtacggtcgtaggtaggtcggcgtaggggaaggactatactttcgaaagttcgttaaccgaaacgtaacgttaggaaaactaactaaaagttatacgtactaacctaattcgtaggttacggacggtacgtacggtaactcggaaactaaacgtaaccgaaacggttaaacgacctaaacgtaaacggttaaccgaaaacgtaaacccgttacgtttacccgtacccttacgggacctaacgggtccttaaccggtaacccgttcgtacggttacccggtaacccgttacccgggtaaacgggtaacggttacgggtttcggttaattaacggtttacgtaacgggttaacggaacgggttacccgaaccccgttaagtaaccgg

SEQ ID NO: 429705 - DNA, 594 bp, Homo sapiens
  misc_feature: GZ8MTXP01E5VLM.19.71.G05.1.454.CMB.2.raw
  modified_base (250)..(250): a, c, t, g, unknown or other
  modified_base (315)..(315): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcaaccatcaactgcaagtccagccacaatcttttatacagttaccaanaatagaaaactactagctggtaccagcagagaccaggacagcctcctaggctgcttcatttacgngggcactccgtaacccggggaactcccggggtccccctggaccgattcgaggtagggcgaaggccggggtgtaggggacagtactttcactctacaccatcagcagcctgcaggctagaagtatggggtgtacttaagtttatatttagactaaactaaattattatttaactcgtttcggtaaggtaaccgttccgggaacccgaaacgggtaaaccggtaaggacggttagttacttaacgagtaaccgaacgtcggttggtccgttcgtaaccccg

SEQ ID NO: 429706 - DNA, 643 bp, Homo sapiens
  misc_feature: GZ8MTXP01BUVDR.19.71.G05.1.454.CMB.2.raw
  modified_base (243)..(243): a, c, t, g, unknown or other
  modified_base (255)..(255): a, c, t, g, unknown or other
  modified_base (328)..(328): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagactccctggctgtgtctcgtgggcgagccgggccacgatcgaactgacaagtccagccacaattcttttaanactactaccaanaatagtaaactcttagcttagacagcaagacgaccaggacacgccctacgtaggctgccttactagtttacgnggactacgttacccggtaacccgggtacgtccccgggtccccaggtaccgtagttccgaggtcgaccgtcgggtcgggtacgtagggactagttacttaccgactacgtacacctacgtcgacgtcgacgtcgtagcgaggtactaggaacgtgttcggggtagtactttagtttatacgtacgtaactaaagttaatttagttattacgttacggttcggtaacggttaccgttcgggaaacgttaaacgggtacgtaagggttcgttattacgtaacgaacggaacgttagtcggttcgtaaccgttaagtcc

SEQ ID NO: 429707 - DNA, 490 bp, Homo sapiens
  misc_feature: GZ8MTXP01CCST3.19.71.G05.1.454.CMB.2.raw
  modified_base (238)..(238): a, c, t, g, unknown or other
  modified_base (250)..(250): a, c, t, g, unknown or other
  modified_base (356)..(356): a, c, t, g, unknown or other
  modified_base (403)..(403): a, c, t, g, unknown or other
  modified_base (410)..(410): a, c, t, g, unknown or other
  modified_base (416)..(416): a, c, t, g, unknown or other
  modified_base (427)..(427): a, c, t, g, unknown or other
  modified_base (429)..(429): a, c, t, g, unknown or other
  modified_base (469)..(469): a, c, t, g, unknown or other
  modified_base (475)..(475): a, c, t, g, unknown or other
  modified_base (477)..(477): a, c, t, g, unknown or other
  modified_base (482)..(482): a, c, t, g, unknown or other
  modified_base (484)..(484): a, c, t, g, unknown or other
  modified_base (488)..(488): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaanaatgaaaactacttagctggtaccagcagagaccaggacagcctcctagctgctcatttactggcatctacccggaatccggggtccccctgacgattcagtggcngcgggtctggggacagatttcactctcaccatcagcagcctgcagcngaagaanggtggnagttattattntntaataataatattataactctgagttgtcgagacgagagngataananaagangngtgngc

SEQ ID NO: 429708 - DNA, 570 bp, Homo sapiens
  misc_feature: GZ8MTXP01DQR9G.19.71.G05.1.454.CMB.2.raw
  modified_base (242)..(242): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagcgggccacatcaactgacaagtccagccataattcttttanacagttaccaaacaatagaaaactacttagcttaggaccagcaagacgaccaggacagcctctaggctagctactatttaccgtggctatccgtaacccggggaatcccgggggtccccctaggaccgtagttcaggtggccaagggccgggtctacggggaccaggtactttccacttcacaccatcacgacacgcctgccaggctagaagatggggtggactagtttattagtagtactaataaattattattatacgttgtggttaacgttcggtaccaagggacctaagttgttgataatcgaagtacgaacgttgtcggctcg

SEQ ID NO: 429709 - DNA, 655 bp, Homo sapiens
  misc_feature: GZ8MTXP01ARM7R.19.71.G05.1.454.CMB.2.raw
  modified_base (204)..(204): a, c, t, g, unknown or other
  modified_base (410)..(410): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggctggngacgcctcgcacgaccctctcgctcacctgtcgccagtccgtccggggacaggacgtcgcgtacggcgacgtaggttgttcgcgttggcctacgtggtcaggccacgtccccagtcggacgtaggtcaggtacggtggacgtaggggaacgactattacgttacaattcgtccaaacgtacggtacggtaaattaactaaatttancgtacctaacccgtaatttcgtaggttagaaggtacggtacgactacggaaactaacgtaacgaaacgttaacgaactaacgtaataaccggtaaacgtaaccgtaccgtttcccttacccgtaggacctaccggtacgttacgaccctttcggtacggttccgtacccgttacccggaacggacgttacgggttattagtaacttacgttaaggacggacgttaccggaacccttaagtaaccg

SEQ ID NO: 429710 - DNA, 618 bp, Homo sapiens
  misc_feature: GZ8MTXP01BO9VZ.19.71.G05.1.454.CMB.2.raw
  modified_base (238)..(238): a, c, t, g, unknown or other
  modified_base (323)..(323): a, c, t, g, unknown or other
  modified_base (477)..(477): a, c, t, g, unknown or other
  modified_base (509)..(509): a, c, t, g, unknown or other
  modified_base (528)..(528): a, c, t, g, unknown or other
tcagtactctcgtgcacgaccggtgctcgatttagtgtcgtcgcaagagagaggaggtacaacaggcaggcaggggcagcaagatggtgttgcagaccccaggtcttcatttctctgttgctctggatctctggtgcccaggggacatcgtgatgacccagtctccagacctccctggctgtgtctgtgggcgagccgggccacgatcaactgacaagtccagccataattctttaanacagttaccaaataatagtaaaactcttagcttaggaccagcagacacaggtacacgcctacgtaggctgactctagtttaccgngggactacgtccgtacccggggaacgttccccgggggtccccctaggtaaccgtgttaccgaggtcgacggtaacgggtcgggtcgtaggggaacctagtcctttcaacttcctacgacctagccaaggcacgcctgccgaggtcagaaacgtntgggggtacgtatttaagtttataccgttaanaactaaattaattaagttnttaacgtcgttcggtaacggtaccggttacggaacgttagggtaacgtaaggttgattagtcgaagtaacgtacgtggcgtcgttcgaac

SEQ ID NO: 429711 - DNA, 683 bp, Homo sapiens
  misc_feature: GZ8MTXP01DN9KK.19.71.G05.1.454.CMB.2.raw
  modified_base (243)..(243): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccacgatacaactgacaagtccagccactaaatcttttaanactacgttaccaaactaataacgaaaactacgttagtactaggacagacaagacgaaccaaggaccacgccctaccgtaggctgtacctactaacgtttacgtcgggactacgtacccggtaaccgggtaacgttccccggggtacctaccgaccgtattacgaggtcggacagggtcggggtactagggaactagtactttcgactcctaccactatacacgacgacgtaccgtacgacgacgacgtagtaagtagtagtacggggtacgttaagtttaattagttacgtaactaaactaaattaattaattaattacgttacggttacgggtaacggttaccggttaccggtaaacgggttaaacggtaaaggtaaggttaacgttagttacgtaacgtaacgtaacgtacggtaggttacgtaacgttaacgtaacg

SEQ ID NO: 429712 - DNA, 548 bp, Homo sapiens
  misc_feature: GZ8MTXP01AUP33.19.71.G05.1.454.CMB.2.raw
  modified_base (468)..(468): a, c, t, g, unknown or other
  modified_base (473)..(473): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtgccatcgtccggggacagagtcgctagcgacagtgttgcttggcacgtgggtcaggcacgtccccagtcgagaggtctagagtggcgtaggggaaggactagttactttcagtcgtaccaaacgacggtaggaaactaccgtaaattatgaccaaaccgtatctggttagagtagtcactagaacagtacaacgtagacacatacgaacacagtctcctgacagctgacctgcgtgaccgtccgagacgtcggtntattnttacgtggtaggaacggaccggcccctaagtacgacacttccgaacctctcgtctcgttcggtcgttcgttaagg

SEQ ID NO: 429713 - DNA, 640 bp, Homo sapiens
  misc_feature: GZ8MTXP01BXBH1.19.71.G05.1.454.CMB.2.raw
  modified_base (240)..(240): a, c, t, g, unknown or other
  modified_base (253)..(253): a, c, t, g, unknown or other
  modified_base (318)..(318): a, c, t, g, unknown or other
tcagtactctcgtgcacgaccggtgctcgatttagtgtcgtcgcaagagagagggggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgacaagtccagccataattctttanacagttaccaaanaatagaaactactagctggtacagcagacgaccaggacagccctctaggctgctactatttacgngggcacgttccgtaacccgggtaacgtccccggggtccctcggaccgtattccgaggtcggacgaggtcgggtcgtgggactagtactttcactctaccacatacgagcagccctagcgtaggctagaagtgttcggtaggggtactttaaggttttatacgttagtaactaaactaatttatttaattacgttacgttacgggtcgggtaaccggttcggggaaccggtaaacggggttaaaccgtaaaggggttaggaacttagttaaccggtaaggtaaccgtaacggttgggtcgggttactaacggaaccctaaccg

SEQ ID NO: 429714 - DNA, 632 bp, Homo sapiens
  misc_feature: GZ8MTXP01BIXSD.19.71.G05.1.454.CMB.2.raw
  modified_base (245)..(245): a, c, t, g, unknown or other
  modified_base (330)..(330): a, c, t, g, unknown or other
  modified_base (365)..(365): a, c, t, g, unknown or other
  modified_base (378)..(379): a, c, t, g, unknown or other
  modified_base (412)..(412): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagactccctggctgtgtctcgtgggcgagcggccaccatacaactgacaagtccagccaactaattcttttanactagttaccaaacaatagaaaactacttagcttaggaccagacagagaccaggacagccctactaggctagcctatatttacgnggcatccgaaccggatcccggggtcccctgacgtntaccgaggtcggnnggcgggtcgtgggacagtctttcactctcacancagcagcctagcaggcagaagtagtggggtaggtagtttaagtttattagttacgtaactaaacttaaatttaatttaaatttaatttaccgtttagggtaacgggtaacgggtttcccggggtaaacccgaaagggggtaaacccgtaaggggttacgggttaacttaaagttcgaaacggttaaccgaaacgttaggttggggtaacttcggtaaccc

SEQ ID NO: 429715 - DNA, 643 bp, Homo sapiens
  misc_feature: GZ8MTXP01ELNCI.19.71.G05.1.454.CMB.2.raw
  modified_base (203)..(203): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtnaacgccctgcacgaccctctcgctcacctgtcgcccagtccgtccggggacaggacgtcgctaggcgactagtgttcgcgttggcagtgggtcaggcacgtcccagtcgagagtctagagtggcgtagggaacgactattatttcagttacgtacccaacgtacggttaaggaaacttaactaaaattttacgacgtacctaacctatttaccgttaggttagacggtacgttaccgaacgttagaacctaaattaccgaaacggtaacgaacctaaacggtaacgttaaccggaaaacgtaacccgtacggttttaccccacccgttagaccgtacgtccgttacggtacccttcgtcggttaccgaccgtacccggaggtaacgtacgggttagttattacgtaacgtggaacgacgccggaccctaagttaacgaac

SEQ ID NO: 429716 - DNA, 827 bp, Homo sapiens
  misc_feature: GZ8MTXP01DYGZT.19.71.G05.1.454.CMB.2.raw
  modified_base (253)..(253): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttctcttcttctgccgtgctggcctccacaaggtgtcctgtcacaagtacagctgcagcagtcaggtccaggactggtcgaacgccctgcacgaccctctcgcctcacctgtcgccagtccgtaccgggganaggacgtcgctaggcgacgtagttcggttcgtcgttcgggacctacgggttcggggtaccgacgggtaccctaaccggttaccccccgtaaggtttacccgggaaagggttacgggttaccgttaagggtacgggtacgggggtaccgttaaggggggaaacggtacgttaacgttttaacgttttaccaaacgtttacggtaacccgtaaaacggtaaccgggttaaaggtaaaaactttaaaccgtaaaaattttcgtaaccggtaccctaaaccgtaagtttcgttacggtttaaggaaggttaacggttacgtaacgttaacgaaactaaacgtaaccgtaaaacgtacgaaacgtaaacgtaacgtaaaccggaaacgtaaacccgttaacgtttccccttacccgtacgtaccgtaacggtacccttaacgtaaccccgttggttcggttaccggtaccccgttaccgggtaaacgggtaccggttaacgggtttgttaaacgttaacgtttaaaccggttggggttaacgggaaaccggacccgtaacccccgttaagtaaacccgg

SEQ ID NO: 429717 - DNA, 595 bp, Homo sapiens
  misc_feature: GZ8MTXP01EN6VD.19.71.G05.1.454.CMB.2.raw
  modified_base (393)..(393): a, c, t, g, unknown or other
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgaccctctcgctccacctgtcgccctagtccgtccgggggacaggacgtcgactagcgacagtgttgcgttggctacgtgggtcaggcacgtccccgagtcggagtaggtactaggagtgggcgtaggggaacgactatattcatacgtaccaagtacgtagaaactactaaattancgacactatctggtagagtagtacgtactagaacaacgtacaacgtagacacgtaacgtacgaaacgtaaccgtacttcctacctgaccgtacgtcctacgtacctcgtcgtcgttaccgtacccgagggtaaccgtacgggttagttacgttacgttcggtaggtaacgggaacggacccgaccccgtaagttaacgaacg

SEQ ID NO: 429718 - DNA, 659 bp, Homo sapiens
  misc_feature: GZ8MTXP01DP2AY.19.71.G05.1.454.CMB.2.raw
  modified_base (243)..(243): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgagccggccaccatcaactgacagtccagccactaattctttanactacttaccaacaatacgaaactactagcttaggtaccagacagacgaccaggacacgcctctaggctgctctatttacgtggctacgtccgtaacccgggtacgtccccgggggtcccccctacggtaccgtagttccgaggtcgggacgtcgggtccggggttaccgtacggggtaacctaggtacttttccaccttcctaccacctatcgagacagccctgccaggctagaagtagtggggtaggtacttaagtttagttattagtaacctaaattaaatttagttaatttaagttaccgtttcggtaacggtaaccggttacgggaaccccgttaaaggggtaaaccgtaagggttagttaagttaacgtcgtaaaggaaccgtaagttggttacggtccgttcgtaaccc

SEQ ID NO: 429719 - DNA, 627 bp, Homo sapiens
  misc_feature: GZ8MTXP01CFIVP.19.71.G05.1.454.CMB.2.raw
  modified_base (243)..(243): a, c, t, g, unknown or other
  modified_base (254)..(254): a, c, t, g, unknown or other
  modified_base (449)..(449): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccacgatacgaactgactaagccagccacaattctttanacagtaccaanatagaaactctagcttagaccagcagacaccaggacagcctcgaggctgactctatttacgcggactacgttccgtaaccccggggacgttcccgggggtccccccctaggaccgtgtttacgaggggtcgaccgtaagggccgggttacgtcggggaacctaggttactttcaacctcctacacccgtatcganacacgcccgtagaccgaggacgtaggaaagtgtcgggtggttacttagtttagttattactaactaaataattatttaatcgttaacgttcgtaacggtacgtttcgggaccgttaaagggtaccgtaagggttgacgttagtaacgaacgaaccgtagtggttaggtcttcgtaacc

SEQ ID NO: 429720 - DNA, 716 bp, Homo sapiens
  misc_feature: GZ8MTXP01BE2WF.19.71.G05.1.454.CMB.2.raw
  modified_base (224)..(224): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctntcgctcacctgtcgccagtccgtccggggacagagtcgctagcgacagttgtgcgttggcacgtgggtcaggccacgtccccagtcggagtaggtcaggaggtggcgtaggggaacgactagttatttcatacgtaccgaacgtacggtaaggaaacttacgtaaattctacgacctacccgtattccgttaggtaggaaggtacggtaccgtaacgttagaaactaacgtaaccgtaaacggtaacgaacctaacggtaaacgtaaccgggtaaaacccgtaaacccgttacggtttaaccccctcccgttacggaaccgtaccgttacccgtaaccgtcccgttaccggtaacgggttacccgttaaccccggttaaccccgggaaacgggtaaccgggttaccggggttaattaacgtttaccggttaaacgttcggggtaacggaaaccgggccccggttaaaccccgtaagttaaaccgtaaccccg

SEQ ID NO: 429721 - DNA, 655 bp, Homo sapiens
  misc_feature: GZ8MTXP01BMCVZ.19.71.G05.1.454.CMB.2.raw
  modified_base (267)..(267): a, c, t, g, unknown or other
  modified_base (281)..(281): a, c, t, g, unknown or other
  modified_base (394)..(394): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcgggcctcccacaaggtgtcctgtcacaagtacagctgcagcagtcaggtccaggactggtcgaacgccctcgcacgaccctctcgctcactgcgcatcgtcgggacagagtcgctagcgacnggtgttgcttggcncgtggtcagcacgtccccagtcgagtacggtctaggacggtggcgtagggaaggtactagttactttcaagttacgtccaaacgtacggtaggtaaactaactaaagtttacncgtaccaacctagttcgtagttaggaagtacgtacgaacgtcgaaactaatacgaaacgtaacggaacctacgtaacgtaaccggtaaactaaacccgtcgttttaccccgtaccgtacggacctaccgtaccgttaccgtaccttcgtacggttaccgtacccgttaccgggaacggtaacggttaacgggttcgttaacgttaacggttacggttaacgggaaccggtaaccggttacccgtaacccgttaacgtaacg

SEQ ID NO: 429722 - DNA, 639 bp, Homo sapiens
  misc_feature: GZ8MTXP01ATQD8.19.71.G05.1.454.CMB.2.raw
  modified_base (601)..(601): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgacccctctcgctcacctgtcgccatccgtccggggacaggacgtcgctagcgacgagtcgttgcgttggctacgtgggtcacgggcacgtccccagtcggagtaggtctaggagtggcgtaggggaaccgatagttattcagtacgtaaccaacgtacgtaagggtaaactaacgtaaattacgtacgacctaacctagttcgtaggtagaacggtagtaccggtaccttaggaaactaaacgttacgaaacgtaacgaaccgactaaacgtaaacggtaacgtaacccgttacggtttaccctccgtacggacacggtctacgtaccttcgtcggtacgaccgtcccgggaaggtaaccggcgggttattagttacgttaacgnggtaacgggacggaccggaccctaagttaacggaaccg

SEQ ID NO: 429723 - DNA, 602 bp, Homo sapiens
  misc_feature: GZ8MTXP01EY3AV.19.71.G05.1.454.CMB.2.raw
  modified_base (367)..(367): a, c, t, g, unknown or other
  modified_base (380)..(380): a, c, t, g, unknown or other
  modified_base (452)..(452): a, c, t, g, unknown or other
  modified_base (467)..(467): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccacgatacgactgacaagtccagccataattctttaatacagttaccaaacaatagaaaactacttagcttaggtaccagcaagacgaaccaggacagccctcgaggctgctactatttacgggccattccgtaacccgggatccggggtcccctgacctnttcgagtcgggcnggtcgggtagcgggactggtactttcacttcaccactatcagcgacgcctggaccaggtctagaagtgtggnggttatattttagtntttagaactaattaattattaattacgttacgttccgtaagggttacgttcgggaacgttaacgggaaccgtaaaggttcggttacttagttaacggacgtaaccgtaacggttggacgggttcccgcgtaaccc

SEQ ID NO: 429724 - DNA, 604 bp, Homo sapiens
  misc_feature: GZ8MTXP01BT37S.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtccgtccggggacagacgtcgctagcgacagttgtgcgttggcacgtggtcaggcacgtccccagtcgaggacggtctaggagtcggcgtaggggaacgactagttatttacaattcgtccaaacgtacggtaggaaactaactaaatttacgtacgacctaacctagttcgttaggttacgaagtaacgtacgtactagaaacaatacgaaacgtagaactaacacgttacgaaacgaacctacgttcctacccgtagacctacgtctacgtacctcgtacgttcgacccgttccggaggacgttacgggttcttattaagttacgtcggtacggaacgaccggaacccttaagtaaccg

SEQ ID NO: 429725 - DNA, 669 bp, Homo sapiens
  misc_feature: GZ8MTXP01A80H1.19.71.G05.1.454.CMB.2.raw
  modified_base (605)..(605): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagagtcgctagcgacagtgtgcgttggcacgtggtcaggcacgtccccatcggagaggtctagaggtcggcgtacgggggaagtactagttactttcgaaattcgtaaccgaaacgtacggtagggtaaactaacgtaaaattgtacggacctaacccgtattcgtaggtttagaacggtaacgttacgacgttacggaaacctaattaaccgaaacgttaacgaaccaacgtaacgtaaacgaaacggtaaccctaggtttccctacccgttacgacctacggtcttacgccccttcgttacggttccgtaacccgttacccggaacgggtacccgttaacgggggtttnttagtttaacgttacgtcggggtaacggtaacgggacccggtaacccccgttaagttaacccgg

SEQ ID NO: 429726 - DNA, 709 bp, Homo sapiens
  misc_feature: GZ8MTXP01B03YC.19.71.G05.1.454.CMB.2.raw
  modified_base (646)..(646): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtccgtccggggacaggacgtcgctagcgacgtaggttgttgcgttggctacgtcgggtcacggcctacgtcccccagtccggaggtacggttcgtaaggacggtcgggacgttagggggaaacggtactaagtttacttttacgaaacgttaccgttaacccgaaaacgtaccggttaagggtaaaacttaacctaaaagtttacgtacgtaccctaaccgtattccgtaggttagaaggtaacggtcgtaactaggaactaacgtacgaaacgtaacgactaacgtaaagtaaccgaaacgtaacccgtacgtttccctacccctagacctaacggtcctacggtaccccttgttaccggttccgtaacccgttcccggaaagggtaccgttaccggggttnttaacgtttaagttaccgttaagggaacgggaacggttacccggtaaccccttaaggtaaccg

SEQ ID NO: 429727 - DNA, 744 bp, Homo sapiens
  misc_feature: GZ8MTXP01CQFA3.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgcctcacctgtcgcctagtccgtccggggacaggagtcgcgtagcgacaggttgttcggcgttggcgtacgtcgggtcgacgggtacctaccgtccccgagtcccggaggtacgggttcgtaaggacggttgggaccggtagggggaaacggactagttactttcgaaacgttacgtaacccgaaacgtaaccggttagggtaaattaaccgtaaaatttagtacgtaccctaaccgtagttaccgtttagggttacggaacggtacggttaccggaacgttaacggtaaaccgtaaacgttaaccgaaacggttaaccggaaaccgtaacgtaaacggttaaccgaaaaccgtaacccgtaacgtttccctacccgtcggtaccacggtcctacgtccttcgttcggttaccggtaccccgttacccgggaacgggtaaccgttacgggttcgttaattaacgttaccggttaaggtaacgggtaaccggacccggtaaccccgttaagtaaccgg

SEQ ID NO: 429728 - DNA, 693 bp, Homo sapiens
  misc_feature: GZ8MTXP01AB4WJ.19.71.G05.1.454.CMB.2.raw
  modified_base (240)..(240): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcaagtccagccacaattcttttanactagttaccaactaatagaaaacttactagcttacggtaaccagcaagacgaccaaggacaacgtccctaccaggacctgcttactattttacgtcgggactattaccgaaccccggggtaattccccgggggttaccccctaggaccgtattacccgagggttcggaccgtaacgggccggggtacgtagggggactaacggttactttccgaacttcctacacctaactcgagacgacgtcctggacgacggtcaggaaacgtgttggggtacgggattaacggttttattaagtttacggtacctaaaataatttaactttaatttacgttacgttcggtaacgggttaacgtttccgggaccgttaaacgggaaaccgtaagggttacggttacttaaccgttaagaacgggtaacccgtaaagtcggttacggtcgttcggaacccg

SEQ ID NO: 429729 - DNA, 723 bp, Homo sapiens
  misc_feature: GZ8MTXP01BVUAP.19.71.G05.1.454.CMB.2.raw
  modified_base (246)..(246): a, c, t, g, unknown or other
  modified_base (256)..(256): a, c, t, g, unknown or other
  modified_base (260)..(260): a, c, t, g, unknown or other
  modified_base (266)..(266): a, c, t, g, unknown or other
  modified_base (269)..(269): a, c, t, g, unknown or other
  modified_base (278)..(278): a, c, t, g, unknown or other
  modified_base (319)..(319): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccacgatacgaactgacaacgtccagccactattctttanactatacaanatanaaactntanctagacagnagacgacgagacacgcctacgtgctgactacgtagttacgnggtacctacgtaccgggtaacccgggacgtcccggggtaccccctacggtaccgtattacggacggtacgggccgtaacggggtccgggtacggtacgggactagttaccgtttaccaccttccacctaaccgtactaccgaacgcccgtaccggtccgtacggacgtacggtacgtaacgtaaagtacggttacgggggtacggttaacgtttaagttttaacgttacgtttaaccgtaaactaaactttaaacgtttaatttaaacgtttaacgtttaccggttacgggttaacgggttaacccggttaccgggaaaccggttaaacgggtaaccgggttaagggttagttaacttacgaacgtacgggaacgtaggtcgggttacgtaacgttcgtaaccg

SEQ ID NO: 429730 - DNA, 656 bp, Homo sapiens
  misc_feature: GZ8MTXP01CZN4I.19.71.G05.1.454.CMB.2.raw
  modified_base (590)..(590): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgtaccctctcgctcacctgtcgccagtcgtccgggacagacgtcgctagcgactagtgtgcgttggcacgtcggtcaggccacgtccccagtcgagaggtcaggaggtggcgtaggggaaggtactagttactttcgaaattcgtaaccgaaacgtacggtaaggtaaactaactaaagtttacgacgacctaactatcgtagttagaagtacgttcgaatcgaactaaataccgaaacggtacaaacactaaacgttaacgaaacgaacccttaaggttcccctaccgtacgacctaacggtacctacggtaacccgttcgtaggttacccggtaacccgaccgggtaaaggaacccgttaacgggggttnttaacgtttaacggttacgtcggggttaacggaacggttacccgggtaaccccttaaggtaacccg

SEQ ID NO: 429731 - DNA, 721 bp, Homo sapiens
  misc_feature: GZ8MTXP01CRC49.19.71.G05.1.454.CMB.2.raw
  modified_base (287)..(287): a, c, t, g, unknown or other
  modified_base (671)..(671): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactggtgaagccctcgcacgaccctctcgctcacctgtgccatcgtccgggacagagtcgctagcgacagtgttgcttggctacgtgggtcaggcacgtccccagtcgagnggtctaggagtggcgtagggaagactattatttcattcgtaccaaacgtacggttaggaaaaccttaacgaaaattttcgacggacccaaaacccgttattccgtttagggtttacggaaaggtaacggttacccgaacgttacggaaacctaaaagtttacccgaaaacggttaaacggaaaccaaacgtaattaacccgggaaaaacgtaaaccccgtaacggttttaccccacccccgttaggaccgtaacggtcctttaaccggggtaaacccctttgtaccggttacgaaccccgttcccggaggaacccgttacggggtagtacttaacgttcgtaacggtaagggacgtacccggttacccctaaagtcgttaaccngttaccggccctaccgttccgtacgttcggttacgtcgttcgttaacggg

SEQ ID NO: 429732 - DNA, 697 bp, Homo sapiens
  misc_feature: GZ8MTXP01APB3E.19.71.G05.1.454.CMB.2.raw
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcactgtcgccacgtccgtccggggacagacgtcgctaggcgacgtagttgttcgcgttcggctcgtgggtcgacggccacgtccccagttcggagtaggtcgtaggaggtggacggtaggggaacgtactattagttcaagttccgtacctaacgtacggtaacgggtaaacttaacgtaaatttacacgtacctaaccgttagttcggttagttacggagttacggttaccgaaagttacgaacctaaactacgtaaacgtacgaacctaacgtaacgtaaacgaaaccgtaaccgtacggttccctacccgtagtaccgtaacgtcctaccggtaccctcggtccggtttacgaacccggttacccggggaaacggtaccggttaacgggggttaacttacggttaacgtttaacggacgggtaacgggtaaccggaccccgttacccgtaagttaacgtaacccg

SEQ ID NO: 429733 - DNA, 636 bp, Homo sapiens
  misc_feature: GZ8MTXP01EB5C7.19.71.G05.1.454.CMB.2.raw
  modified_base (224)..(224): a, c, t, g, unknown or other
  modified_base (325)..(325): a, c, t, g, unknown or other
  modified_base (583)..(583): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcagacccctntcgctcacctgtcgccagtcgtccggggacagacgtcgctagcgacgtagtgttgcttcggctacgtgggtcaggtccagtccccagtcgagaggtctagngtggcgtagggaacgactatacgtttcaattcgtaaccgaaactacggttaggaaacttacaaatttcgtacgacctactattcgtagttgaagtacgttacgacttacggaactaaactacgtaaacgtacgaacgtaaccgtaagttaaccgaaacggtaaacctacggtttacccttaccccgttagacctaacgtcgtaccgtaaccttcgtcggttacgtacccgttacccggaacgggtaacgacggggttnttaagttaacgttacgtaaggttacggaacgaccggtaaccccaagtaaccgg

SEQ ID NO: 429734 - DNA, 608 bp, Homo sapiens
  misc_feature: GZ8MTXP01ED2PR.19.71.G05.1.454.CMB.2.raw
  modified_base (244)..(244): a, c, t, g, unknown or other
  modified_base (257)..(257): a, c, t, g, unknown or other
  modified_base (328)..(328): a, c, t, g, unknown or other
  modified_base (382)..(382): a, c, t, g, unknown or other
  modified_base (423)..(423): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccacgatcgaactgacaagtccagccataattctttanactacttaccaanaatacgtaaaactcttagcttaggtaccagcaagacaccgaggacacgcctccaggctgctctatttacgnggctactccgtaaccgggagtcccggggtcccctggaccgattcgagtcggcgnggtcgggtcgtagggactaggtactttcgactctcaacctncagcgacgcctagcgagcgtaagaagtgtgggtcgtattagttatatacgtaataaattaattatttaattacgttacgttacggtaacggtaccggttacggtaaccggttaaacgggtaacgtaaggttagttaacgttacgtaacgtacgtaacgtacgtggttacggtcgttaacgtaacg

SEQ ID NO: 429735 - DNA, 590 bp, Homo sapiens
  misc_feature: GZ8MTXP01CEZJF.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccatcgtccggggacagagtcgctagcgacagtgttgcttggcacgtgggtcaggcacgtccccagtcgagaggtctaggagtggcgtaggggaacgactatatttcatacgtaccaacgacgtaggaaataacaaattacgtgacacctatctgtagagtagtacgacgtagacaatacaacgtagaccaacatacgaaacgaacccgtagttccctcccgtagaccagtcctacggtacctcgtcggtcggaaccgttccccgggaaggtaaccgtacgggttagttagttaacgtttaacgtagggttaacggaacgggtaccggacccccgtaagttaacggtaaccg

SEQ ID NO: 429736 - DNA, 631 bp, Homo sapiens
  misc_feature: GZ8MTXP01AT97E.19.71.G05.1.454.CMB.2.raw
  modified_base (231)..(231): a, c, t, g, unknown or other
  modified_base (351)..(351): a, c, t, g, unknown or other
  modified_base (408)..(408): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtcgccatcgtccggggganagagtcgctagcgacagtgtgcttggcacgtgggtcaggcacgtccccatcgagaggtctagaggtggcgtgggaagcattatttcatcgtaccaacacggtagaaacttacaaatttancgaccaaacctattcgtaggttagaagagtacgactgaaacaactacgaaacggtanaactacaagtaaccggaaactaaacccgtagtttcccctccgtaggactacggtacctcgtaacccgttcgtcggttaccgacccgtccgggaggtaaccggtagggttgttaaacttagttacgtaaggtaacgggaaacgacccgggacccctaagtaaccgacgttacgttaccggtcccctaccgttccgttccgttcgttggtcgttaaccgttaagg

SEQ ID NO: 429737 - DNA, 547 bp, Homo sapiens
  misc_feature: GZ8MTXP01AKA1G.19.71.G05.1.454.CMB.2.raw
  modified_base (416)..(416): a, c, t, g, unknown or other
  modified_base (435)..(435): a, c, t, g, unknown or other
  modified_base (537)..(537): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccatcgagaggtctaggagtggctagggaagactatatttcatcgtaccaaacgacgtaggaaactacaaattatgacaaccatcgtagttagagtacgtcgactgaacaatcaacgtagacacagtacgaagactgtccncctagcagctagacccttntcgtcgacctccggaggaccgtacggtgtaatcgtacgtggtagggaacgaccggaccccagttaacgacttattcgaaccctacgtcgtctcgttgggtcncgtttaacgg

SEQ ID NO: 429738 - DNA, 710 bp, Homo sapiens
  misc_feature: GZ8MTXP01EAE9G.19.71.G05.1.454.CMB.2.raw
  modified_base (652)..(652): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctccacaaggtgtcctgtcacaagtacagctgcagcagtcaggtccaggactggtcgaacgccctcgcacgaccctctcgctcacctgtcgccagtccgtccggggacaggacgtcgctagcgacgtagtgttgcgttggctacggtgggtcacggcacgtccccagtcgaggtacggtctaggaggtggacgtaggggaaggtactattactttcgaacgttcgtaaccgaaagtaccgggttaggtaaaacttaacgtaaaatttacgtacgtacctaacccttagtttacgttagggttaggaaacggtaacggttaccggtaacttaacgggaaactaaaacgttacgaaaaaccgggttacgaaacctaacgtaaacggtaaccgtaaacggtaaacccttacggttaccctaccccgtagaccgtaacggtcctaccggtaacccttcgtcgttaccccggtaaccggttacccggaacgggtaacggttacggggttnttaacgttaacgtttacggtggtaacgggacggttaccggtaaccccttaagtaaccg

SEQ ID NO: 429739 - DNA, 655 bp, Homo sapiens
  misc_feature: GZ8MTXP01BPW3D.19.71.G05.1.454.CMB.2.raw
  modified_base (194)..(194): a, c, t, g, unknown or other
  modified_base (542)..(542): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactggtgaacgcccccgnacgaccctctcgcctcacctgtgccatcgtccggggacagagtcgctagcgacagtgtgcttggcacgtgggtcaggcacgtcccatcgagagtcagagtggcgtgggaagactatatttcatcgtaccaacacgtagaaataaccgaaattatgaccacctaattcgtgttagaacggtacgtacgacttacggaactaaactaccgaaaacgttacgaaacaacgtaaacttaacggaaaaccgtaacctacggtttccctaccccgttagacctaacggtcccttacggggtacccttacgtggttaccgaacccgttcccggaacggtacgtaaaccggggttnttaaacgttacgtttaccgtgggtaacggaaacgcccggaccccttaagtaacgtacacgttcgaccctaacgtcgtcgttaccgtggttacgtaacgttaacgttaacgggg

SEQ ID NO: 429740 - DNA, 650 bp, Homo sapiens
  misc_feature: GZ8MTXP01BLVT7.19.71.G05.1.454.CMB.2.raw
  modified_base (230)..(230): a, c, t, g, unknown or other
  modified_base (240)..(240): a, c, t, g, unknown or other
  modified_base (250)..(250): a, c, t, g, unknown or other
  modified_base (254)..(254): a, c, t, g, unknown or other
  modified_base (259)..(259): a, c, t, g, unknown or other
  modified_base (262)..(262): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacgatacgactgactaagcagccanaattctttanactatacaanatanaactntanctagacagacagagacagacacgtcctacgtagctgtactatattacgcggactacgtaccgtacccggtacgtcccgggtcctacgaccgttacgtcgacggtcgaacgtacgggtcgggtacgtacgggactacgttcttaccactacctacctaccactacgacgacgtacgacgacgacgacgacgtacgaagtagtaggtacgggtacgttaagtttaacgttagttacgttaacgtaaacttaaatttaatttaactttaacgttacgttacggttacggttaacggtaccggttaaccggtaacggttaacggtaaacggtaacgttacgttacgttacgtaacgtacgtaagtcggtacggttacgtaacgaacgtaacg

SEQ ID NO: 429741 - DNA, 669 bp, Homo sapiens
  misc_feature: GZ8MTXP01A7K61.19.71.G05.1.454.CMB.2.raw
  modified_base (253)..(253): a, c, t, g, unknown or other
  modified_base (411)..(411): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctcccgtggctgtgtctcgtgggcgaggccggccaccatacaactgacaacgtccagcccaactaattcttttaanactacgttaccaaactaatacgaaaacttacttagcttacggaccagacagacgaccgaggacacgtcctcgtaggctcgcttactactttacgcgggtctagtccgtaacccgggacgtccccggggtcccctaggacctagttcgacggtcgacgnggtccgggtgtagggactagtcttcactctcacatcacgcgacgccgtagccgaggtactaggaagtacgttgggtacggttacttaagttttagttacgttacgtaacctaaatttaaattattttaattacgttcgtttacgggtggttaacccgggttaccgggtaaccgttaaaggggtaaccgtaaggggttagttaacgttaacggtaacgtaaggtaaccgtaacgttgggaccgtcgttaacggaacccg

SEQ ID NO: 429742 - DNA, 590 bp, Homo sapiens
  misc_feature: GZ8MTXP01CGFD7.19.71.G05.1.454.CMB.2.raw
  modified_base (440)..(440): a, c, t, g, unknown or other
  modified_base (445)..(445): a, c, t, g, unknown or other
  modified_base (468)..(468): a, c, t, g, unknown or other
  modified_base (540)..(540): a, c, t, g, unknown or other
tcagtactctcgtgcacgaccggtgctcgatttagtgtcgtcgcaagagagaggggggcagagtctgctgaattctggctgaccagggcagtcaccagagctcaagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtcgtccggggacagacgtcgctacgcgacagtgttgcgttggctacgtgggtcagggccacgtccccagtcgagacggtctaggagtggcgtagggagactataattcaaagttcgtaaccaacgtaacgtagggaaactaacgtaaattactacgacacctatacgtgttagagagtcgatagacatacaacgtanacganaagtacgaacgacctacgttccncctacggactaacgtcttacgaacccttcgtcggttacgaccgttacccggaaacggacgttaccggggttnttacgttaacgttagtcggttaaggaccgacggtaacccccaagtaaccg

SEQ ID NO: 429743 - DNA, 644 bp, Homo sapiens
  misc_feature: GZ8MTXP01CLUDY.19.71.G05.1.454.CMB.2.raw
  modified_base (279)..(279): a, c, t, g, unknown or other
  modified_base (349)..(349): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctccctggctgtgtctcgtgggcgaggccgggccacgatacgaacgtgacaacgtccacgccaactaattctttaactactacgttacccaaataagtaanaaaactacttagcgttagaaccagacaaggacgaccgaggtacacgccctcgtaggctgctctatttcgnggacctagtccgtaacccgggtacgtccgggtccccctaggaccgtattcgaggtcgggctcggggcgggttcgaggggacacggttactttccaccttccacaaccacgtcacgtcacgtccgtagccgtaggctaaggtagtagtggggtcgtattagtttattattacgtataaattatttaagttattacgtacgtttcgggtaagggtaaccgttacgggacccgttaaagggtaaccgtaggttagttattacgtaacgaggtaaacctgtgggttcgtcgttcgaacc

SEQ ID NO: 429744 - DNA, 673 bp, Homo sapiens
  misc_feature: GZ8MTXP01A9RR4.19.71.G05.1.454.CMB.2.raw
  modified_base (357)..(357): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatccgtccggggacagagtcgctagcgactagtgttgcgttggcacgtgggcaggcacgtccccagtcgagaggtctaggagtggcgtagggaagactattatttcatcgtaccaagtacgtaggaaactaacaaattangaccaacctatcgtgttagagtacgtacgactagaactaatacaaagtacgaacacaagtaaccgaaacgtaacctacgttccctacccgtagaccgtacgtccgttacgtaccccgttacgttacggtaccgaaccccgttacccgggaacggtaacccggtacggggttagttaacgttaacgtttacgggtaacggttacgggaaacggtacccgggttaacccccgtaaggttaaccgaccgttacgttacccgtaaccccgttacccgttccggttccttcggttcgggttaacgttaacgtttaaccggg

SEQ ID NO: 429745 - DNA, 590 bp, Homo sapiens
  misc_feature: GZ8MTXP01BP4GI.19.71.G05.1.454.CMB.2.raw
  modified_base (383)..(383): a, c, t, g, unknown or other
  modified_base (449)..(449): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgccgtgctgggcctccacaaggtgtcctgtcacaagtacagctgcagcagtcaggtccaggactggtgaacgccctcgcacgaccctctcgctcacctgtcgccagtccgtccggggacaggacgtcgctagcgactagtgttgtcgttggcacgtgggtcaggccacgtccccatcggagaggtctaggagtggacgtagggaacgactagtattcatacgtaccaacgtacgtagaatacgaaattancgacactattgtgtagagagtacgactagaacaatacgaaagtacgaacacgtaactaccggaaanaacccgttagttcccctccgttagacccaggtccctaggtaccccttcgtaacgtacgacccgtcccggaaggtaaccgtacggggttattagttacgttcgtaggtaacggaacggtccggacccctaagttaacgaacc

SEQ ID NO: 429746 - DNA, 591 bp, Homo sapiens
  misc_feature: GZ8MTXP01E15VQ.19.71.G05.1.454.CMB.2.raw
  modified_base (376)..(376): a, c, t, g, unknown or other
  modified_base (421)..(421): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctgctgtgtctctgggcgagcgggccaccatcaactgcaagtccagccacaatcttttaatacagttccaacaatagaaaactacttagcttggtaccagcagagaccaggacaggccctcctaggctgctactatttacgtgggcactccgtaccccggggaatcccgggggtcccccctggacgattcgagtgggcngcgggtctggggacagtatttcactctcaccatcagcacgccctncgaggctaggaaagtgtgggtggtctaagttttaattattgactaaactaattattaacttaacgttaaccgtttcggtaaggtacccggttacgggaccgaaacgggaacccgtaagggttgggaacttactcgaacggtaaccgaacgttggacggtcttaacggccc

SEQ ID NO: 429747 - DNA, 638 bp, Homo sapiens
  misc_feature: GZ8MTXP01AJM0J.19.71.G05.1.454.CMB.2.raw
  modified_base (237)..(237): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgaccagtctcagactcctggctgtgtctcgtgggcgagcgggcacgatacgactgactaagtcagcactaatctttaanactactacaataataactaaactactagtacgtacgacagacagacgacgacgacacgtcctacgtagctacgctactagttacgcggactacgtaccggtaccgggtacgtcccccgggtacctacgtaaccgtacgtcgaagggtcggcgtacgggtcgggtcgtacggtactacgtacttcactctacactactacgacgacgacgtcgtacgacgacgtacgtacgtaacgtacggtacggtacggtacgttagtttagttagttacgtaacgtaaactaattaattaacttaacgttacgttaacggtacggttacggtaccggttaacggtaacggtaacgttacggttacgttacgtaacgtacgtaacgtaacgtacgttacgtcgttcgtcg

SEQ ID NO: 429748 - DNA, 683 bp, Homo sapiens
  misc_feature: GZ8MTXP01CR883.19.71.G05.1.454.CMB.2.raw
  modified_base (253)..(253): a, c, t, g, unknown or other
  modified_base (320)..(320): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtgccagtcgtccgggganagagtcgctagcgacagtgttgcttggctacgtgggtcaggcacgtccccagtcgagtaggtctagngtggcgtaggggaacgactattattcagtacgtaccaacgtacgtaggaaatactaaagttatacgacctacctaattcgttagttaggaacgtacgtacgaacgttacggaaacctaaacgttaaccgaaacggttaacgaaacctaacggtaacgttaaaccggaaaacgtaaaccccttacggttaccctaccccgtagaccgtaacgtccgttaacgtaccccgttcggtcggtaccggaacccgttaccccgggaacgggtaaaccggttaccgggggttattaacgttacggtttaaccggtgggttaaccgggtaaaccggacccggttacccccgtaaggttaacggtaaacccg

SEQ ID NO: 429749 - DNA, 657 bp, Homo sapiens
  misc_feature: GZ8MTXP01ENSJB.19.71.G05.1.454.CMB.2.raw
  modified_base (240)..(240): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgacaagtccagccactaattcttttaanactacgttaccaaataataacgtaaactacgtagtcgtacgaacagacaagacgaccgaggacacgcctacgtagctcgtcttactagtttacgcgggactacgtaccggtaaccggacgtccccgggtcctacggaccgtatcgaggtcggaacgacgggtcgggtacgtagggaactagttacttaccgacttcctaccactacgtacgacgaccacgtccgtagacgagcgtaagaagtagtcggtacggggtatttaaggtttaacttagttacgtaactaaacttaaatttaatttaacttaacgttacgttacggtacggtaacggttacggaacgtaaacgggttacgtaaagggtagttaagttacgacgaaggtaacgtaacgttcggcggttactaacgccgtaacg

SEQ ID NO: 429750 - DNA, 646 bp, Homo sapiens
  misc_feature: GZ8MTXP01A4FPQ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatccgtcgggacagacgtcgctagcgacgtagtgttgcgttggcgacgtggtcacggcacgtccccagtcgagtaggtctaggaggtggcgtagggaagtactattatttcaagttacgtaaccgaaacgtacggtaggtaaacttaacgtaaattacgtacgacctaacctagttacgttaggttagaggtacgtacgtactacgaactaacgtaccgtaaacgtacgaaccaacgtaagttaaccggaaacgtaacccttacggttccctaccgttggacctaacgtccgtacgtacccgttcgtacgaccggtaccgttcccgggaaacggtaccgttacggggttattaacgttaagttaccgttgggacgaacggaccgtaaccccgttaagtaacccgg

SEQ ID NO: 429751 - DNA, 646 bp, Homo sapiens
  misc_feature: GZ8MTXP01CR8NK.19.71.G05.1.454.CMB.2.raw
  modified_base (246)..(246): a, c, t, g, unknown or other
  modified_base (288)..(288): a, c, t, g, unknown or other
  modified_base (383)..(383): a, c, t, g, unknown or other
  modified_base (443)..(443): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagacctccctggctggtgtctcgtgggcgaggccgggccaccgatcgaactgacaagtccagccactaattctttanacagttaccaaatatagaaactctagcttaggaccagcaganaccaggacagcctaccaggctcgactctagtttacgcgggactacgtacccgtaacccgggtagttcccccgggggtcccccttaggaaaccgtnttcccggaggtcggcgaacggtccgggtcgtaggggacagtacttcacctactcacctancacgcacgcgagacgaggtatagaagtgtggggtagtacgtttagttattagtacgtataaagtaatttacgttaagttaccgttacggttacggtaacggttaaccggttaccgggtaaacgaacggggtaaccgtaaggggttacgttaacgttacaacggtaaacgtaacggtacgtggttacgtaacgttaacgtaacc

SEQ ID NO: 429752 - DNA, 547 bp, Homo sapiens
  misc_feature: GZ8MTXP01DSBE9.19.71.G05.1.454.CMB.2.raw
  modified_base (340)..(340): a, c, t, g, unknown or other
  modified_base (370)..(370): a, c, t, g, unknown or other
  modified_base (404)..(404): a, c, t, g, unknown or other
  modified_base (517)..(517): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttctcctgccgtgctgggcctcccacaaggtgtcctgtcacaagtacagctgcagcagtcaggtccaggactggtgaagccctgcagaccctctcgctcacctgtcgccatcgtcgggacagagtcgctagcgacagtgttgcttggcacgtgggtcaggcaacgtccccatcgagaggtctagagtggcgtagggaggtacatattcaagtntcaaacgtacgtaggaaataacgaaattanacgacaccatctgtagacgagtcgactagacaancaaagtagacgaacacgttacaaacgtaaccagttccaccctagccgtagtcgtactaccctcgtggctacccgttaccggaggtacgttacgggttgaacgttaagttacgnggttaggaacgacggtccccttaagaaccg

SEQ ID NO: 429753 - DNA, 666 bp, Homo sapiens
  misc_feature: GZ8MTXP01EYS1T.19.71.G05.1.454.CMB.2.raw
  modified_base (222)..(222): a, c, t, g, unknown or other
  modified_base (241)..(241): a, c, t, g, unknown or other
  modified_base (251)..(251): a, c, t, g, unknown or other
  modified_base (287)..(287): a, c, t, g, unknown or other
  modified_base (317)..(317): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgagcgggccacgatacgactganaagtcagcactatctttanactatacaanaatacaaactatagctagacagacagacacgagacncgtcctacgagctcgtactactagttacgnggacctacgtaccggtaccgggtacggtcccgggtacccacggtacgtgtcgacggtcggcgcgggtcggtacgacgggactagtacttacactcctaccaccgtactcgacgacgacgtacgtacgacgacggtacgtaacggtaagtacggtacggggttacggttacgttaacgtttaagtttaacgttaacgttaaactaaacttaaactttaactttaacgtttaacgtttacgttacggttaacggttacggttaccggtaaccggttaaacgggtaacggtaacggttacggttacgttacgtaacgtacgtaacgtacgtacggttacgtcgttcgtaacg

SEQ ID NO: 429754 - DNA, 674 bp, Homo sapiens
  misc_feature: GZ8MTXP01A3Z6Z.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctcgcacgaccctctcgctcacctgtcgccacgtcgtccggggacagacgtcgctagcgactggtgtgcttaggctacgtgggtcaggccacgtccccagtcggaggtacggtctaggagttggcgtaggggaagactaagttactttcaacgttcgtaaccgaaacgtacggtaagggtaaactaactaaaagttacgtacgtaccctaacgtagttcgttaggttaggaagtacgttacgacttaggaaactaaacgtacgaaacgtaacgaaccaacgtaagtaaccgaaaccgtaaaccgttaccgttaccctaccgtacgtaccgaacggtcccttacggtaacccgttcgttaccggttcggtaaccccgttaccgggaaacggtaaccggttacgggttagttaacgtttaacgtacggtggtacggaacggttacccggaacccttaagtaacccg

SEQ ID NO: 429755 - DNA, 617 bp, Homo sapiens
  misc_feature: GZ8MTXP01E0RDD.19.71.G05.1.454.CMB.2.raw
  modified_base (239)..(239): a, c, t, g, unknown or other
  modified_base (314)..(314): a, c, t, g, unknown or other
  modified_base (361)..(361): a, c, t, g, unknown or other
  modified_base (424)..(424): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaatcttttanacagttccaacaatagaaaactacttagcttggtaccagcagagaccaggacagcctctaggctgctcatttacnggcatcgtacccgggatcccggggtccccctggacgattcgagtgcnggccgggtcgtgggactagtactttcacttctacaccatcagcacgcctgcaggctagaagtntggggtgtcgttaagtttattagttacgtaactaaacttaaatttaatttaagtttaacttaccggtttacgggtaacgggtaaccggtttaccgggaacccggttaaacggggtaacccgtaaaggggttagttaacgttacgtaaccgaacggtaaccggtaacggtcggttacggtaaccgttcgaaccc

SEQ ID NO: 429756 - DNA, 674 bp, Homo sapiens
  misc_feature: GZ8MTXP01BCMN6.19.71.G05.1.454.CMB.2.raw
  modified_base (245)..(245): a, c, t, g, unknown or other
  modified_base (340)..(340): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgaggccggccaccatcaactgacaagtccagccataattactttanactacgttaccaaataatacgaaaactactagacttaggaaccagacagacgacccaggaccacgccctaccgtaggctgcctatacgtttacgnggctacgttccgtaacccggggtaacgtccccgggggtaccccctaggaccgtattacgaggttcggacgtgggtcgggtccgtaggggacctaggttactttacgaccttcctacctaaccctagtaccgaacgtcgacggtccgtaggaccgtaggacgtaggaaagtcggttggggtacgggttactttaaggtttaatttagtactaactaaacttaaattattaattagtaccgttcgggtaagtacggttacggaccgttaagggaaccgtaaggttacgttattacgtaacgaagtaacgtacgtggttacgtaacgttcgtaaccg

SEQ ID NO: 429757 - DNA, 727 bp, Homo sapiens
  misc_feature: GZ8MTXP01C9I5U.19.71.G05.1.454.CMB.2.raw
  modified_base (234)..(234): a, c, t, g, unknown or other
  modified_base (237)..(237): a, c, t, g, unknown or other
  modified_base (300)..(300): a, c, t, g, unknown or other
  modified_base (429)..(429): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccctccacaaggtgtcctgtcacaagtacagctgcagcagtcaggtccaggactggtgaacgccctcgcacgaccctctcgctcacctgtcgccagtccgtaccgggganagngtcgcgtagcgactagtgtgcgttggcacgtgggtcaggcacgtcccagtcgagagtctaggngtggcgtagggaagactagttatttcagtacgtaccaacgtagtaggtaaactaacgtaaattgtcgacctaactattcgtgttagacgtacgtacgaactagaactaactacgtaaacgtagactaanaacgtaacgtaaacgtacccgttaacggttccctaccccgtagaaccgtacggttaccggttaacccgtacccgttacgttacgggttaccggtaaccccgtacccgggtaacgggtaaacccgggttaagggtttacgtttaaacgttaaccgtttaacgggtaacggggttaacgggaaaccggtacccgggttaccccctaaagttaccggaaccgttaccgttcccgtaaccccgttaaccggttccggttaccgttaccgggttcggttaacggttaaccgttttaaccgggg

SEQ ID NO: 429758 - DNA, 575 bp, Homo sapiens
  misc_feature: GZ8MTXP01C0HGZ.19.71.G05.1.454.CMB.2.raw
  modified_base (243)..(243): a, c, t, g, unknown or other
  modified_base (322)..(322): a, c, t, g, unknown or other
  modified_base (361)..(361): a, c, t, g, unknown or other
  modified_base (373)..(373): a, c, t, g, unknown or other
  modified_base (428)..(428): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagactccctggctgtgtctcgtgggcgagccgggccacgatacgaactgacaagtccagccaacaattctttanacagttaccaaacaatagaaaactacttagcttaggaccagacagacgaccagacagcctctaggctgctcatttacgnggctagtccgtacccgggatcccggggtccctgaccgtnttcgagtcggcnggcgggtcagggacagtactttcactctcaccatcacgcagcctgcagcagaagntggggtcggatttaagtttattattgtactaaataattattaagttactacgtttggtaacggtacgtttcgggacccttaagggtaaccaagggttacggactttacggaagaacggtaacgtacgtggttacgtcgttcgtaacc

SEQ ID NO: 429759 - DNA, 561 bp, Homo sapiens
  misc_feature: GZ8MTXP01A90HE.19.71.G05.1.454.CMB.2.raw
  modified_base (224)..(224): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctntcgctcacctgtgccatcgtccggggacagagtcgctagcgacagtgttgcttggcacgtgggtcaggcacgtccccatccgagaggtctaggagtggctaggggaaggtacagttatttcaattcggtcccaaacgtacggtaggaaactacaaaattactcgacaacctaatcgtagttgacgtagttcggactgaacaatacaaacggttacacaactagtacgaaacgaacctacgttctccctgcagcctcgaccttctgttcgtaccgttccggaaggacttacgggttcgttataattacgtggtaggaacgacggtccccaagtaaccg

SEQ ID NO: 429760 - DNA, 694 bp, Homo sapiens
  misc_feature: GZ8MTXP01ADP5M.19.71.G05.1.454.CMB.2.raw
  modified_base (241)..(241): a, c, t, g, unknown or other
  modified_base (382)..(382): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacgatcaactgacaagtccagccataattcttttaanactagttaccaaacaatagaaaacttctagtctggtaccagacagacgaccaggtacagccctcgtaggctcgctactacgtttacgcgggactacgtcccgtaacccgggtaacgtcccggggtaccctcgaacccggtnttaccgaggtcggaacgtacgggtcggtcgtacggggactaggttcctttcaaccttcctaccacccaagtcaacgccacgtccgtagaccgaagggcttaaggaaagtcgtttaaggggtacggggttaacttaagttttaacgttacgttaacgtaaactaaagttaaattttactttaagttaccgttacgttcgggttaacgggtaaccggttaccggaacggtaaacgggttacggtaaagggtacgttaacttaggttacgaacggtacgtaacggttcggtacgttacgtccgttaaccgtaacg

SEQ ID NO: 429761 - DNA, 656 bp, Homo sapiens
  misc_feature: GZ8MTXP01A86GQ.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtccgtccggggacagagtcgctagcgacagtgttgcttggcacgtggtcaggcacgtccccagtcgagtggtctaggaggtggcgtaggggaagactagttactttcgagtcgtaccaacgtacgtaggtaaactaactaaagttatcgaccaaacctatcgttagttgaaggtagtcgaactcgaaactaatacaaacggtacgtacaacagtaaccgaacgtaaaccctacggtttcccacccgtagtacgaaggttcctacggtaacccttcgtacgtacgtaccccgtacccggtaaggaacccggtacgggttagttaattacgttaggtaacggtacgggaaaccggaaccggttccccctaaagtacggaacttcggttcccaacccgttaccgtccgttacgtccgttgggtaaccttcgtttaacgg

SEQ ID NO: 429762 - DNA, 635 bp, Homo sapiens
  misc_feature: GZ8MTXP01EJWVE.19.71.G05.1.454.CMB.2.raw
  modified_base (243)..(243): a, c, t, g, unknown or other
  modified_base (332)..(332): a, c, t, g, unknown or other
  modified_base (468)..(468): a, c, t, g, unknown or other
  modified_base (592)..(592): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtggcgagccggccacatcaactgcaagtccagccaactaattctttaanactacgttaccaaataatagaaaactatagcttaggaccagacagacgaccaggacagccctcgtaggctgaccttctaatttacccgnggggaccacgttcccgtaacccggggaacgttccccggggtaccccctagaccgtatttccgaggtcggccgtaagggtccgggtcgtacggggactaggttacttcacttccgactaccatcgacgcacgtccgngacgacgtacaggagtgtggggtacgttagttatttattagttagtaactaaagttaatttattaattacgtaccgttgggtaacggttacggttaccgggaaacgttaacgggaacgtaaggngttaacttcgtaacgagtaacgtacgtggttcgtaacgttcgc

SEQ ID NO: 429763 - DNA, 625 bp, Homo sapiens
  misc_feature: GZ8MTXP01AK6SR.19.71.G05.1.454.CMB.2.raw
  modified_base (238)..(238): a, c, t, g, unknown or other
  modified_base (313)..(313): a, c, t, g, unknown or other
  modified_base (388)..(388): a, c, t, g, unknown or other
  modified_base (440)..(440): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttctcttcttcctgcccgtgctggcctcccacaaggtgtcctgtcacaagtacagctgcagcagtcaggtccaggactggtcgaacgccctcgcacgaccctctcgctcacctgtcnccatccgtccggggacagagtcgctagcgacaggtgttgcttggctacgtgggtcaggcacgtccccagtcgagnggtctaggagtggcgtaggggaaggactagttacttcaattcgtaaccaacgacgtaggaaactaactaaattancgactactagtcgtagttagagtacgtcgactagaactaatacgaaacgtanaacgaacgtacgtaaccgaaacgtaacccgtcgttacccgtacccgttaggacctacggtcctacgtaacccgttcgtacggttaccgtaccgttaccccgggtaagggtaccgttaacggggttcttaacgttaacgttacgtaagggtacggaacggacccgggtaaccccttaagtaaccgg

SEQ ID NO: 429764 - DNA, 548 bp, Homo sapiens
  misc_feature: GZ8MTXP01BK5IU.19.71.G05.1.454.CMB.2.raw
  modified_base (320)..(320): a, c, t, g, unknown or other
  modified_base (502)..(502): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctccacctgtcgccatccgtccggggacagagtcgctagcgacagtgttgcgttggcacgtgggtcaggccacgtccccagtcgagaggtcagngtggcgtggggaagacatatttcaattgtccaaacacgtaggaaactacgtaaattatcgacacatcgtgttgaggtagtcgactagacaatacaacgtagacacagtacgaagaacctacgtcctccctgcgtacgctcgacctctgttcgtaccgttcccggaggtacgttacggggttnttagttaacttacgtgtacgggtacgacggtccccgttaagtaacg

SEQ ID NO: 429765 - DNA, 619 bp, Homo sapiens
  misc_feature: GZ8MTXP01CIRDY.19.71.G05.1.454.CMB.2.raw
  modified_base (257)..(257): a, c, t, g, unknown or other
  modified_base (267)..(267): a, c, t, g, unknown or other
  modified_base (313)..(313): a, c, t, g, unknown or other
  modified_base (322)..(322): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagacctccctggctgtgtctcgtgggcgagccggccacatcaactgacaacgtccagccactaattctttatactacgttaccaanatagaaactnttagcttagacagcagacgaccgagacagtccctactaggctgctntatttacgnggactacgttccgtaacccggggacgtcccgggggtccccctaggtaccgtattccgaggtcggcgtaagggtccgggtacgtggggaacctagtactttcaaccttcaccaacactcgacgcacgcctagcgaggtctagaagtgtcgggggtagtactttaagttttatagttagtaacctaaataatttaattattttacgtacggttcggtaacggtaaccgtttccggaaaccggagggtaaaccgtagggttagattacgtcaagggtaactacgtggaccgtcgcgtaac

SEQ ID NO: 429766 - DNA, 669 bp, Homo sapiens
  misc_feature: GZ8MTXP01DLO50.19.71.G05.1.454.CMB.2.raw
  modified_base (225)..(225): a, c, t, g, unknown or other
  modified_base (238)..(238): a, c, t, g, unknown or other
  modified_base (618)..(618): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctntcgctcactgtcnccatccgtcggggacagacgtcgactacgcgacgtaggtcgtgtcgttcggctacggtgggtacacggcctacggtccccagtcggaaggtacggtactaggaggtggacggtaggggaacggtactaagttactttacgaaattcgtaacccgaaacgtacggtaaggtaaactaaacgtaaatttacgacgtacctaacctatcgttaggttagaaggtaacgttacgaacgtacgaaactaataaccgtaaacggtacgaaacgtacgtaaacgttaaccgaaaacgtaaaccctaacggtttccctaccccgttaggacacggtactcgaccttaacgtcgttacgacccgttacggaaggtacccgttagggttnttaacgtttaacgtacgtggtacggaacgacccggaacccttaagtaaccg

SEQ ID NO: 429767 - DNA, 578 bp, Homo sapiens
  misc_feature: GZ8MTXP01AVEKS.19.71.G05.1.454.CMB.2.raw
  modified_base (241)..(241): a, c, t, g, unknown or other
  modified_base (318)..(318): a, c, t, g, unknown or other
  modified_base (346)..(346): a, c, t, g, unknown or other
  modified_base (351)..(351): a, c, t, g, unknown or other
  modified_base (360)..(360): a, c, t, g, unknown or other
  modified_base (369)..(369): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctcgtggcgagcggccacatcaactgacaagtccagccactaattcttttaanactagttaccaaacaatagaaaactcttagcttaggaccagcagacgaccaggacagcctcaggctgctcatttacnggacatcgtaccggatccggggtccccngacgntcgagtgcnggcgggtcngggacagtcttcactctacacatcagcacgcctgcaggctagaagtagtcgggtaggtacttagtttattagtacgtactaaactaattattatttacttacgtttcggtaacggtaacgttcgggaacccgttaaagggtaccgtaaagggttcggttaattacgttaacaaggtaaccgtaagtggttacgggtaacttcggtaacc

SEQ ID NO: 429768 - DNA, 679 bp, Homo sapiens
  misc_feature: GZ8MTXP01A79AS.19.71.G05.1.454.CMB.2.raw
  modified_base (244)..(244): a, c, t, g, unknown or other
  modified_base (256)..(256): a, c, t, g, unknown or other
  modified_base (320)..(320): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgagccgggccaccatcaactgacaagtccagccactattctttaanacagtaccaaanaatagaaactctagctgacagacagacgacaggacacgcctcgtaggctgctatacgtttacgnggactacgtaccggtaacccgggacgtcccggggtacctcggaccgtattcgaggtcggacgacgggtccgggttacgacggggaacctaggttaactttccaaccttccctaccctaaccctactaccgacggtaccaccgcccgtaggaccgtaacgggtaccgttaaggaaacggtcgttggtacggggtactttaaaggttttataactttacgaactaaattaatttatttaacttaacgtcgttacggtacggtaaccggttacggacccgtaaagggttacccgtaagggttacggaacttcgttaccggaaacgtacgtaacgttgggtacgaccgttcgaacccgtaacc

SEQ ID NO: 429769 - DNA, 676 bp, Homo sapiens
  misc_feature: GZ8MTXP01A8LC8.19.71.G05.1.454.CMB.2.raw
  modified_base (246)..(246): a, c, t, g, unknown or other
  modified_base (257)..(257): a, c, t, g, unknown or other
  modified_base (309)..(309): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggcctacgactacgacgtcgactaagtccagcactaatctttanacagtaccaanatagaaactctagcttaggaccagcagagaccaggactagcctcgaggtctnctactactcgtgactacgtacgtaccggtacggtcccggtaccgtacgtacgtacgtcgtaacgtcgcgacggtcgggtacggtacggtacgtacgtacttactactactacctactactacgacgacgtacgtacgtacgacgtacgtacgtagtaagtacgggtacggtacggttacgttaagtttaagttacgttacgtaacgtaaacttaaacttaaacgtttaacgtttaacgttacggttaacggttaccgggttaccgggttaccgggttaaccgggtaaacgggtaaccggttaacggttacggttaacgtaacgtaacgtaacggtaacggtacggttacggtaacggttcggtaacg

SEQ ID NO: 429770 - DNA, 650 bp, Homo sapiens
  misc_feature: GZ8MTXP01BDU43.19.71.G05.1.454.CMB.2.raw
  modified_base (154)..(154): a, c, t, g, unknown or other
  modified_base (584)..(584): a, c, t, g, unknown or other
tcagtactctcgtgcacgaccggtgctcgatttagtgtcgtcgcaagagagaggggggcagagtctgctgaattctggctgaccgagggcagtcaccagagctccagacaatgtctgtctccttcctcttcttcctgccgtgctggcctcccanaaggtgtcctgtcacaagtacagctgcagcagtcaggtccaggactggtagaacgccctgcacgaccctctcgctcactgtcgccagtccgtccggggacagacgtcgactagcgactaggttgttgcttggctacgtggtcaggcacgtcccctagtcgagtaggtctaggagtcggacgtacggggaaggtactagttactttcgaagttcgtaaccaaacgtacggtaaggtaaacttaactaaattacgtacgacctacgtatcgttagttagagtacgtacgtactacgaactaactaccgaaacgttcgaacacaacgtaaccgaaacgtaaccctcgttccctcccgtagaccgtacgtcctaccggccttaacgttcgttaccggtaccgttacccgggtaaaggtaccggttacggggttnttaacgtttaacgttacggtaacgggtaacggaaccggttacccgtaaccccgttaaagtaacccg

SEQ ID NO: 429771 - DNA, 652 bp, Homo sapiens
  misc_feature: GZ8MTXP01A8UYI.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactgggtgaacgccctcgcacgacccctctcgctcacctgtcgcccagtccgtccggggacaggagtccgctagcgacaggtgttgcttggcacgtggtcaggcacgtccccagtcgagaggtctaggagtggcgtggggaaggtactagttactttcgaacgttcgtaaccaaacgtacgggttaggaaattaacgtaaatttacgtacgacctaacctattcgtagttagagtacgtacgtaactacggaactaagtaccgtaaacggtaacaacctaacgaacgttaaccggaaacgtaaccctaccggtttccctaccccgttaggacctacggtccttaccggtaacccttcgttacggttacgaacccgttcccggaagggtacccgttacgggttgttacgttaacgttaccgtggtacggaacggaccggtccccttaagtaaccg

SEQ ID NO: 429772 - DNA, 538 bp, Homo sapiens
  misc_feature: GZ8MTXP01BHPJ7.19.71.G05.1.454.CMB.2.raw
  modified_base (285)..(285): a, c, t, g, unknown or other
  modified_base (341)..(341): a, c, t, g, unknown or other
  modified_base (408)..(408): a, c, t, g, unknown or other
  modified_base (455)..(455): a, c, t, g, unknown or other
  modified_base (493)..(493): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatccgtccggggacagagtcgctagcgacagtgttgcttggcacgtgggtcaggcagtccccatcgagnggtcagagtggctgggaagcattatttcatgtcaacacgtaggaactacaaattangacaaccatcgtgttgagagttcgactgaacaatacaacgtagaacacatacgaagaaccagttacnccctgcagctgaccttcgtcgtacgacctccggaggacgtacgggtntagtatacgtggtacggaaggccggaccccatacgacngttcggccctaccgttcgttacgtcgttcggtcgttcgtttaagg

SEQ ID NO: 429773 - DNA, 617 bp, Homo sapiens
  misc_feature: GZ8MTXP01A9BYN.19.71.G05.1.454.CMB.2.raw
  modified_base (153)..(153): a, c, t, g, unknown or other
  modified_base (574)..(574): a, c, t, g, unknown or other
  modified_base (585)..(585): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccanaaggtgtcctgtcacaagtacagctgcagcagtcaggtccaggactggtgaacgccctcgcacgacccctctcgctcacctgtcgccatcgtccggggacaggagtcgctagcgacgagtgtgcgttggctacgtgggtcaggccacgtcccagtcgagaggtcgtaggagtggcgtaggggaacgactattatttcatacgtaccaacgtacggtaagaaataactaaattacgacgtaccaacctagttcgttaggttacgaagtacggttacgaacttaagaacctaaagtaccgtaaacggtaagaaccaacgtaaacgttaaccggaaacgtaacccgttagttccctacccgtagacccagtcctaccgtaccttcgtaagtccgaccgtacccggaggtaccgtagggttattnttagttaacgnggtaacggaacgccgaccctaagaacgtaacg

SEQ ID NO: 429774 - DNA, 575 bp, Homo sapiens
  misc_feature: GZ8MTXP01B5RD2.19.71.G05.1.454.CMB.2.raw
  modified_base (382)..(382): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaacgccctcgcacgaccctctcgctcacctgtcgccagtcgtccggggacaggacgtcgctagcgacagtgttgcttggcacgtgggtcaggcacgtccccagtcgagagtctaggagtggcgtagggaacggactattattcatacgtacccaagtacgtaggaaactaactaaattangacctactatcgtaggttgaagtagtacgactagaacaactacaacgtagacaacgatacgaaacgtaacctagttccctccgtgccacgtcctcgtaccttgtaacgtcgacccgtaccggaggtaccgtacgggttagttacttacgttaacgtggtaacggaacgtaccggacccctaagttaacgaacc

SEQ ID NO: 429775 - DNA, 651 bp, Homo sapiens
  misc_feature: GZ8MTXP01CBN13.19.71.G05.1.454.CMB.2.raw
  modified_base (240)..(240): a, c, t, g, unknown or other
  modified_base (324)..(324): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactcctggctgtgtctcgtgggcgagcgggcacgatcaactgacaagtccagccacaattcttttaanactagttacaataatacgtaaactactagcttagacagcagacgaccgagacacgcctacgtaggctcgtctactagtttacgnggactacgtaccgtaaccgggtacgtcccggggtacccctggacgtattcgaggtcggctaagggtcgggtacgtggggaactagttactttacaccttacctaccaacctatacgacgcgacgtccgtacgacgacggtacgtacggtaagtagttacggggtaggtacgttaacgtttaacgtttacgttacgttacgtaactaacttaatttaatttaacttacgttacgttaacggttacggttacggtacggttaacggtaacggtaacggttacggttagttacgtaagtacgtaacgtacgtacgttacgtcgttcgtcg

SEQ ID NO: 429776 - DNA, 580 bp, Homo sapiens
  misc_feature: GZ8MTXP01APSOD.19.71.G05.1.454.CMB.2.raw
  modified_base (497)..(497): a, c, t, g, unknown or other
  modified_base (532)..(532): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcactgtcgccatccgtccggggacagagtcgctagcgacagtgtgcttggcacgtggtcaggcacgtccccagtcgagaggtctaggagtcggcgtaggggaaggactattactttcgaaattcgtcccaaacgaccggtaaggaaacttaacgaaaatttacgcgacctacctattcgtggttagagtacgtcgaatagaactaatacaaagtacgaacgacagtacgaaacaacctagttccctacgtgactacgctcgaccctnttgccacgttacccggaagggtacttacggggttnttaataagttacgtggtaacgggacgaccggaaccccttaagtaaccg

SEQ ID NO: 429777 - DNA, 709 bp, Homo sapiens
  misc_feature: GZ8MTXP01D2Q9O.19.71.G05.1.454.CMB.2.raw
  modified_base (244)..(244): a, c, t, g, unknown or other
  modified_base (320)..(320): a, c, t, g, unknown or other
  modified_base (328)..(328): a, c, t, g, unknown or other
  modified_base (383)..(383): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgagccggccacgatcaactgacagtccagccaactaattctttanacacgttaccaaataatagaaaactacttagcttacggtaccagacagacgaccaggacacgcctacaggctgctntatttcgnggctacgtaccgtaccgggacgtccgggtacccctgaccgtatccgagtcggacngggtcgggtcgtacggggactacggttacttccgaactcctaccaacctgtaccgaagccctaacggtcccgtgaccgtaggactaggtaaagtcggttagggtacgggtttactttaaggttttaattagttaaccgtaaactaaaacgtttaaattttacgtttaaatttaacggtttaacccgtttcggggtaacggtttaacccgggttacggggaaaccccgttaaaaggggtacccgttaaaggggttaacggttattaaacggtcggtaaaacggtaacccggttaaacgtaggggttaccgcgttaacggtaaccccg

SEQ ID NO: 429778 - DNA, 649 bp, Homo sapiens
  misc_feature: GZ8MTXP01A8LXX.19.71.G05.1.454.CMB.2.raw
  modified_base (325)..(325): a, c, t, g, unknown or other
  modified_base (386)..(386): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcacgacccctctcgctcacctgtcgccatccgtccggggacaggagtcgctagcgacagtgtcgcgttggctacgtgggtcagggccacgtccccagtcggagaggtctaggngtggcgtaggggaacgactattattcatacgaccaacgacggtaagaataactaaatttancgactacctattctaggttagaacgtacggtaccgtacgtacgaaacaacgttaccgaaacggttacgaacctaaccggtaagttaacccgggaaactaaacccgtacggtttacccctccgtacgaccgtacgtccgtaccgtaccgttcgtaacggtaccgttacccggtacccgggaagggtaccggttaacggggttagttacgttacgttaacggtacggtaacgggaaccggacccggaccctaagttaaccgaacg

SEQ ID NO: 429779 - DNA, 655 bp, Homo sapiens
  misc_feature: GZ8MTXP01BTXT2.19.71.G05.1.454.CMB.2.raw
  modified_base (237)..(237): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaacgccctgcacgaccctctcgctcacctgtcnccagtcgtccggggacagagtcgcgtagcgacgtagtgttgcgttggcacgtgggtcaggccacgtccccagtccgaggtaggtctaggaggtcggacggtaggggaaggtactagttactttcgaaattcgaaccaaacgtacggtaggtaaataactaaattagtacgacctaactattcgtggttacgagtacggtacgaacttcgaactaaacgtaccgaaagttacgacaactacgtaaccgaaacgtaaacccgtacggtttccctacccggtagccgtacggtaccgttccgtaaacccgttcgttacggttaccggacccgttaccgggaacgggtaacgttacgggggttattaacgttaagttacggtgggtaacggaacggttacccggtaaccccaaggttaaccg

SEQ ID NO: 429780 - DNA, 671 bp, Homo sapiens
  misc_feature: GZ8MTXP01CBI3Q.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctccacaaggtgtcctgtcacaagtacagctgcagcagtcaggtccaggactggtgaagccctgcagaccctctcgctcacctgtcgccatcgtccggggacagagtcgctagcgacagtgtgcttggcacgtgggtcaggcacgtccccagtcggagaggtctaggagtggctaggggaaggtacattattcaagttacgtccaaactacggtaggaaactaactaaaagttactcgaccaacctatccgttaggttagaaggtaacgtacgtaacttacgaaactaaaacgtactaaacggttaacgaacgtaaactaagttaaccgaaaacggtaaacctaacggttacctacccgttacggaccctaaggtccctacggtacccttaacggttacggttaccgtaacccggttaccccggaaagggtaccccgttaacggggttgttaacgttaaacggtttaaccgttggggttaacgggtaaaccggacccggggtaacccccttaagttaaacccgg

SEQ ID NO: 429781 - DNA, 701 bp, Homo sapiens
  misc_feature: GZ8MTXP01D5CQR.19.71.G05.1.454.CMB.2.raw
  modified_base (239)..(239): a, c, t, g, unknown or other
  modified_base (335)..(335): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgacacgaccctctcgctcacctgtcnccacgtcgtccggggacagacgtcgactagcgaactggtcgttgcgttggcacggtcggtcacggcacgtccccagtcggagtcggtacgagacgnggcgtagggaacgtactattacttcaaacgttcgtaaccaaagtacggttaaggaaaacttaacctaaaattacgtaccgactaaccctagttacgtagtttacggaagtacggtttaccgaacgtacggtaaactaaacgtacctaaaacgggttaacgaactaaacgtaaacgttaaaccggaaaccggtaaaccctacggtttacccacccgttacggacctacggtaccttcgaaccgttcgttcggttaccgtaaacccggttacccgggaaacggtaacggttaaaccggtttggttaaactttaacgtttaccgggtaaggtaacgggtaacgacccgtaaccccgttaagtaacccgg

SEQ ID NO: 429782 - DNA, 619 bp, Homo sapiens
  misc_feature: GZ8MTXP01AHBPJ.19.71.G05.1.454.CMB.2.raw
  modified_base (561)..(561): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctcacctgtcgccactcgtccggggacagacgtcgctagcgactaggtgttgcgttggcctacgtgggtcaggccacgtccccagtcggagacggtctagaggtggcgtaggggaaggtactagttattcaaattcggtaaccaaacgtacggtaggtaaactacgtaaatttacgtacgacctaacctattacgtgttagagtacgtcgacttagaactaaataccgaaacgtagaaccactaagtaccgaaacgtaccgtagttccctcctagccagtcctcgtaccctctggttaccgaccgttacccgggaaggtaccgttacgggttnttaacgttaacgttacggtcgggtacggaaccgacccgggtaaccccaaggtaaccgg

SEQ ID NO: 429783 - DNA, 601 bp, Homo sapiens
  misc_feature: GZ8MTXP01CDVNG.19.71.G05.1.454.CMB.2.raw
  modified_base (262)..(262): a, c, t, g, unknown or other
  modified_base (316)..(316): a, c, t, g, unknown or other
  modified_base (437)..(437): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtcgcccgacggggacatcgtgatcgacccagtctccagactccgtggctgtgtctcgtgggcgaggcggccacgatacgaactgactaagtccaacgacctaactaattctttaacactacgtaccaanaactagaaactactagcttaggacagcagagaccaggacagcctcctagcgtcnctacgtattacgtggctagtaccgtaccgggtaagtccgggtcccctagaccccgattccgaggttacgcgaacgccgggtgagggactagtacttacaactctcacacacacggaccacncgcgcgacgacgtagagtagtaggtacgtagttagttattatactaactaataattattacttacgttacgtcggtaacggtacggttacggtacggaacggtaacggtaagttagttacgttacgtaacgtacgtaacgtacggtacgttacgtcgcgtaacg

SEQ ID NO: 429784 - DNA, 595 bp, Homo sapiens
  misc_feature: GZ8MTXP01AG30U.19.71.G05.1.454.CMB.2.raw
  modified_base (252)..(252): a, c, t, g, unknown or other
  modified_base (336)..(336): a, c, t, g, unknown or other
  modified_base (588)..(588): a, c, t, g, unknown or other
tcagtactctcgtgcacgaccggtgctcgatttagtgtcgtcgcaagagagaggggggaggtacaacaggcaggcagggggcagcaagatggtgttgcagacccaggtcttcatttctctgttgctctggatctctggtcgcccgacggggacatcgtgatcgacccagtctccagacctccctggctgtgtctcgtgggcgaggccgggccatcaatcaactgacaagtccagccaactaattcttttaanactacgttaccaaacaatagaaaacttactagcttaggaccagcaagacgaccaggacacgcctcgaggctgctctatttacgngggctacgtccgtaacccggggacgtccccccggggtcctaggaccgtattcgaaggtcgggcgtagggtccgggtctaggggactagtactttcacctctaccacctatccagcacgtcctcggacaggactagaagtacggttgtaggtcttagtttattatcgtaacaaataattattagttaactcgttggtcggttacggtaccggacgaacgggtaacgaggttgataagtcaagacgtacgttgngttcgcg

SEQ ID NO: 429785 - DNA, 698 bp, Homo sapiens
  misc_feature: GZ8MTXP01A28J7.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggactggtgaacgccctcgcacgaccctctcgctcacctgtcgccagtcgtccggggacagacgcgctagcgactagtgtgcgttggcacgtgggtcaggcacgtccccagtcggagacggtctaggaggtggcgtagggaagtactattacttcgaattcgtaacccaaacgtaccggtaggtaaaacttaactaaaagttcgtacgacctaacctagtttaccgttaggtttaggaaggtaacggtacgtaacgttacggaaactaaacttacgaaacggttacaaacctaacgtaacgttaaaccggaaaccgtaaacccgttaccggtttacccttaccccgtacggaccctaaacggtcccgtaccgtaaccccgttcgttacggttaccggtaaaccccgttacccgggaaacgggtaaccgttacgggggttcttaacgttaacgtttacgtaacgggtaacggaaccggacccggtccccttaagtaacccgg

SEQ ID NO: 429786 - DNA, 826 bp, Homo sapiens
  misc_feature: GZ8MTXP01AHPWV.19.71.G05.1.454.CMB.2.raw
  modified_base (245)..(245): a, c, t, g, unknown or other
  modified_base (257)..(257): a, c, t, g, unknown or other
  modified_base (269)..(269): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagccgggccaccatacaactgacaagtccagccataattctttaanactactaccaanaatacgaaactntagctagacagacagacgacgagacacgtcctacgagctgtactactacgtttacgcggactacgtacccggtaacccggggtacgttccccggggtacccctacggaccgtagttccggaggtacggacggtcgggtccgggtacgtacgggtactacgttacttaccgacccttcctaccgtaacctacgtaccgaacgccgtaaccggtcccgtacggaccgtaacgggtaccgttaaagggtaaacgttacggttacgggggttacggttaaacgttttaacggtttttaaaccgtttaacgtttaaccgttaaacttaaaacgttttaaaactttttaacgttttaaaccgtttaaccggtttaacccgggttttaccggggtaaccggggtttaaacccgggtttaacccgggggtaaacccgggttaaaccgggggttaaaacccggttaaagggggtttaacggttaaccgttaaccgtaaacgggtaaaccgggttaaacccggttacggttacgggttaccgggtaacccgttaaccggtaaccccg

SEQ ID NO: 429787 - DNA, 640 bp, Homo sapiens
  misc_feature: GZ8MTXP01CG926.19.71.G05.1.454.CMB.2.raw
  modified_base (240)..(240): a, c, t, g, unknown or other
  modified_base (570)..(570): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctccacaaggtgtcctgtcacaagtacagctgcagcagtcaggtccagggactggtgaacgccctcgccacgaccctctcgctccacctgtcnccatccgtcggggacaggacgtcgctaggcgactaggttgttcggcgtttggctacggtgggtcaggccacgtccccagtcggagacggtctaggagtggacgtaggggaacgactattattcaagttacgtccaaacgtacggtaggaaattaacgaaatttcgacgacctaactattcgttagttacgaagtacgtacgtacgtagaactaatacgaaacgtagaacacaacgtacgaaacgtacctagttccctccgtagcctagtcctcggtaaccttcgtcggttacgtacccgttaccgggtaacgggtaccgttacggggttnttaacgttaacgtttacgggtaacgggttaacgggaaccggttacccgggtaaccccttaaggttaaccg

SEQ ID NO: 429788 - DNA, 537 bp, Homo sapiens
  misc_feature: GZ8MTXP01DLFS0.19.71.G05.1.454.CMB.2.raw
  modified_base (236)..(236): a, c, t, g, unknown or other
  modified_base (251)..(251): a, c, t, g, unknown or other
  modified_base (259)..(259): a, c, t, g, unknown or other
  modified_base (412)..(412): a, c, t, g, unknown or other
  modified_base (422)..(422): a, c, t, g, unknown or other
  modified_base (428)..(428): a, c, t, g, unknown or other
  modified_base (451)..(452): a, c, t, g, unknown or other
  modified_base (496)..(496): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaagcccctgcacgtcctctcgctccactgtcnctatccggacggganagacgtcncgagcaacgtgtgtctgtgctacgtggtcagcacgtacccctagtacgaggagtacgtagaggtgacggtaggacgatattacttcaattctaaccgaaacgtaggtagtaaactaactaaattgcgacactatctgtagagagtcatacganatacaagtanaacganagtaacgaacgactagtcctacnncgtctacgtcacctgtgcgtaccgttccggagtacgttacgttnttacgttaatagtaagtagacgttaccgcccttaagaaccg

SEQ ID NO: 429789 - DNA, 635 bp, Homo sapiens
  misc_feature: GZ8MTXP01CNK05.19.71.G05.1.454.CMB.2.raw
  modified_base (255)..(255): a, c, t, g, unknown or other
  modified_base (346)..(346): a, c, t, g, unknown or other
  modified_base (458)..(459): a, c, t, g, unknown or other
  modified_base (471)..(471): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtcgcccgaggggacatcgtgatcgacccagtcctccagacctcccgtggctgtgtctcgtgggcgaggccgggaccacgatacaacgtgacaacgtccagccaactaattcttttaanaactacgttaaccaaactaatacgtaaaaacttcgtagcttacgacagcaagacgacaggacacgcctcgagctgacttactactttacgngggtacctacgttacccgtaaccggggaccttcccccggggtccctaggaccttagttcgaaggttcggcgtgggtccgggtcgagggacaggttacttcacttcaccaacnncgacgctcgcgngacgagacgtagaagtggttggtacgttagttatttatacgtataactaagttaattatttaagtccttcggtcggtacggttacggtacggaaccgtaaacgggtacgttaaggttcgttaataacgtagtaacggaccgtaggttcgtaaccgttcgtaacg

SEQ ID NO: 429790 - DNA, 671 bp, Homo sapiens
  misc_feature: GZ8MTXP01D0QG4.19.71.G05.1.454.CMB.2.raw
  modified_base (251)..(251): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaagccctgcacgaccctctcgctcacctgtcgccatccgtcgggganagagtcgcgtagcgacagtgttcgcgttggcacgtggtcaggcacgtccccagtcggagtaggtctaggaggtggacgtagggaaggactagttattcaatacgtaaccaaacgtacggtaggtaaactaacgtaaattctacgactaacctattcgtagttacgaaggtacgtacgtaactaggaaactaacttacgaaaacggttacgaaactaaacgtaagtaaaccggtaaacgaacccgttaacgtttcccaccccgttaggaccctaacggtcccgttaacggtccccgttgttacggttacccgtaaacccggttcccggaaacgggttaaccgttacgggggttatttaacgttaacgttacggttaacgggtaacgggaaccggttacccgaaccccgaagttaaacccgg

SEQ ID NO: 429791 - DNA, 742 bp, Homo sapiens
  misc_feature: GZ8MTXP01DRC3C.19.71.G05.1.454.CMB.2.raw
  modified_base (215)..(215): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtnccagtccgtaccggggacagagtcgctagcgactagtgtcgcgttggctacgtggtcaggcacgtccccagtcggagtacggtacgtaggtacgtggcggtaaggggaaacggtactaagtttagtttacgacgttacgtaacccaaacgtacggtaaggtaaacttaaccgtaaaatttacgacgtacctaacccttaagtttccgttaggttacggaaacggtacgtaccgtaacgttacggaaacctaaacgttaaccgaaaacggttacgaaacctaaacgtaacgttaaaccgggaaaaccttaacccgttacggttacccctaccccgtaggaacctaccgggtacctaccgggtaccctttcgtaccggttaccgacccgttacccgggaaggtaaccggtacgggtagttaactacgttcgtaaggtacggaaacggtaccccggttaccctaaagtaccgttacgcttacccggaaccctaccgttcgtactcggttagttcgttaaccgtttaaggg

SEQ ID NO: 429792 - DNA, 542 bp, Homo sapiens
  misc_feature: GZ8MTXP01DI6KJ.19.71.G05.1.454.CMB.2.raw
  modified_base (238)..(238): a, c, t, g, unknown or other
  modified_base (250)..(250): a, c, t, g, unknown or other
  modified_base (304)..(304): a, c, t, g, unknown or other
  modified_base (312)..(312): a, c, t, g, unknown or other
  modified_base (373)..(373): a, c, t, g, unknown or other
  modified_base (404)..(404): a, c, t, g, unknown or other
  modified_base (414)..(414): a, c, t, g, unknown or other
  modified_base (420)..(420): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgcaagtccagccacaatctttanacagttccaaanaatagaaaactctagctggaccagcagagaccaggacagcctcctagctgctanatttacgngggcacgtccgtacccgggaatcccggggccctacgaccgattccgagtgacgagcgggtntagggacagattcacgtctcacagcagctancctgctaggnagaatntggtggtattagttatatagtaactaaatattaattattactacgtcgtcggtaacgtacgaacgtaaggaacgtaaggtgttaattacacgaagtaacgtcgtggtgcgtcgaacgtaacg

SEQ ID NO: 429793 - DNA, 707 bp, Homo sapiens
  misc_feature: GZ8MTXP01DVDTB.19.71.G05.1.454.CMB.2.raw
  modified_base (223)..(223): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctntcgctcacctgtcgcccatccgtccgggggactaggacgtcgctagcgactagtgttgcttggcacgtgggtcaggctacgtccccagtcggacgaggtctaggagtggcgtagggaacggtactattactttacacgttcgtaccaacgtacggtaagggtaaaacttaaactaaaagtttacgtacggaacctaaccctagtttccgtaggtttacggaaaggttacgttaacggtaccttaaggaacctaaaacttaccgaaaacggttaaacgaaccaaacggtaaccgttaacggaaaaccggtaaacccttaggtttcccctaccccgtaggaacctacggtactaacccgtccgttccgtaacggttaccggttacccgttaccccggaaagggttaaccggtaacggggttagtttaacttacgtttaacggtaggtaacgggaaacgccgggttacccctaagttaacggaaccg

SEQ ID NO: 429794 - DNA, 544 bp, Homo sapiens
  misc_feature: GZ8MTXP01A882Q.19.71.G05.1.454.CMB.2.raw
  modified_base (240)..(240): a, c, t, g, unknown or other
  modified_base (312)..(312): a, c, t, g, unknown or other
  modified_base (322)..(322): a, c, t, g, unknown or other
  modified_base (413)..(413): a, c, t, g, unknown or other
  modified_base (418)..(418): a, c, t, g, unknown or other
  modified_base (420)..(420): a, c, t, g, unknown or other
  modified_base (429)..(429): a, c, t, g, unknown or other
  modified_base (435)..(435): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgcaagtccagccaacaattcttttanacagttccaaacaatagaaaactactagcttggtaaccagcaagagaccaggacagcctctaggcttagctntactttacgngggcattcgtaacccggggaactccccccgggggtcctgaaccgtattcgaagtcgcagcgggtctgggacagtatttccactctcactancagcncnctgacgagntagagngtgtgtacttagtttatattcgtaataataattattattacgtcttcggtgttacggtacgacgaacggtacgaggttgataatacgaagtacgagttcggtcgcgtcg

SEQ ID NO: 429795 - DNA, 620 bp, Homo sapiens
  misc_feature: GZ8MTXP01DXEE8.19.71.G05.1.454.CMB.2.raw
  modified_base (238)..(238): a, c, t, g, unknown or other
  modified_base (285)..(285): a, c, t, g, unknown or other
  modified_base (298)..(298): a, c, t, g, unknown or other
tcagtactctcgtgcacgaccggtgctcgatttagtgtcgtcgcaagagagaggggggagtacaacaggcaggcaggggcagcaagatggtgttgcagacccaggtcttcatttctctgttgctctggatctctggtgcccgacggggacatcgtgatgacccagtctccagacctcctggctgtgtctcgtgggcgagccggccacatacgaactgacaagtcagcatatctttaanactactacaatatataaactctgctagacagacagacacgagacacncctacgagctacnctactagttacgcgactacgtaccggtaaccggacgtccggtccctacggacgtatcgagcgacgtcgggtcgtacgtacggactacgtacttacgactctacacctagtacacgtacgaccgtcgtacgacgtaggtacgtagtaacgtgttacgggtagttaacgtttagttattacgtataaactaaagtttaacttattaacttacgttaccggttacgtaacggtaccgttaccggaaacgttaaacgggtacgttaaggttacgttaacttacgtaacgaaagtaacccgtaggtcgttacgtaaccgcgtaaccg

SEQ ID NO: 429796 - DNA, 656 bp, Homo sapiens
  misc_feature: GZ8MTXP01AEOKV.19.71.G05.1.454.CMB.2.raw
  modified_base (235)..(235): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggactggtgaacgccctcgcacgaccctctcgctcactgtcnccagtccgtccggggacaggacgtcgctagcgactagtgttcgcgttggctacgtcggggtacaggcctacgtccccagtcggagaggtctaggaggtggcgtaggggaacgtactagttactttcagtacgtaccaacgtacggtacgtaaataacgtaaattagcgacaacctattcgtagttacgagtacgtacgaactagaactaagacgtaaacggtacgaaccaacgaacgtaacgaaaacgtaaacctacggttaccctcctaggacctacgtccgtacgtaaccctcgttaacggtaaccgacccgttaccccgggaagggtaaccgttaaccgggggttattaacgttaacgtttccggtagggttaacgggaaaccggacccgggttacccctaaagttaaccggaaaccg

SEQ ID NO: 429797 - DNA, 718 bp, Homo sapiens
  misc_feature: GZ8MTXP01ESD5I.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccctcgcagacccctctcgctcacctgtcgccatcgtccggggacagagtcgctagcgacagtgttgcgttggcacgtgggtcaggcacgtccccagtcggagacggtctaggagtgggcgtaggggaaacggtactattactttcagttcgtacccaacgtacggtagggaaacttaactaaaatttcgtacgacctaaccctagttaccgttaggttagtaaggtacgttaccgaacttaggaaactaaactaaccgtaaacggttaagaaccgtaaacgtaacgtaaccggaaacgtaaacccgttacggtttaccccttaccccgttacggaccgtacgtaccgttaccgtaacccgtttccggtaacgttacccggaaacccggttaccccgggaaacgggtaacccgggtaaccggggtttagttaacgttaaccggtttaacggtacggggttaaacggaaaccgggacccggttaaccccccgtaaggttaaccggtaacccg

SEQ ID NO: 429798 - DNA, 580 bp, Homo sapiens
  misc_feature: GZ8MTXP01BHVSQ.19.71.G05.1.454.CMB.2.raw
  modified_base (316)..(316): a, c, t, g, unknown or other
  modified_base (375)..(375): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcacgaccctctcgctcacctgtgccatctccggggacagagtcgctagcgacagtgttgcttggcacgtggtcagggcacgtccccagtcgagaggtctagngtggctggggaagacattactttcaattcgtccaaacgacggtagaaataacaaattanagacactatctgtgagagtcgactgactaatacaacgtagacaactaagtacgaaacgtaacctacgttcctacccgtacgcctacgtacctacgtaccctcgtcggttacgtaccgttcccggaacggtaacgttacggggttacgttaagttaacgttacgtaacgggtacgggaacgaccgggtaacccccttaagtaacgg

SEQ ID NO: 429799 - DNA, 639 bp, Homo sapiens
  misc_feature: GZ8MTXP01CCUOD.19.71.G05.1.454.CMB.2.raw
  modified_base (242)..(242): a, c, t, g, unknown or other
  modified_base (321)..(321): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccacatcaactgacaagtccagccaactaattctttanactagttaccaaacaatagaaaactctagcttaggaccagacagagaccaggacagcctctaggctgctctatttacgngggctacgtccgtaacccggggatcccgggggtccccccaggaccgtattcgaggtcgggacgtgggcgggttcgtcggggaactaggtactttcgacctcctacacctatccagctacgccgttagcgtagggctagaagacttggggtacggtacgttaatttagttagttcgtaaacctaaattaaattatttaatttaacgtaccgtttcgggtaagggttaccgttcgggaaacccgaaaggggtaaaccgtagggttacggttattacgtaagaaacgtaacgtaacgtgttggtaaccttaacggtaaccc

SEQ ID NO: 429800 - DNA, 726 bp, Homo sapiens
  misc_feature: GZ8MTXP01B9QIC.19.71.G05.1.454.CMB.2.raw
  modified_base (239)..(239): a, c, t, g, unknown or other
  modified_base (666)..(666): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcnccagtccgtaccggggacaggagtcgctagcgacagtgttgcgttggcgtacgtgggtcgaggccgacgtccccagtccggaggtacggtcgtaggaggtgggacgtagggggaaacggtactaagttacttacgaacgttacgtaaccgaaacgtaaccggtaggtaaacttaacgaaaatttagacgtaccgtaaccctaattccgtaggttacgaacggtaccggttacgaacgtacgaaaccttaaacgttaccaaaacggttacgaaaccgacgtaaaggttaacccggaaaacgttaacccgtaacgggttttcccctaaccccgttgaacccgttaacggtcccgtttacgaaccccgttccggttagggttacccgtaaaccccgttccccgggaaaggggtccttaacggggggtttnttaacgttaaggtttacgtaacgggacgggtaacgacccgggtaaccccaaggttaaccg

SEQ ID NO: 429801 - DNA, 700 bp, Homo sapiens
  misc_feature: GZ8MTXP01A5BOD.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtccgtcgggacagagcgctagcgactagtgtgtcttggcacgtggtcacggccacgtccccagtcggagtcggtacgtaggaggtcgggtacgtaggggaacggtactattacgtttacgaagttaccgtaaccctaaacgtaaccgggttaagggaaactttaaacctaaaatttacgtacgaccctaaaccctagtttacgttagggtttacgaaagggtaaccggttaccgtaaacgttacgaaacctaaacgttaaccgaaacgttacgaactaacgtaaacgtaaccgaaactttaaccctacgtttccctaccgtaggacctacggtacctaccgtaccctcggtacgttaccgtaacccggccggtaagggaacccggttagggttacttaacgttaagttaacccggtgggaaacgggaccggttacccggaaccccttaagtaacccg

SEQ ID NO: 429802 - DNA, 703 bp, Homo sapiens
  misc_feature: GZ8MTXP01CW0OT.19.71.G05.1.454.CMB.2.raw
  modified_base (247)..(247): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgaggggacatcgtgatcgacccagtctccagacctcctggctgtgtctcgtgggcaggccggccacgatacaacgtgacaacgtccagaccaataattctttaanactactacaataataactaaactctagctacgacagacacgacacgagacacgcctacgagctatctactacgtttacgcggactacgtaccggtaacccgggtacgtccccgggtacccctacggactacgttacggaggtacgggcgtcgggtcgggttcgtacggggaactagttcttacaccttccaccaccgtactacgacgacgtacgccgtagacgacggtacgtaaggaacgttgttaggggtacgttaacgtttaagttttaacttaacgttactaaactaaagtttaaatttaagtttaacgtttaacgtttaccgttacgggttaacgggttaaccggttaaaccgggtaaaccggaaacgggtaaacggtaaagggttacgttaacttaacgtaacgaaacgggtaacgttaacgggtcggttacggtccgttaaccggtaacc

SEQ ID NO: 429803 - DNA, 584 bp, Homo sapiens
  misc_feature: GZ8MTXP01DDJOM.19.71.G05.1.454.CMB.2.raw
  modified_base (385)..(385): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctcggcctccacaaggtgtcctgtcacaagtacagctgcagcagtcaggtccaggctggtcgaacgcctcgcagaccctctcgctcacctgtcgccagtccgtccggggacagagtcgcgtagcgacagttgtgcttggcacgtggtcaggccacgtccccagtcgaagtcggtctagagtggcgtagggaagtactagtattcaatcgtaaccaaacgtacggtaggaaattaacaaagttancgactaactagtcgtagtacgagacgtacactacgaacaactacgaaacgtacgaacacgtaagtaacgaaacgtacctacgttcctccgtagctaacgtctacgtactcgttacgaccgtaccgttaccggaaggtaccgttagggttcttaagttaagtacgtggtaacggacgttaccgaaccccttaagtaaccg

SEQ ID NO: 429804 - DNA, 225 bp, Homo sapiens
  misc_feature: GZ8MTXP01BI7UO.19.71.G05.1.454.CMB.2.raw
  modified_base (219)..(225): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggctgggcaaggcgcatagnnnnnnn

SEQ ID NO: 429805 - DNA, 680 bp, Homo sapiens
  misc_feature: GZ8MTXP01CVDMS.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctccacaaggtgtcctgtcacaagtacagctgcagcagtcaggtccaggactggtgaagccctcgcagaccctctcgctcacctgtgccatcctccggggacagagtcgctagcgacagtgtgcttggcacgtgggtcaggctacgtccccatcgagtaggtctaggagtgggctaggggaaaggactattaatttcgattcgtaccaaacacggtaggtaaactactaaaattatgaccaaaccaatcgtgttagacgtagtcgactagaacaatacgaaacgtagaacacgtaagtaacgaaacgtaaacctacgttacctacccgtacgacctacgtacgttacgtacccttacgtacggttaccgtaacccgttaccccggacgggtaaaccgtaccgggggttacttaagttaacgtttaacccggttaacggggttaagggttaaacgggacccgggttaccccccgtaaagttaacggaaccgttaacgttcccgtaacccgacccgtttccgtccgttcgttacgggttcgttaacgttttaacggg

SEQ ID NO: 429806 - DNA, 518 bp, Homo sapiens
  misc_feature: GZ8MTXP01CMUXH.19.71.G05.1.454.CMB.2.raw
  modified_base (243)..(243): a, c, t, g, unknown or other
  modified_base (256)..(256): a, c, t, g, unknown or other
  modified_base (289)..(289): a, c, t, g, unknown or other
  modified_base (375)..(375): a, c, t, g, unknown or other
  modified_base (409)..(409): a, c, t, g, unknown or other
  modified_base (417)..(417): a, c, t, g, unknown or other
  modified_base (419)..(419): a, c, t, g, unknown or other
  modified_base (422)..(422): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (494)..(494): a, c, t, g, unknown or other
  modified_base (499)..(499): a, c, t, g, unknown or other
  modified_base (511)..(511): a, c, t, g, unknown or other
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaaactgacaagtccagccaacaattctttaanacagttaccaaanaatagaaaactactagctaggtaccagacaganaccagacagcctcagctagctcatttacgtggcactaccgtaaccggggaatccggggtcccccctgaccgattcgaagtgggacnggcgggtctagggacagtactttcactcacacancagcagcngnagnagagagtggtgtatattatatntanaanaatattatatactgtgtacgttcgacgaacgaacgaagttaganataanagaacgagtagngtcgcgc

SEQ ID NO: 429807 - DNA, 600 bp, Homo sapiens
  misc_feature: GZ8MTXP01ESWZZ.19.71.G05.1.454.CMB.2.raw
  modified_base (245)..(245): a, c, t, g, unknown or other
  modified_base (330)..(330): a, c, t, g, unknown or other
  modified_base (571)..(571): a, c, t, g, unknown or other
  modified_base (585)..(585): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgagcggccaccatcaactgacaagtccagccaactaattctttaanactacttaccaaacaatagtaaaactacttagcttaggaccagcagacgaccaggacacgccctctaggctgctactatttacgnggactacgtacccgtaacccggggaacgttccccggggtacccctacggaccgtagttcgaggtcgggccgaaggggtcgggtacgtggggaactagttacttcacttcctacacctatcagctacgcctagcgaggctaggaaagtcgttggggtgttacgttaagtttattagtagtactaaataattacttattactacgttgtaacggtacgttcggacgaaggacgtaggttaganagtcaaggtcgtanggttctcgttcgaac

SEQ ID NO: 429808 - DNA, 771 bp, Homo sapiens
  misc_feature: GZ8MTXP01CBW66.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtccgtccgggacagacgtcgctagcgacagtgttgcgttggctacgtgggtcaggcctacgtcccccgagtcggaggtaggttaccgtaaggaggtcgggacgttagggggaaacggtactagtttaacgtttcaaagttacgtaacccaaaacgtaccggttagggaaaacttaactaaaagtttacgtacggtacctaaccgtaactttcgttaggttacggacggtaacgttaccgaacgtttacggaaactaaactaaaccggtaaacgttaaacgaaacctaactaacgttaacccggaaaacgtaacccgttaaacggttttccccacccgtttaggaaccctacggtaccgttaccggtaaaccccgtttcgttaccggttaaccggtaaccccggttaccccgggtaaaggggaacccggttaaccgggggtttagttaaaccgtttaacgggtttaaccgtggggttaaaccgggaaaccgggttaccccggggtaacccccttaaggttaaaccccgg

SEQ ID NO: 429809 - DNA, 610 bp, Homo sapiens
  misc_feature: GZ8MTXP01BKWAP.19.71.G05.1.454.CMB.2.raw
  modified_base (248)..(248): a, c, t, g, unknown or other
  modified_base (388)..(388): a, c, t, g, unknown or other
tcagtactctcgtgcacgaccggtgctcgatttagtgtcgtcgcaagagagaggggggaggtacaacaggcaggaaggggcagcaagatggtgttgcagacccaggtcttcatttctctgttgctctggatctctggtgcccgacggggacatcgtgatgacccagtctccagactccctggctgtgtctcgtgggcgagccgggccaccgatacgaactgacaagtccagccataacttcttttaanactacgttaccaaacaatagaaaacttactagctaggaccagcaagacgaccaggacacgcctcgtagctgctctattacgtgggactagtccgacccgggtagtccccggggtccacgaccgtatcgaggtcgaaccgngggtcgggtgtaggactacgttacttcactcctaccaccgatcgacgacgacgtaccgcgacgacgacgtagtagtagtaggtagggtagttagtttattagttactactaataattaattattacttacgttcggtcggtaacggtacgttacggtaacggaacggtacggtagttagttacgacgtaagtacgtaacgtgtcgttacgtcgaacgtaacg

SEQ ID NO: 429810 - DNA, 528 bp, Homo sapiens
  misc_feature: GZ8MTXP01DNKMS.19.71.G05.1.454.CMB.2.raw
  modified_base (249)..(249): a, c, t, g, unknown or other
  modified_base (312)..(312): a, c, t, g, unknown or other
  modified_base (364)..(364): a, c, t, g, unknown or other
  modified_base (418)..(418): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtgccatctccgggganagagtcgctagcgacagtgttgcttggcacgtgggtcaggcagtccccatcgagaggtctagngtggctgggaacgcatatttcatcgtaccaacgacgtaggaaatacaaattngacacctatctgttgagagtcgactgaacaatacaagtagacacaatacgaaanaacctagttcctcctgacagtctcgacctctgtcgacgtcccgaggacgtacgggttagttacgttattaacgtgtaacgggaacgtaccggacccctaagttaacgaac

SEQ ID NO: 429811 - DNA, 653 bp, Homo sapiens
  misc_feature: GZ8MTXP01A3UXZ.19.71.G05.1.454.CMB.2.raw
  modified_base (245)..(245): a, c, t, g, unknown or other
  modified_base (259)..(259): a, c, t, g, unknown or other
  modified_base (321)..(321): a, c, t, g, unknown or other
  modified_base (428)..(428): a, c, t, g, unknown or other
  modified_base (447)..(447): a, c, t, g, unknown or other
  modified_base (457)..(457): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgccccgacggggacatcgtgatcgacccagtcctccagacctcccctggctgtgtctcgtgggcgagccgggccacatcaactgacaagtccacgccataattctttanacacgttaccaaanaatagaaaactactagctggacagcagagacaggacagcctacgaggctgctctatttacgngggactacgtaccgtaccccgggagtcccggggtcctacggaccgtatccgagtcggacacgggtcggtcgtaggggactacggtactttccacttcaaccactacncaacggccacggtacccgngacgacgtanaggatgtcggtacggtaactttaagtttaattacgttaacgtaaacctaaagttaatttaactttacgttacgttaccggttacgggtacgggttaaccggttaccgggaaaccggtaaacgggttacgtaagggtacgttaacgttacgacgtaacgtaacgtaacggtggtaccgttcctaacgaaccgtaacg

SEQ ID NO: 429812 - DNA, 620 bp, Homo sapiens
  misc_feature: GZ8MTXP01AQ0S4.19.71.G05.1.454.CMB.2.raw
  modified_base (366)..(366): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctccgctcacctgtcgccagtccgtaccgggggacagacgtcgctagcgactagtgtgcttggcacgtgggtcaggcacgtccccagtcggagtagtcgtaggaggtgggcgtagggaacggactatatttcagtgaccaacgacgtaggaaactaacaaattangaccaactattctagttagagtacgtcgatacgaacaatacgaacgtagaacacgtaagtaacggaaactaacccgttagttaccccacccgtagaccgtacgcctacgtacctcgtacgtcggaacccgtaccgagggaaacgtcggggttataattacggttacgtaagggtacgaacggacccggttcccaagtaccgaacttcgttaccgccctaccgtcttaccgtgttacggtcgttaacgttaacgg

SEQ ID NO: 429813 - DNA, 585 bp, Homo sapiens
  misc_feature: GZ8MTXP01CGQ1T.19.71.G05.1.454.CMB.2.raw
  modified_base (203)..(203): a, c, t, g, unknown or other
  modified_base (224)..(224): a, c, t, g, unknown or other
  modified_base (319)..(319): a, c, t, g, unknown or other
  modified_base (468)..(468): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtnaacgccctcgcacgacccctntcgctcacctgtcgccagtcgtccggggacagagtcgctagcgacagtgttgctggcacgtggtcaggcacgtccccagtcgagacggtctaggngtggctggggaacgactagtatttcatacgtaccaagacgtagaaactagaaattcgacgacacctattacgttgttaggagagttccgattacgaacattacgaaacgtagacaagtaacgtacgaaacgtaaccgtacgtttacccnccgtagtcacgtcctacgtccttggtcgtccgaccggtacccgagggtaaaccgtggttaagttacttacggttaacgtggtaacgggaacgtacccggttaccctaagaacgtaac

SEQ ID NO: 429814 - DNA, 653 bp, Homo sapiens
  misc_feature: GZ8MTXP01DD5KQ.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggctgtgaacgccctgcacgaccctctcgctcacctgtcgccatccgtccggggacagagcgctagcgacagtgttgcttggcacgtggtcaggcacgtccccagtcggagtaggtctaggacgtggcgtagggaaaggtactattatttccaaagttcggtaacccaaacgtaacgggttaagtaaactaaactaaattatacgactacctattcgtggttagaagtacgtacgtaactagaacaaactaacgaaacgtaacgaaccgttaagtaacgtaaccgaaacgtaacccttaccgttaccctaccgtacgtaccgtaacgtacgtaccgtacccttcgtcgttaccgtacccgttacccggtaacggtaaccggttacgggtttacgttaacgttaacgttacgttaacgggtaaccgggtaacgacccggtaacccgttaacgtaacgg

SEQ ID NO: 429815 - DNA, 562 bp, Homo sapiens
  misc_feature: GZ8MTXP01CFEPB.19.71.G05.1.454.CMB.2.raw
  modified_base (222)..(222): a, c, t, g, unknown or other
  modified_base (460)..(460): a, c, t, g, unknown or other
  modified_base (497)..(497): a, c, t, g, unknown or other
  modified_base (520)..(520): a, c, t, g, unknown or other
  modified_base (535)..(535): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctntcgctcacctgtcgccatcgtccggggacagagtcgctagcgacagtgttgcttggcacgtgggtcaggcacgtccccagtcgagaggtctagagtggactgggaaggacattatttcaattcgtaaccaaacgtaacgtggaaaactaacaaagttatcgacaacctaatcgtgttagagagttcgactgaacaatacaaagtagaacgtacaagtacgaaacgtaacctacgttcncccttagcaggtctacgaccctcgtgttacggtaccncccggaaggacgttacggggttnttacgttaattacgngtaggacgacggtaaccccaagtaacg

SEQ ID NO: 429816 - DNA, 695 bp, Homo sapiens
  misc_feature: GZ8MTXP01BRWUU.19.71.G05.1.454.CMB.2.raw
  modified_base (646)..(646): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgccacgaccctctcgctcacctgtcgccagtccgtccggggacaggacgtcgcgtacgcgacgtaggttcggttcgtcgtttggctacggttgggtaccacgggccaaccggtccccctagttacggagtacggtctaggaggtggcgtagggaaggtactagttatttcaagttcgtaacctaaacgtaccggtaaggtaaactaactaaatttacgtacgacctaaccgtaatttcgtaggtttacgaggtaacggtccgtaacgttaagaacctaaagtacctaaaacggttacgaactaacgtaaacgtaaccggaaaacggtaacccttaacggttccccttacccgttagaccgtaacgtccgtccgtaacccttcggttacgaccggtaccccgttacccgggaaagggtaccttaacgggggttnttaacttaagtaccggtggtaacgacgttaccggtcccttaagtaaccg

SEQ ID NO: 429817 - DNA, 558 bp, Homo sapiens
  misc_feature: GZ8MTXP01BVTPM.19.71.G05.1.454.CMB.2.raw
  modified_base (240)..(240): a, c, t, g, unknown or other
  modified_base (252)..(252): a, c, t, g, unknown or other
  modified_base (282)..(282): a, c, t, g, unknown or other
  modified_base (313)..(313): a, c, t, g, unknown or other
  modified_base (346)..(346): a, c, t, g, unknown or other
  modified_base (378)..(378): a, c, t, g, unknown or other
  modified_base (530)..(530): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagactccctggctgtgtctcgtgggcgagcgggccaccatcaactgcaagtccagccacaattctttanacattaccaaanatagaaaactctagcttggtaccagcaganaccaggcagcctcgaggctgctcatttacgngggcagtccgtaaccgggatcccggggtccccngtaccgattccgaggtacgcgaaggcgggtcngggacagtatttcactctcaccatcagcacgctgcaggctagaagtgtcggggtggtacttagtttattagtcgtacaaataattatttattattacgtcggtaagaccgttcgggacttaaagggaccgtaaggttcggttattacgtaanaggaacgtaacgtgttacggtcttgccc

SEQ ID NO: 429818 - DNA, 664 bp, Homo sapiens
  misc_feature: GZ8MTXP01DC5LI.19.71.G05.1.454.CMB.2.raw
  modified_base (247)..(247): a, c, t, g, unknown or other
  modified_base (261)..(261): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgccccgacggggacatcgtgatcgacccagtcctccagacctccccgtggctgtgtctcgtgggcgacggccggccaccatcaactgacagtccagccataattctttanactacgtaccaaanaatacgaaaacttacgtagtctacggaaccagacaagacgaccgaggacacgccctcgtagctcgtactactagtttacgcgggactacgtaccggtaacccgggacggtcccggggtaccctcggaccgtatcgagtcggacacgggtcggtcgtacgggacgtacgtacttccacttcctaccactagtcgagaccacgtcctagacgacggactaaggaatgtggtacgggttaatttaagttttaattacgttataaactaaattaagtttaatttaacgtttaacttacggttcggttaacgggttaaccggtaccggaacccggaaagggttacgtaaggtaggttaacttgaaacgtaaggtaaccgtaagtttcggacggttctaacgcctaacg

SEQ ID NO: 429819 - DNA, 512 bp, Homo sapiens
  misc_feature: GZ8MTXP01EA1K3.19.71.G05.1.454.CMB.2.raw
  modified_base (240)..(240): a, c, t, g, unknown or other
  modified_base (253)..(253): a, c, t, g, unknown or other
  modified_base (310)..(310): a, c, t, g, unknown or other
  modified_base (368)..(368): a, c, t, g, unknown or other
  modified_base (403)..(403): a, c, t, g, unknown or other
  modified_base (405)..(405): a, c, t, g, unknown or other
  modified_base (409)..(409): a, c, t, g, unknown or other
  modified_base (412)..(412): a, c, t, g, unknown or other
  modified_base (414)..(414): a, c, t, g, unknown or other
  modified_base (435)..(435): a, c, t, g, unknown or other
  modified_base (448)..(448): a, c, t, g, unknown or other
  modified_base (492)..(492): a, c, t, g, unknown or other
  modified_base (494)..(494): a, c, t, g, unknown or other
  modified_base (497)..(497): a, c, t, g, unknown or other
  modified_base (499)..(499): a, c, t, g, unknown or other
  modified_base (504)..(504): a, c, t, g, unknown or other
  modified_base (506)..(506): a, c, t, g, unknown or other
  modified_base (510)..(510): a, c, t, g, unknown or other
  modified_base (512)..(512): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctctgggcgagcggccaccatcaactgcaagtccagccacaattcttttaanacagttaccaaanaatagaaaactacttagcttaggaaccagacagagaccagacagcctctaggctagntcgtatttactggacatccgaccggaatcccggggtccccctgacgattcgagtggcnggcgggtctagggacagtatttcacttcacaccananaganacncncgcgagagagagagtggtgtntattattatatanaataatattattatatgtgtacgttagtacgacgacgaagagananaananaagangngtgngn

SEQ ID NO: 429820 - DNA, 640 bp, Homo sapiens
  misc_feature: GZ8MTXP01BF0VR.19.71.G05.1.454.CMB.2.raw
  modified_base (352)..(352): a, c, t, g, unknown or other
  modified_base (529)..(529): a, c, t, g, unknown or other
tcagtactctcgtggcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtgccatcgtccggggacagagtcgctagcgacagtgttgcttggcacgtgggtcaggcacgtccccatcgagaggtctagagtggcgtgggaagactatatttcatcgtaccaaacgacgtaggaaactactaaaattntgaccaaaccctattcgtagtttagaacgtagtaccgacttaggaaacaaagttacgaaacgtagaaccaacgtaagtaaccggaaacgtaacctacggtttccctacccttgacgtacggccttacggtacccttgtacgtacgtacccgtacccggaggtaaccgtacggggttntaaattacgttacgtaagggtacggaaacggtcccggaccccaaagttaacgacgttacttcggaacccctacgttccgttcgtcgttacggttcgttaacgtttaacggg

SEQ ID NO: 429821 - DNA, 662 bp, Homo sapiens
  misc_feature: GZ8MTXP01CL0L4.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctccacctgtcgccagtccgtccggggacagacgtcgctagcgacagtgttgcttggcacgtggtcaggcacgtccccagtcgagaggtctagagtggcgtacgggaaggactattacgtttcaaacgttcgtaaccaaacgtacggttaagggtaaaattaacctaaaagtttactacggaccctaacctacgttactggtttaacggaaggtaacggttaccgtaactacggtaacctaaactacgtaaacgttaacgaacctaacgtaaacgtaccgtaaacgaacccgtaacgttcctaccccgttggacctagtacctcggtacccttcgtcgttacggtaacccgttcccggaaacggtcgttaccgggttagttacttaacgttacgtaacggtacggtaacggaccggaaccccttaaggtaaccg

SEQ ID NO: 429822 - DNA, 682 bp, Homo sapiens
  misc_feature: GZ8MTXP01AHF3R.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccagtccgtccggggacagacgtcgcgtacgcgacgtaggttgttcggtcgtttggcctacggtggggtccacggcctaccgtccccagtcggaggtaggtctaggaggtcggcggtaggggaaaggtactattactttcaagttcgaacccaaagtacggtaaggtaaactaactaaaagttactacgaccaaccttagttcgttagggttacggaaggtacgtacgtaactagaacctaaacgtacgtaaacgtaacgaccaacgtaagttaaccgaaacgtaacccgttacgtttaccctcccgttaggaccctagggtacccttacgcccttcgtacgttaccgtacccgttaccccggaagggtacccgttaggggttccttaagttaaccgttagtcggtaacgggaccggttaccggtaaccccttaagtaaccg

SEQ ID NO: 429823 - DNA, 668 bp, Homo sapiens
  misc_feature: GZ8MTXP01CIZX4.19.71.G05.1.454.CMB.2.raw
  modified_base (243)..(243): a, c, t, g, unknown or other
  modified_base (445)..(445): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgaggggacatcgtgatcgacccagtctccagacctcctggctgtgtctcgtgggcgagccgggccacgatcaactgacaagtccagaccataattctttanactacgttaccaaagtaataacgaaaacttactagaccttaggaaccagaccaggacgtaccaaggtaccacgtccctccgtagcctagcttactagtttacgcggactacgtacccggtaccgggtactcccggggtcccctagaccgtatcgaggtcgcgtggcgggtctaggggactagtacttccactctacacctanacgagcgacgtctgacgacgacgtagtaagtcggttaggggtacggttacgtttaagtttagtttacttaacgtaaacttaaatttaaatttatttaactttacgttacgttcggttaacgggttacggttaccgggaaacggttaaaccggtaaacggtaagggttagttaacttacgtaacgtaacgtaacggtagtcggttacgtccgttaacgtaaccg

SEQ ID NO: 429824 - DNA, 727 bp, Homo sapiens
  misc_feature: GZ8MTXP01AQBP8.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcgggccctcccacaaggtgtcctgtcacaagtacagctgcagcagtcaggtccaggactgggtgaacgccctcgcacgaccctctcgctcacctgtcgcccagtccgtaccggggacaggacgtcgcgtagccgaacgtagttgttgcttggctacgtggtcaggccacgtccccagtccggagacggtactaggaggtggacgtaggggaacgactaattactttcgaaattcgtaacccaaacgtacgggtaagaaacttaacgtaaaattcgtacgacctaacctattaccgttaggtttagaggtaacggttaccgaacgtaggaacctaaagtaccgaaaacggttacgaaacctaacgtaaacgttaaccggaaaaccggtaaacccttaacggttttccccacccgttacgggacctaacggttaccctccggtaaccccttcgttcggttaaccggaccccgttacccgggaaacgggtaacccggttaacgggggttcttaaagttaacgtttaccgggtaagggttaaacggggaacccggttacccggtaacccccgttaagttaaacccgg

SEQ ID NO: 429825 - DNA, 811 bp, Homo sapiens
  misc_feature: GZ8MTXP01A6F02.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcgggccctccacaaggtgtcctgtcacaagtacagctgcagcagtcaggtccaggactggtacgaacgccctcgacacgaccctctcgctcacctgtcgccagtcgtcgggacagagtcgcgtagcgacgtgtgttcgcgttggccgtacggttcgggtacgacggcctaccggtcccccgtagtaccgggaaggtacgggttaccgtaagggtacgggtggggaccggttacgggggaaacggtaacgttaagtttaacgtttcccggtaaacgttaacccgaaacggttaaccgggttaaagggtaaaactttaaaccgtaaaaagttttcgtaacggtaaccctaaacccgttagtttaccggtttagggttaagggtaaccgggttaacgttaccgggtaaaccgtttaacggaaaaccttaaacgttaaccggtaaaacggttaacgtaaacccaagttaaacccggtaaacgggtaaacccgtaaacccgtttaacggttcccctaccccgtaggtaacctacgttccgtacgtacccgttcggtaacgtccggaaccgggttaccccggaagggtaaccgtaacgggggtttattacgttaaccggttaagggtacggtaacgggaaccggtaccccggacccctaagttaacgtaaccg

SEQ ID NO: 429826 - DNA, 686 bp, Homo sapiens
  misc_feature: GZ8MTXP01AIYEK.19.71.G05.1.454.CMB.2.raw
  modified_base (203)..(203): a, c, t, g, unknown or other
  modified_base (221)..(221): a, c, t, g, unknown or other
  modified_base (244)..(244): a, c, t, g, unknown or other
  modified_base (290)..(290): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctccctggctgtgtctcgtgggacgnggccggcacagtcaactnacagtcagccacaattctttaanactatacaatatataaactctagctacgacagacagacgacagacncgcctacgagctcactcttacttcgcggctacgtaccggtaaccgggtacgtcccgggtacccctacggtacgtagtcgaggtcgaccggtgggtcgggtacgacggtacgtacgtacttactactacctacctactactacgacgacgacgtaccgtacgacgacggtacgtaacggtacgtagtacggggtacggttacgttagtttaacgtttaacgttacgttaacgtaaacttaaactttaaatttaacgtttaacgttacggttacggttaacggttaaccggttaccgggtaaccgggttaaacgggtaaacggtaacggttacgttaacgttaacgtaacgtaacggtaacggtaacggtacggttacggtaaccgttaacgtaaccg

SEQ ID NO: 429827 - DNA, 745 bp, Homo sapiens
  misc_feature: GZ8MTXP01A20GF.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctgcacgaccctctcgctcacctgtcgccatcgtaccgggacagagtcgctagcgactagtgttgcgtggcacgtgggacaggctacgtcccagtcggagtaggtcgaggagtcgggcgtaggggaaagtactattacgtttcacgttacgtaccaacgtacggtaagtaaactaactaaaagttactacgtacctaaactattccgttagttacgggaagtacgggttacgaactagggtaaaacctaacgttaacgaaaccggttaaacgaaccgtaaacctaacggtaaaccggtaaaacggtaaaccccttaacgggtttacccctacccgtacgtaaccgtaacgtaccggggttaacctaaccccggttcgtaccgggtaaccgtacccggtaccccgggaaggtaaaccggtaccgggttaagttaacgttaacgttaacggtaaggttaacggggaaaccggtacccggttaccccgaaagtacgttaccgaacgttccgaacccgttaccggtcgttacctcggttacggtcggttaacgttaaccggg

SEQ ID NO: 429828 - DNA, 640 bp, Homo sapiens
  misc_feature: GZ8MTXP01ED1M6.19.71.G05.1.454.CMB.2.raw
  modified_base (578)..(578): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttctcttcttcctgccgtgctgggcctccacaaggtgtcctgtcacaagtacagctgcagcagtcaggtccaggactggtgaacgccctcgcacgaccctctcgctcactgtcgccatcgtcgggacagagtcgctagcgactagtgtgcgttgcgtacgtcggtcgacggcacgtccccagtcgagtaggtctagagtcggcgtaggggaagactattactttcaagtcgtccgaaacgtacggtaggaaaacttaacgtaaatttatacgaccctaactatcgtaggttagaagttacgtacgattagaactaaacttacgaaacgttacgaactaacgtaagtaaccgtaaacgtaaaccctaggttccctacccgtagtccgtacggttacctcgtaacccttcggtacgttacgtaacccgttaccgggaaggttaaccgttaccggggttnttaacgttaacgttacggtcggtaaacgggaccggttacccgtccccgttaaagtaacccgg

SEQ ID NO: 429829 - DNA, 718 bp, Homo sapiens
  misc_feature: GZ8MTXP01CI1S6.19.71.G05.1.454.CMB.2.raw
  modified_base (246)..(246): a, c, t, g, unknown or other
  modified_base (335)..(335): a, c, t, g, unknown or other
  modified_base (672)..(672): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctcccgtggctgtgtctcgtgggcgagccgggccacatcaactgacaacgtccagccactaattctttaanactagttaccaacaatagaaaactctagcttaggaccagacagacgaccgaggacacgtccctacgtaggctcgcctactagtttacgngggacctacgtaccggtaaccccggggtacgttccccggggtacccccctaggtaccgtatttcccgaggtcgggaccgaacggggtccgggttacgtacggggtaacctacggttactttcccacccttcccgtaccctaaccgacgtaccgagcccgaaccggtccgttcggaacccggaggtaccgtaaggtaaggtacgttgggggtccgggttaattaaccggtttttaatcggttaagtaaccctaaagttaactttattaatttaccgttacggttccggtaaggttaccccggttacggaccgggttaggtaaccgtaggggttacttnttacgttcgaagttaacggaacgtttggacgtcccgttgtaacccc

SEQ ID NO: 429830 - DNA, 696 bp, Homo sapiens
  misc_feature: GZ8MTXP01EWI3N.19.71.G05.1.454.CMB.2.raw
  modified_base (244)..(244): a, c, t, g, unknown or other
  modified_base (253)..(253): a, c, t, g, unknown or other
  modified_base (257)..(257): a, c, t, g, unknown or other
  modified_base (263)..(263): a, c, t, g, unknown or other
  modified_base (266)..(266): a, c, t, g, unknown or other
  modified_base (274)..(274): a, c, t, g, unknown or other
  modified_base (317)..(317): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccacgatacgactgacaagtccagccacaattctttaanacatacaanatanaaactntanctagacanacagacgacagacacgccctacgtagctgtctactatttacgnggctacgtaccggtaacccggggtacgtccccggggtaccccacggaccgtagtcgacggtcgggacgtaacgggtcggggtacgtacgggaactaggttacctttaccacctacctaccacctacgtacgacgcacgtccgtcgacgaggtacgtaaggaagtacgttagggggtacggttatttagttttaacttacgttaacgtaaacttaaacttaaagtttaatttaactttaacgttaccgtttacgggttaacggttaaccggtttacccgggaaaccggttaaacgggtaaccggtaaagggttacgttaacgttaacgttaacggaacggtaaaccgtaacggttacgggttacgtcgttaacgtaaccg

SEQ ID NO: 429831 - DNA, 804 bp, Homo sapiens
  misc_feature: GZ8MTXP01AHOGB.19.71.G05.1.454.CMB.2.raw
  modified_base (250)..(250): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgaggccggccacatcaactgacaacgtccagacccaactaattcttttaanactacgttaccaaactaatagaaaactactagcttacggtaccagcaaggacgaccgaggacacgccctacgtaggctgctactagtttacgtcgggactacgttacccggtaaccccggggtacgtcccccgggggttacccccctacgggtaaccgtagtttaccgacgggtcgggacccgtaacgggggtcccgggggttaccggtacgggggtaaacctaacgggtttaaccttttacccgtaaacccgtttcccttacccgtaaacccctaacgtacccgaaccgggacccgtaaccgggtcccgttacgggaccggtaacggggtaccgttaagggaaacggttacggttagggggttacggtaaacggttttagtttttaaacgtttacgttacgtaaactaaactttaaatttatttaacgtttacgttaccgtttcgggtaacgggttaacccggtttacgggaacccgttaaaggggtaaccgtaagggttacgttattacgtaacgaacggaacgttacgtcggttacgtcgttcggtaaccc

SEQ ID NO: 429832 - DNA, 784 bp, Homo sapiens
  misc_feature: GZ8MTXP01CGAQX.19.71.G05.1.454.CMB.2.raw
  modified_base (266)..(266): a, c, t, g, unknown or other
  modified_base (318)..(318): a, c, t, g, unknown or other
  modified_base (333)..(333): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctcccgtggctgtgtctcgtgggcgagccggccaccatcaactgacaagtccagcctaataacttcttttaacacaacgttaccaaanaatagtaaaactacttagcttaggaccagcagacgaccaggacacgcctacngctcgctctattcgnggctacgtccgaaccggggacgttcccggggtaccccctggtacctagttccgaggtcggacgtaagggtccggggtacgtggggtaactagttaactttccaaccttcccacctaaaccctacgttaccgaacggtcccgaacggtccccgttaggacccgtaaggtaccgttaacggaaacgtcggtttagggggtacggggttaaaccttttagttttttaaacgttaaggtttaaccgttaaagtaaaaccgtttaaattttaacgttttaaatttaacggtttaacccgtttacggggttaaccggggttaacccggttttaccggggaaaccccgggttaaagggggtaaacccggtaaggggtttggaaacgttaaccggtaaccgtaaaacggggttaaccttaaaccggttgggcccgggttaaccgttaacggtaaacccg

SEQ ID NO: 429833 - DNA, 627 bp, Homo sapiens
  misc_feature: GZ8MTXP01BI6W4.19.71.G05.1.454.CMB.2.raw
  modified_base (253)..(253): a, c, t, g, unknown or other
  modified_base (340)..(340): a, c, t, g, unknown or other
  modified_base (347)..(347): a, c, t, g, unknown or other
  modified_base (379)..(379): a, c, t, g, unknown or other
  modified_base (400)..(400): a, c, t, g, unknown or other
  modified_base (439)..(439): a, c, t, g, unknown or other
  modified_base (442)..(442): a, c, t, g, unknown or other
tcagtactctcgtgcacgaccggtgctcgatttagtgtcgtcgcaagagagaggggggaggtacaacaagcaggcaggggcagcaagatggtgttgcagacccaggtcttcatttctctgttgctctggatctctggtgcccgacggggacatcgtgatcgacccagtctccagacctccctggctgtgtctcgtgggcgaggccggccacgatacgaactgacaacgtccagacctaactaattcttttaanacgtacgttaccaaactaataacgtaaaactacgttagcttaggaccagacagacgaccgaaggaccacgcctacgtaggctcgctntattcgnggacagttaccgtaccgggatcccgggtcccnggtacgattccgaggtgacgngggtcggtcgtagggactagtcttcacttcacacgtacncancacgcgcgacgacgacgtagtagtagtcggggtgtagttagttagttagttagtaactaactaattaatttattacgttacgttggtaacggtacggttacggtaacggttaaacggtaacggtaaggttacggttagttacgtaacgtacgtaacgtacgtacgttacggtcgttaacgtaacg

SEQ ID NO: 429834 - DNA, 694 bp, Homo sapiens
  misc_feature: GZ8MTXP01ATNJS.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtgccatcgtccggggacagagtcgctagcgacagtgttgcgttggcacgtgggtcaggccacgtccccagtcgagaggtcgtaggaggtggcgtaggggaacggactattagtttcacgttacgtaccaacgtacggtaggaaattaacctaaaatttagtacgacctaacccgtattaccgttagggtttacgaaggtaacggttcggaaaccgttaggaaacctaaacgtaacgtaaaacggttacgaaaacctacggtaaacgttaaccgggaaaaccgtaaacccgttacgtttcccgtaccccggttagaccggtacgtaccgttaaccgtcccgttaccgttggggtaccttaaacccggtccccgggaaagggtaacccggtagggggttacttacgtttacgttaacggtagggtaaccggaacgtaccgggacccctaagttaacgaacg

SEQ ID NO: 429835 - DNA, 658 bp, Homo sapiens
  misc_feature: GZ8MTXP01C0WJP.19.71.G05.1.454.CMB.2.raw
  modified_base (353)..(353): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccttccacaaggtgtcctgtcacaagtacagctgcagcagtcaggtccaggactggtgaagccctcgcagaccctctcgctcacctgtcgccatccgtccggggacagagtcgctagcgacagtgtgcttggcacgtgggtcaggcacgtccccatcgagaggtctaggagtggcgtaggggaaagacagttatttcattcgtaccaacacgtagaaacttacaaattntagaccaaactatcttagtagaagagtacgatagaactaatacaaacgtacgaacaacgtacgaacgaaacgtaacctacggttaccctacccgtaggaccacggttactaccgtaccgttacgtacggtaccgaacccgtcccggaacggtaaccggtacgggttattaacgttaacgttaacggttgggtaaacgggaacggtaacccggacccccgtaaagttaacggaaccttacgttccccgtaacccgtacccgtttccggttccttaggttcgggttaacgttaacccgtttaagggg

SEQ ID NO: 429836 - DNA, 691 bp, Homo sapiens
  misc_feature: GZ8MTXP01BGTS1.19.71.G05.1.454.CMB.2.raw
  modified_base (236)..(236): a, c, t, g, unknown or other
  modified_base (657)..(657): a, c, t, g, unknown or other
  modified_base (675)..(675): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctcgtggcgagcggccacatcaactgacaagtccagccataattcttttanactacgttaccaaacaaatacgtaaaactacgttagtcgttacggaacccagtacaaggaacgaaccgaagggaccaacgccccttaccgtaacggccttcgaccttacttaacgtttttaccggacgggtactaaccgttaccccggttaaaccccggggtaacggttcccccgggggtacccctacggtaaccccgtagtttcgacgggttcggaaccgacgggtcggggtaccgtagggggaacctaggttaactttccgaaccttcctaccaactactcaagccagtccctgaccgagctaagaatgtagtggggactttaagtttatagttacgaactaaataatttacgttaattacgtttacgttacgggcgtaaccgggttacgaacgggaaacggacgtaaaggtcgaattnacgtaagtatcggtaagnggttcgtcttgaaccc

SEQ ID NO: 429837 - DNA, 566 bp, Homo sapiens
  misc_feature: GZ8MTXP01EMK4N.19.71.G05.1.454.CMB.2.raw
  modified_base (237)..(237): a, c, t, g, unknown or other
  modified_base (312)..(312): a, c, t, g, unknown or other
  modified_base (371)..(371): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccggccaccatcaactgcaagtccagccatatctttanacattcaacaatagaaactactagcttaggacagcagacgacagacacgcctacctaggcctgctctatttacgnggcatccgtaaccggatccgggtccctgaccgatcgagtggcaagtcgggtctgggganagtactttacactacctcacctactacgacgcgacgccgagcgagacgtagaagtagtagggtagtagttagtttattatacgtaataaataattagttattacgttcgttcggtaacgtacgttacgaaccgttaaaggtacgtaaggttagttattacgtaagacgtaacgtagtgttacgtcgttaacgaac

SEQ ID NO: 429838 - DNA, 621 bp, Homo sapiens
  misc_feature: GZ8MTXP01DJ9C9.19.71.G05.1.454.CMB.2.raw
  modified_base (334)..(334): a, c, t, g, unknown or other
  modified_base (355)..(355): a, c, t, g, unknown or other
  modified_base (389)..(389): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtcgaacgccctcgcacgacccctctcgctccaccgtgtcgccctagtccggtccggggacaggagtcgctagcgactagttgttgcgttggcacgtgggtcaggccacgtccccagtcggagtaggtctaggngtggcgtagggaacgactatnttcatacgtaccaacgagtagaaataactaaatnacgccactattctgtagagtacgtacgtacttagaactaagtacgaaagtacgaacaacgtaacgtaacggaaaccgtaacctacgtttcccctaccgtacgaacgtcgtcctacgtacccgttcgtaacgtacggacccggttacccggaggtaaccggtgggtttacttagttaacgttaaggtacggtaacgggaaccggaccgggttacccctaagttaacggaaccg

SEQ ID NO: 429839 - DNA, 600 bp, Homo sapiens
  misc_feature: GZ8MTXP01A060F.19.71.G05.1.454.CMB.2.raw
  modified_base (393)..(393): a, c, t, g, unknown or other
  modified_base (501)..(501): a, c, t, g, unknown or other
tcagtactctcgtgcacgaccggtgctcgatttagtgtcgtcgcaagagagaggggggcagagtctgctgaattctggttgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccatccgtccggggacaggacgtcgctaggcgacagtgttgcttggctacgtggggtcaggccacgtcccccagtcggaggaggttcaggaggtggacgtagggaacgactatagttcattacgaccaagtacgtaggtaaataactaattancgaccactatcttaggttagagtagtacgactagaactaatacgaaacgtacaacaacgaatacgaaacgaacctcgttcctccctagaccagtctacggtcctcggngttaccggcctaccggacggaacgtaccgggggttattacgttacgtttccgtagggttaacgggaacgaccgggttacccctaagttaacggtaaccc

SEQ ID NO: 429840 - DNA, 687 bp, Homo sapiens
  misc_feature: GZ8MTXP01DHN0R.19.71.G05.1.454.CMB.2.raw
  modified_base (242)..(242): a, c, t, g, unknown or other
  modified_base (259)..(259): a, c, t, g, unknown or other
  modified_base (333)..(333): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttctcttcttcctgcccgtgctcggcctcccacaaggtgtcctgtacaacaagtacagctgcagcagtcaggtccaggactggtcgaacgccctcgcacgaccctctccgctcacctgtcnccagtccgtccgggganagagcgactagacgactagttgtgcttggcacgtggcacggccacgtccccgagtacggagtacggtctaaggnggtcggacgtacggggaaagacttagttaacttttcgaaaacgttccgaacccgtaaacgtaacgggttaaagtaaaacttaaacgtaaaatttgacccgactaaaccgttattcggtagttagaaggtacgttaaccgaactacggaaacaacttaaacgaaccgttaagaaacggtactaaaggtaacccgaaaacgtaacccgtacgtttccctaccctacggactacgtcctaccggtccttcgtacgttccgaaaccgttaccggtaaacgggacgttaacgggttatttaacgttaacgttacgtaacgggtaacggaaacggaccccggaaccctttaaaggaaccg

SEQ ID NO: 429841 - DNA, 676 bp, Homo sapiens
  misc_feature: GZ8MTXP01BG4FU.19.71.G05.1.454.CMB.2.raw
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgcccgtgctggcctcccacaaggtgtcctgtcacaagtacagctgcagcagtcaggtccaggactggtgaacgcccctcgccagacccctctcgcctacacccgtgtcgcccagtccgtccgggggacaggagtcgcgtagcgacgagtgtgcgttggcacgtgggcacggctacgtccccagtcggagaggtctaggaggtggcggtaggggaacgtactagttacttacagttaccgtaccgaacgtacggttaggaaattaactaaattactacgacctaacctattcgttaggttgaaggtacgtacgaactagaaacctaataccgtaaacgtaacgaactaacggtaaacgtaaccggaaaccgtaacgttaccggttcccttaccgtacgaccgtaacgtccgttaaccgtacccgtttcgaacggtacgttacccggtacccgggaagggtaaccggtacgggtttagttaacgtttacgttaaccggtaggtaacgggaaccggtcccgacccctaaggttaacggtaacccg

SEQ ID NO: 429842 - DNA, 659 bp, Homo sapiens
  misc_feature: GZ8MTXP01BCVTV.19.71.G05.1.454.CMB.2.raw
  modified_base (243)..(243): a, c, t, g, unknown or other
  modified_base (256)..(256): a, c, t, g, unknown or other
  modified_base (326)..(326): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgacaagtccagccactaattctttanacagttaccaaanaatacgaaaactcttagcttaggaccagcagagaccaggacagccctctaggctagctactattttacgngggtacctacgtaccggtaacccggggacgttccccgggggtaccccctaggtaccgtagtttcccggagtacgggccgtaagggccgggttaccgaggggacctaggtactttcgactctacaccgtatcgacgcacggccgtagacgtagcgtagaagtcgttggggtacgttacgtttaagtttattacgtacgtaaactaaacttaagtttatttaacttacgttaccgttcggtaacggtaccggttacgggaaaccggttaaagggtaacgtaagggttacgttacttacgtaacggaacgtaacgtagtcggttcgtcgttaacgc

SEQ ID NO: 429843 - DNA, 537 bp, Homo sapiens
  misc_feature: GZ8MTXP01B5YI5.19.71.G05.1.454.CMB.2.raw
  modified_base (371)..(371): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcctccgggggacagagtcgctagcgacaggtgttgcttggctacgtgggtcaggccagtccccagtcgagaggtctagagtggctggggagactatattcaattgccaacgacgtggaaatacaaattanagcacatctgtagagagtacgactgacaatacaaacgtagacgacatacgaaacgaaccagtcctacctgctagtctcgacctctgttcgacttaccggaggtacgttacggttgttaacgttaattaccgtaaggttaggacgttacggaaccccgaagtaaccg

SEQ ID NO: 429844 - DNA, 689 bp, Homo sapiens
  misc_feature: GZ8MTXP01DPYNZ.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactgggtgaagccctcgcagacccctctcgctcacctgtcgccatcgtccggggacagacgtcgctagcgactagtgttgcgttggcacgtgggtcaggcacgtccccagtcgagagtctagagtggcgtagggaagactattatttcatcgtaccaagtcgtagaaactaacaaattgtagacctaaaccattcgttaggttacgagtacgttaccgaacttacgaaactaaagttacgaaaacgtacgaacctaactaacgttaaccggaaacgtaaacccttcggttaccctaaccccgtaggaaccgtaccggtaccggttaccgttaacccgttcgtaccggttaccgtaaccccgttacccgggaacggttaacccggtacgggttaagttaacttacgtttaacggtggttaacggaaacgtaccgggacccctaaagttacggaaccttcgttaccgtccccttaccgttccgttcgtacggttcggtcgttaacgtttaacggg

SEQ ID NO: 429845 - DNA, 806 bp, Homo sapiens
  misc_feature: GZ8MTXP01AZ8PX.19.71.G05.1.454.CMB.2.raw
  modified_base (347)..(347): a, c, t, g, unknown or other
tcagtactctcgtgcacgaccggtgctcgatttagtgtcgtcgcaagagagaggggggcagagtctgctgaattctgggtgaccagggcagtcaccagagctccagacaatgtctgtctccttcctcttcttcctgcccgtgctgggcctcccacaaggtgtcctgtcacaagtacagctgcagcagtcaggtccaggactggtagaacgccctcgcacgacccctctccgctcacctgcgacctacgtccggtaccggggacaggacgtcgacgtacgcgacgtaggttcgttcgtcgttggcgtacgtggggtcacggcaccgtcccagtcgagtaggtcgtagnggtggacgtaggggaacgactagttacgttcgacgttacgtaacccgaacgtaacggtaaggtaaacttaaacgtaaagtttacgacgtaacctaaccttagttaccgttagggttacggaacggtaacggttacccgaaacgttacggaaaacctaaacgtaaccggtaaaaaccggtacgtaaacccctaaacggggttaaaccggttaaaaccggtaaaaacccgtaaccccgtttaacggggtttcccccttacccggaacggtaacccgtaacggtccccgtttaaccgtaccccgttcggttaacgggtaacccgttaacccgggttaccccggaaaggggttaaacccggtaacggggttttaagttactttaaaccgggttaacgggttaaacgggtaaccggggaacccgtaccccgggttaacccctaaggttaacccgggtaaacccg

SEQ ID NO: 429846 - DNA, 805 bp, Homo sapiens
  misc_feature: GZ8MTXP01BIYIH.19.71.G05.1.454.CMB.2.raw
  modified_base (243)..(243): a, c, t, g, unknown or other
  modified_base (256)..(256): a, c, t, g, unknown or other
  modified_base (261)..(261): a, c, t, g, unknown or other
tcagtactctcgtgcacgaccggtgctcgatttagtgtcgtcgcaagagagaggggggaggtacaacaggcaggcaggggcagcaagatggtgttgcagaccccaggtcttcatttctctgttgctctggatctctggtgcccacggggacatcgtgatgacccagtctccagacctccctggctgtgtctcgtgggcgagcgggccacgatcaactgacaagtccagcccataattctttanacagttacccaanaatanaaactctagctacgacagacagacgacgagacacgtccctcgtagctgctactacgtttacgcggactacgtacccgtacccgggacgttcccggggtaccccctacggaccgtagttaccgacggtcgggaccgtcgggtccggggtacgtacggggtaactaggttaccttttacccacccgttacccgtacctaaacccgtacgtaccgaaaccggtacccgtaacggtccccgttacgggaccggtaacgggtaccgtaacggtaaacggtaacggttacgggggttacgggttaacggtttaacgttttaacgtttaacgtttaacgttaacgttaaacgttaaaacgtttaaacgttttaaacgttttaacgtttaaccggtttaaccgggtttaaccggggtttaaacccgggtttaacccggggtaaacccggggttaaaccggggtaaaccgggtaacgggttaacggttacgttaacgtaacgtaacggtaacggttaacggttacgggttacggtaaccgttaaccgtaaccg

SEQ ID NO: 429847 - DNA, 633 bp, Homo sapiens
  misc_feature: GZ8MTXP01EO5YL.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttctcttcttcctgcccgtgctgggcctccacaaggtgtcctgtcacaagtacagctgcagcagtcaggtccaggactggtgaacgccctcgcagacccctctcgctcacctgtgccatcgtccggggacagagtcgctagcgactagtgttgcttggcacgtggtcaggcacgtccccagtcggagtaggttctagagtggcgtaggggaaggtactagttatttccaaagttcgtcccaaacgaacggttggaaaactaactaaattactcgacctacgattcgtgttagagtacgttcgaactagactaaactacgaaacgttacgaaaccgactaagtacccgtaaagtaaaccctaagttcccttcccgtagcctaacgtactcggtaacctcgttacggttcgaaacccggttccgaacgggtaaccgttacggggttagttaacgtttaagttaccggtaacggttaacgggaacggttacccggtaaccccgttaagtaaccgg

SEQ ID NO: 429848 - DNA, 660 bp, Homo sapiens
  misc_feature: GZ8MTXP01ARWO8.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctccacaaggtgtcctgtcacaagtacagctgcagcagtcaggtccaggactggtgaacgccctcgcacgaccctctcgctcacctgtcgccatccgtccggggacaggacgtcgctagcgactagtgttgcttggctacgtggtcaggcacgtccccagtcgagtacggtcgtaggacggtggcgtaggggaggactattactttcgaattacggtaaccaaacgtacgtaaggtaaacttaactaaattactacgacctaacctaagttcgttaggttagagtacgtcgaacgtcgaaactaattaaccgaacgtagaacaactaacgtacgaaacgtaacctacgtttccctacccgttaggacctcgtacccgttacgaccccgttcgtcgggttaccgtaacccggttacccgggaaacggtaacccgggttcggggtttaatttacgggttaacttaccggtaagggttaacgggaaccggttacccgaaccccgttaagtaaccgg

SEQ ID NO: 429849 - DNA, 610 bp, Homo sapiens
  misc_feature: GZ8MTXP01DWJ9P.19.71.G05.1.454.CMB.2.raw
  modified_base (241)..(241): a, c, t, g, unknown or other
  modified_base (314)..(314): a, c, t, g, unknown or other
  modified_base (323)..(323): a, c, t, g, unknown or other
  modified_base (449)..(449): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtcgcccgaggggacatcgtgatcgacccagtcctccagacctccgtggctgtgtctcgtgggcgagccgggccacgatacgactgacaagtcagccactattctttanactacgttaccaataatacgaaaactctagcttggaccagacacgacgaccaggacacgcctcgtagctgctntatttacgnggactcgttaccgaccggtacgtcccggggtcccaggtaccgtattccgaggtcggctgggtcgggtacacgggactcggttaacttcgaccttctacaccgtatccgagcctacgccgtagacgngcgagtagtagtcgggtagttagttagtttacgttagtacgtacttaacttaattacttacttacgttacgttcggttaacggtacggttacggtaacggttacggtacgtagttagttacgttacgtaacgacgtaacgtacgtcgttcgtcgttcgtcg

SEQ ID NO: 429850 - DNA, 670 bp, Homo sapiens
  misc_feature: GZ8MTXP01CP1U9.19.71.G05.1.454.CMB.2.raw
  modified_base (320)..(320): a, c, t, g, unknown or other
  modified_base (346)..(346): a, c, t, g, unknown or other
  modified_base (447)..(447): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtcgaacgccctcgcacgaccctctcgctcacctgtcgccagtccgtccgggacagacgcgctagcgactaggttgttgtcgttggcacggtggtcaggccacgtccccagtcggagnggtactaggaggtggcgtacgggganactattattcaatcgtaaccaaagtacggtagtaaactaactaaatttcacgtacctaactagttcgtaggttagaggtacgtacgaacgtagaaacttanaacgtaacgtaagaaccacgtaacgtaacgaaacgtaaaccttacgttacccctccgttacgccgtagtaccgttacgaacccgttcgttacgggttaccggtaaaccccggttccgggtaaaacgggtcgggttaaccgggtttagttacgttttaaacggttaccggttaacgggtacggggtaaaccgaccccggtaaccccgttaagtttaaaccccgg

SEQ ID NO: 429851 - DNA, 553 bp, Homo sapiens
  misc_feature: GZ8MTXP01BALJD.19.71.G05.1.454.CMB.2.raw
  modified_base (242)..(242): a, c, t, g, unknown or other
  modified_base (323)..(323): a, c, t, g, unknown or other
  modified_base (374)..(374): a, c, t, g, unknown or other
  modified_base (384)..(384): a, c, t, g, unknown or other
  modified_base (434)..(434): a, c, t, g, unknown or other
  modified_base (452)..(452): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcggccacatcaactgacaagtccagccactaattcttttaanactagttaccaaataatacgaaaactacttagcttaggaccagcagagaccaggacagcctcgtagctgctctatttacgnggcactccgtaccgggactcccggggtcccctggacgtatcgagtggaccnggtccgggtntaggggactaggtactttcgctctcaccatcagcagctgcagctagaagngtgggtgtattagttatntagtacaataattattattatcgttggtaacggtcgttacggacgaaggacgtaaggttgttaattactaagaagtaacgagtcggttacgtcgttcgtcg

SEQ ID NO: 429852 - DNA, 670 bp, Homo sapiens
  misc_feature: GZ8MTXP01BUSBU.19.71.G05.1.454.CMB.2.raw
  modified_base (234)..(234): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactggtgaacgccctcgcacgacccctctcgctcacctgtcgccatccgtccgggganagagtcgctagcgactgtgttgcgttggcacgtgggtcaggcacgtccccatccggagtaggtctaggaggtgggcgtaggggaaagtactatttatttcagttacgtaccaaacgacggtagtaaactaactaaattacgcgaccaaacctatcgtgtagagtacgtcgactagaactatacgaaacgtagaacacgtaagtaacgaaacgtaacctacgttccacccgtagacgtacgtaccgtcgtaacccgtttcgtacggttaccgtaaccccggtacccggaagggtacccgtacggggtttactttaaacgttaacgttaacggttaagggtaacgggaaaccggtaccccgaccccgtaaggtaaccgacttcgttaccggtaacccctaccgttcgttctacggttcgggttcaacgttttaacggg

SEQ ID NO: 429853 - DNA, 674 bp, Homo sapiens
  misc_feature: GZ8MTXP01DHYDV.19.71.G05.1.454.CMB.2.raw
  modified_base (331)..(331): a, c, t, g, unknown or other
  modified_base (391)..(391): a, c, t, g, unknown or other
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctccacctgtcgccagtccgtccggggacagacgtcgctagcgactagtgttgcgttggctacgtggggtcaggccacgtccccagtcggagaggtcgtaggngtggcgtagggaacgtatattattcagtcgtaccaagacgtagaaacttaactaaattancgactaacctattcgttaggttagaagtacgtacgtaaccgttagaaacctaataccgtaaacggtaacgaacccttaaacgaacggtttaaaccggaaaaccgtaaaccccgttacgttttaccccaccccgttagggaccaccggtaccttaccgtacccttcggttaacgggtacgaccccggtaacccgggagggtaaacccggttaggggttatttacgttaaacgtttcggacgggttaacggaaaccgggtcccgaccctaagttaaccgtaaccg

SEQ ID NO: 429854 - DNA, 659 bp, Homo sapiens
  misc_feature: GZ8MTXP01A80Q7.19.71.G05.1.454.CMB.2.raw
  modified_base (622)..(622): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgccgtgctgggccctccacaaggtgtcctgtcacaagtacagctgcagcagtcaggtccaggactgggtagaacgccctcgcacgaccctctcgctcacctgtcgcctagtccgtccggggacaggacgtcgctaggcgactaggttgttgcgttggctacgtggggcagggccacgtccccagtcggagtggtcgtaggaggtgggacgtaggggaacggtactattacgtttacgagttaaccgtaccaacgtaacggtaggaaacttaacgtaaattacgtacgacctaacctagttacgtaggttacggagtacggttaccgtaaacgtttacggaaacctaaagttaaccgaaacggttaagaacctaacggtaacgttaacgaaaacgtaacgtaacgtttcccacccgtagtaccaagtcctacggtaccctgtcgtcgttaccgtccggaggtaccgtagggttagttacttacttaacgnggtaacggaacgacggttaccctaagttaacgtaacc

SEQ ID NO: 429855 - DNA, 625 bp, Homo sapiens
  misc_feature: GZ8MTXP01B57IG.19.71.G05.1.454.CMB.2.raw
  modified_base (246)..(246): a, c, t, g, unknown or other
  modified_base (260)..(260): a, c, t, g, unknown or other
  modified_base (294)..(294): a, c, t, g, unknown or other
  modified_base (326)..(326): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccatcaactgacaagtccagccactaattcttttaanacacgttaccaaanaatagaaaacttacttagcgttggaccagcaganaccaggacagcctctagctgctcatttacggngactacgtaccgaccgggacgttcccgggtcccctacggacgtagtcgacggtcgggacgtcgggtcgggtcgacgggactacgttacttaccacttcctacaccagtcacgaccgacgtcctagacgagcgtaaggaagtgtagggggttcgtaacgtttagtttattaagtacgttaaactaaattaattatttaattacgttacgttaggtcggtacggttacggtaaccgaaacgggtacgtaaggttacgttattacgtaagacggtaacgtacgtggacgtcgttaacgaacc

SEQ ID NO: 429856 - DNA, 750 bp, Homo sapiens
  misc_feature: GZ8MTXP01C4KTL.19.71.G05.1.454.CMB.2.raw
  modified_base (151)..(151): a, c, t, g, unknown or other
  modified_base (220)..(220): a, c, t, g, unknown or other
  modified_base (234)..(234): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttctcttcttcctgccgtgctggcctccanaggtgtcctgtacacaagtacagctgcagcagtcaggtccaggactggtagaacgcctgcacgaccctntcgctcacgtgtcnccagtccgtcgggacagcgtcgacgtagcgacgtaggttgttcgcgttcggcctacgggttcgggtacacgggtacctaacccggtacccccgaggtacccgggaaaggtacgggtaccgttaagggacgggtacggggtaccggtaacgggggaaacggtaactagtttacgtttaaccgtaaacgttaccggtaacccgtaaaacgtaaaccgggttaaagggtaaaaacttaaaccgttaaaaagtttacgaaccggtaccctaaccgtaagtttccgttaaggtttacggaaacgtacgttaaccgacgttaaacggaaactaaacgtaaccgtaaagtaaccgtaacaaccgttaacgttaaacggaaacgtaacccgtacggttaccctacccgtagtaaccacggtacctacggtacctaacgtcgttaaccgaccgttaccggtagtaacgttcgggttattacgttaatacggtggtaacggaacgttacccgtccttaagtaaccg

SEQ ID NO: 429857 - DNA, 591 bp, Homo sapiens
  misc_feature: GZ8MTXP01CFCPY.19.71.G05.1.454.CMB.2.raw
  modified_base (241)..(241): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgcaagtccagccacaattcttttaanactagttaccaaacaatagaaaactacttagctaggtacagacagagaccaggacagccctctagctgctctatttacgtgggacacgtccgtacccgggaacgtccccggggtccctaccggaccgtattcgaggtcggaccgagggtccgggtcgtacggggactagtactttcactcctacacatcagcacgcctgcaggctagaaagtgtggtaggggtacttagttttattagttagtacctaaattaagtttattattacttacgttcggtaggtaacgttcggacgtaaaggaccgtaaaggtgaagttacttacgaagacgtaatggtacggactcgctaac

SEQ ID NO: 429858 - DNA, 632 bp, Homo sapiens
  misc_feature: GZ8MTXP01BD0KD.19.71.G05.1.454.CMB.2.raw
  modified_base (222)..(222): a, c, t, g, unknown or other
  modified_base (229)..(229): a, c, t, g, unknown or other
  modified_base (235)..(235): a, c, t, g, unknown or other
  modified_base (404)..(404): a, c, t, g, unknown or other
  modified_base (578)..(578): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgccgtgctgggcctcccacaaggtgtcctgtcacaagtacagctgcagcagtcaggtccaggactggtgaagccctgcacgaccctntcgctcnctgtcnccatcgtccggggacagagtcgctagcgacgtagtgttcgcttggctacgtggtcacggccacgtccccagtccggagtacgggtctaggaggtcggcgtaggggaagtactagttaacgtttcaaagttcgtaaccgaaacgtacggtagtaaactaacgtaaattancgtacacctatcgttgtagagtaacgtcgtatacggaaactaacgtaacgtaaacggtacaaccgaacgtaacgttaaccgaaacgtaaacccgtacgtttccctacccgttacgctacggtacctcggtaacctcgtcgttacgacccgttccggaaaggtcgttacgggttnttaactttaacgtacgtaacggtacggacggttaccgtccccgttaagtaaccg

SEQ ID NO: 429859 - DNA, 685 bp, Homo sapiens
  misc_feature: GZ8MTXP01A6DK7.19.71.G05.1.454.CMB.2.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtgccatcgtccgggacagagtcgctagcgacagtgttgcttggcacgtgggtcaggcacgtacccagtcggagaggtactaggaggtggcgtaggggaaacggtactagttacgtttcgagttacgttaacccaacgtaacgggttacgggaaaacttaaccgtaaaagtttactacggtaacctaaccctagtttaccgttagggttaggaacggtaacggtacggtaaccgttaaggaacctaaacgttaaccgaaacggttaagaaccctaaacgggtaacgttaaaccgggaaaaccgtaacccgtaacggtttcccctacccgttggacctacgtcctacggtaccctgtaacgtacgaccgtaccggaagggtaccgtagggttagttaacttacgttaaccggtggtaacggtacgacccggttacccctaagttaaccgaacc

SEQ ID NO: 429860 - DNA, 603 bp, Homo sapiens
  misc_feature: GZ8MTXP01A6I1W.19.71.G05.1.454.CMB.2.raw
  modified_base (243)..(243): a, c, t, g, unknown or other
  modified_base (270)..(270): a, c, t, g, unknown or other
  modified_base (334)..(334): a, c, t, g, unknown or other
  modified_base (449)..(449): a, c, t, g, unknown or other
  modified_base (471)..(471): a, c, t, g, unknown or other
  modified_base (492)..(492): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagactccctggctgtgtctcgtgggcgaggccgggccacatacaactgacaagtccagccataattctttanactagttaccaaactatagaaaacttntacgcttaggaccagacaagacgaaccgaggaccacggccctacgaggctgctatagtttacgnggctagtaccgaccggatcccggggtccccagaccgtatccgaggtcggacgtgggtcgggtcgtagggactagtctttaccactctcaacatcagcacgctgcgagtacagaangtacgggtggtatttaagtttnttagttcgaatattaaagttnttagttacttacttgggtaacgttacggttacggaacccgttaaggtaaccgtaaggttcggaattacgcgtaaaggaaccgttaacgtcggttaggtccgttggtaaccc

SEQ ID NO: 429861 - DNA, 762 bp, Homo sapiens
  misc_feature: GZ8MTXP01E084Y.19.71.G05.1.454.CMB.2.raw
  modified_base (243)..(243): a, c, t, g, unknown or other
  modified_base (369)..(369): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccgaggggacatcgtgatgacccagtctccagactccctggctgtgtctcgtgggcgagcgggccacgatacaactgacaagtccagccaactaattctttanactacgttaccaaacaatagtaaaaactctacggtacttacgggtaaccaaggaccaaaggaacgaaccgaagggaaccacggtacccctaccgtaaggccttgaccttactaagttttaaccggnggactacgtaccggtaacccggtacggttccccccggggtccctaggaccgtattaccgaagggtcggcgtacgggtcgggtacggtacgggactagttactttaccacctactaccacctagtacgacgacgacgtccgtacgacggtaggtacgtaaagtaaacggtagggttacggttaggttacgtttaagttttaaacttaagttaacgttaaactaaaattaacgtttaaattttaacttaacgtttaaccggtttaacgggttaaccgggttaaccggttaacccgggaaaccgggtaaaacgggtaaccggttaaacgggttaggttaacttaacgaacggtaaaccggttaaccgtaccggttacgggtcggttaacgtaaccg

SEQ ID NO: 429862 - DNA, 596 bp, Homo sapiens
  misc_feature: GZ8MTXP01BQOTF.19.71.G05.1.454.CMB.2.raw
  modified_base (238)..(238): a, c, t, g, unknown or other
  modified_base (252)..(252): a, c, t, g, unknown or other
  modified_base (324)..(324): a, c, t, g, unknown or other
  modified_base (400)..(400): a, c, t, g, unknown or other
  modified_base (584)..(584): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccacatcactgacaagtccagccataattctttanactacgttaccaanaatagaaaactactagcttaggaccagacagagaccaggacacgcctcgtaggctgcctactagtttaccgngggccaagttaccccgtacccggggaagttccccgggggtccccctacggaaccgtgttccgaggtcgggacccgngggtccgggtcgtagggacctaggtacttcaacttcactaccatcgagcacgctgcgaggctagaagtctggggtggtacttagtttattacgtagtaccaaattaattattacttactacgttggtcgttaacggttcggaccgaaaggaccgtaaggttaggcttagaacagaacgttaacnggttcgtcgcgc

SEQ ID NO: 429863 - DNA, 703 bp, Homo sapiens
  misc_feature: GZ8MTXP01EYRV4.19.71.G05.1.454.CMB.2.raw
  modified_base (238)..(238): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgacaagtccagccactaattcttttaanactagttaccaaactaaatacgaaaactacttagcttaggtaccagcaagacgaccaggacagcctctaggctgctctattactggacagtccgtaacccggggaatcccggggtcccctaggaccgtatttccgaaggttcggacctaagggtccggggtaccgtagggggaaacctagggttaacttttcccaacttcccgttaccaaacccgtagtaccaacggtccaacggcctgggacacgggactaggaaagtagttgggtacggggtacttaagttttaagttagtttacgtaaccgtaaaacgtaaatttaactttaagtttaactaacccgtttcggtaagggttaccggtttaccgggaacccgttaaacgggggtaaaccgtaaagggggttaggttaattacgtaaccggtagaaaccggtaaacgtggttcgggtaaccttaacggaacccc

SEQ ID NO: 429864 - DNA, 748 bp, Homo sapiens
  misc_feature: GZ8MTXP01BLNNG.19.71.G05.1.454.CMB.2.raw
tcagtactctcgtgcacgaccggtgctcgatttagtgtcgtcgcaagagagaggggggcagagtctgctgaattctggttgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagacccctctcgctcacctgtcgccatcgtccggggacagagtcgctagcgacagtgttgcgttggcacgtgggtcaggcacgtccccagtcgagacggtctaggagtggcgtaggggaacgactattacgttcagtacgtacccaactacggtaggtaaactaacctaaaatttacgtacgaacctaccctaattcgttaggtttagaacggtacggttacggaaccgttaggtaaacctaaacttaccgaaaaccggttaacgaaacccgtaaacgtaaacggttaaacccggaaaaccggtaaaaccccgttaacgtttaccccgtaccccgttacggacccgtaacgttccgttaaccggtaacccctttcgttaaccgggttaccgttaaacccccggttaccccgggaaacggggtaaacccggttaaccgggggtttaacgttaacgtttaacggtttaaccgtagggttaaccggggtaaaacggaccccggggttacccccctaaagttaacccgggaacccg

SEQ ID NO: 429865 - DNA, 621 bp, Homo sapiens
  misc_feature: GZ8MTXP01CAMGD.19.71.G05.1.454.CMB.2.raw
  modified_base (573)..(573): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagacgtcgctagcgacagtgttagcttggcacgtggtcaggcacgtcccagtcgagaggtctaggagtggcgtaggggaaggactagtttactttacattacgtacctaaacgacggttacggaaaacttaaccgtaaaatttacgtacggccaaaccctaagttcgtagtttagacgtacgtcgaacttaggaacctaagtacaaacggtacgaaccaactataaccggaaacgtaacctcgttacctccctagacacgtcgtacgccttctgtacgacccgtccggaagtacgagggttgtacttgttacgtggaacggttacgccggacccaagtacaccgngttccgccctacgttcgttccgtcgttgggtcgttaacgtttaacggg

SEQ ID NO: 429866 - DNA, 690 bp, Homo sapiens
  misc_feature: GZ8MTXP01AVLLG.19.71.G05.1.454.CMB.2.raw
  modified_base (251)..(251): a, c, t, g, unknown or other
  modified_base (346)..(346): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctccgtggctgtgtctcgtgggcgaggccggccaccatcaactgacacgtccacgaccaactaattcttttaanactacgttaccaaactaataagtaaaacttacttagcttacggtaccagacagacgaccgaggacacgcctacgtagctcgctactactttacgnggtacctacgttaccgtaaccgggtaccgtcccggggtacccctacggtaccgtagtcgaggtcgggacgtcgggcgggtcgtacgggactacgttacttaccgacctctaccaacgtactcgacgacctacggcctacggacgacgggactaacgggaagtaggttcggggtacggttactttaaaggttttattacgtacgtaacctaaattaaactttacgtttaacttaacgttacggtttccgggtaacgggttaacgttaccgggaaaccgttaaagggtacccgtaaggttcgacttaacgtaacgaacgtaacgtacgtagacgtcgttcgtaacg

SEQ ID NO: 429867 - DNA, 636 bp, Homo sapiens
  misc_feature: GZ8MTXP01A7OXJ.19.71.G05.1.454.CMB.2.raw
  modified_base (256)..(256): a, c, t, g, unknown or other
  modified_base (343)..(343): a, c, t, g, unknown or other
  modified_base (526)..(526): a, c, t, g, unknown or other
  modified_base (602)..(602): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctcccgtggctgtgtctcgtgggcgacggccgggaccaccataccgaactcgacaacgtccagccaactaattcttttanactacgttaccaaataatagaaacttctagcttaggaccagacagagaccgagacacgcctaccgtaggctgctactagtttaccgnggacacgttccggaaccggacgttccggggtcccctaggaccgtatccgaggtcgacgtgggtcgggttacgacgggaactagttaacttccctacttaccacacccttagaccacgtcgaaccgtcgtacgaccgtaggaccgtaagaagtacgtggggtacgttagttaagtttatagttntaaactaattaaattattaattattaccgttgggtcgtaacggttccggaaacgttaagggaacgtagggttacgnttagaacagtaacgtagtccgaggtcttcgaacg

SEQ ID NO: 429868 - DNA, 593 bp, Homo sapiens
  misc_feature: GZ8MTXP01A7CUW.19.71.G05.1.454.CMB.2.raw
  modified_base (413)..(413): a, c, t, g, unknown or other
  modified_base (431)..(431): a, c, t, g, unknown or other
  modified_base (445)..(445): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctctcttcctgcccgtgctggcctccacaaggtgtcctgtcacaagtacagctgcagcagtcaggtccaggactggtcgaacgccctcgcacgacccctctcgctccgacctgtcgcccagtcgtccggggacagagcgctagcgacagtgtcgcgttggcacgtgggtcaggccacgtccccagtcggagagtctaggagtgcgtagggaagactagttatttacgaaattcggtaaccaaacgtacgtaagggaaattaacaaattattcgacaccattgttggttnaagtacgtacgactaganaacgtcaagtacanactagtacgaagaaccctagttccctaccacgctaggtcctacgacttcgtaggttctaaacccgttcccgggaagtacccggttacgggttattagttaagtttacgaagggttacggaacggttaccggtaaccccaagtaacccg

SEQ ID NO: 429869 - DNA, 545 bp, Homo sapiens
  misc_feature: GZ8MTXP01E2OVR.19.71.G05.1.454.CMB.2.raw
  modified_base (243)..(243): a, c, t, g, unknown or other
  modified_base (326)..(326): a, c, t, g, unknown or other
  modified_base (377)..(377): a, c, t, g, unknown or other
  modified_base (403)..(403): a, c, t, g, unknown or other
  modified_base (417)..(417): a, c, t, g, unknown or other
  modified_base (433)..(433): a, c, t, g, unknown or other
  modified_base (438)..(438): a, c, t, g, unknown or other
  modified_base (445)..(446): a, c, t, g, unknown or other
  modified_base (464)..(464): a, c, t, g, unknown or other
  modified_base (524)..(524): a, c, t, g, unknown or other
  modified_base (537)..(537): a, c, t, g, unknown or other
  modified_base (544)..(544): a, c, t, g, unknown or other
tcagtactctcgtgcacgaccggtgctcgatttagtgtcgtcgcaagagagaggggggggtacaacaggcaggcaggggcagcaagatggtgttgcagaccccaggtcttcatttctctgttgctctggatctctggtgcccgacggggacatcgtgatgacccagtctccagactccctggctgtgtctcgtggcgagccgggccaccatacaactgacaagtccagccacaattctttaanacacgttaccaaacaaatagaaaactacttagctaggtaccagcagacgacaggacagccctccaggctgctactagtttacngggcagtccgaacccgggacgtcccggggtcccctagacccgtattaccgngtcggcacgggtcggtcgtagggacngtactttcacttcncaccatcagcagcccngcagntgaaagnnggtggactagttaacttntacgtaacaaataattatattactcgtcgtggaacgtcgaccgaggacgaaggtgattancgaagagaagtgngctcgcnc

SEQ ID NO: 429870 - DNA, 805 bp, Homo sapiens
  misc_feature: GZ8MTXP01DDX4V.19.71.G05.1.454.CMB.2.raw
  modified_base (242)..(242): a, c, t, g, unknown or other
  modified_base (263)..(263): a, c, t, g, unknown or other
  modified_base (316)..(316): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgaggggacatcgtgatcgacccagtcctccagacctccctggctgtgtctcgtgggcgagccggccacgatcaactgacaagtccagcataattctttanacattaccaacatagaaactntagcttaggacagacagacaccaggacagcctcgtagctgctactatttacgnggactagttaccgtaacccgggagtccccgggggtacccctacggaccgtaagtttcccgaaggttacgggcgtaacggggtccgggttaccgtacgggggtaacctaaaggtttacgttttccgaacccgttcccttacccgaaaccccgttaacgtaccgtacggacccgtaaccggtcccgtacggaccggtaacgggtacgtaaggtaaaacggtcggtttacgggggtttaacgggttaacgttttaaacggtttttagtttaaacgttaaccgttaaaccttaaaacgtttaaaacgttttaacgttttaaacttttaacggtttaaccggtttaacgggttaaacggggtttacccgggttaaaccggggtaaacccggttaaaacgggggttaaaccggtaaagggttaacggttaacgttaacgtaaccggaaacggttaacggttaacggttcgggttacgtaaccgttccgtaacccg

SEQ ID NO: 429871 - DNA, 613 bp, Homo sapiens
  misc_feature: GZ8MTXP01ECIGW.19.71.G05.1.454.CMB.2.raw
  modified_base (242)..(242): a, c, t, g, unknown or other
  modified_base (285)..(285): a, c, t, g, unknown or other
  modified_base (325)..(325): a, c, t, g, unknown or other
  modified_base (374)..(374): a, c, t, g, unknown or other
  modified_base (380)..(380): a, c, t, g, unknown or other
  modified_base (392)..(392): a, c, t, g, unknown or other
  modified_base (414)..(414): a, c, t, g, unknown or other
  modified_base (427)..(427): a, c, t, g, unknown or other
  modified_base (431)..(431): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatcaacgtgacaagtcccagccacaattctttanacagttccaacaatcgaaaactacttagcttggtaccagcganagaccaggacagcccctctaggctgcttcgtattttaacngggggcacttaccgtacccggggaacttcccgggggtccccctcgacgngttacncggtaacggcgngggcggttcctaggggaaaccngttacttcactcncacntacagcacgcgtgacgagcgagagtagtaggtagtgtagttagttagttagttacgtaactaataattattaattacgttacgttaacggtacggttacggtacggttacggtaacggtaacggttacggttacggttacgtaacgtacgtaacgtacgtacgttacgtaacgttcgtaacg

SEQ ID NO: 429872 - DNA, 672 bp, Homo sapiens
  misc_feature: GZ8MTXP01AXK37.19.71.G05.1.454.CMB.2.raw
  modified_base (232)..(232): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccagtcgtccgggganagagtcgctagcgactaggtgttgcgttggcacgtgggtacgaggcacgtccccagtcggagaggtctaggagtggcgtaggggaacgactagtttagtttacagtacgtaaccaaacgtacgtaaggtaaactaactaaagttacgcgtaccaaaccgtattcgtaggtagagtacgtcgtaactagaactaatacgaaacgtacgaacaacgtaagtaaccgaacgtaacctacgttcccgacctagacgtacgcgtacgtaccttacggtacggtaccgtaccgtaccgggaacggtacgggtacggttagtacgttaacgttacggtaaggtaaccgggaacggtaccccggttaccctaaggtaccgaaaccgttcgttaccgaacccgtacccgtttccggtacttcgggttacggtcgttaacgttaaccggg

SEQ ID NO: 429873 - DNA, 707 bp, Homo sapiens
  misc_feature: GZ8MTXP01B4WMV.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacaggtcgttgcttggcacgtgggtcaggctacggtccccatccggagtacggtactaggaggttggcgtaggggaaggtactagttatttcgaaattcgtcccgaaacgtacgggttagggtaaaacttaacgtaaaatttacgtacgacctaacctacgttaccgttggttaggaggtaacggttacggtaacgttacggaactaaacgtacgaaacggttaacggaaccgtaacgtaacgtaaccggaaacgtaaacccgtacgtttacccgttaccccgttacgtaccgtacggtaccgttacgtacccttcgttacggttaccggtacccggttaccccggtaaacggggtaacccggttaacggggttcggttaactttaagtttacgtaacggtacgggtaacgggaccgggtaacccccgttaagttaacccgg

SEQ ID NO: 429874 - DNA, 664 bp, Homo sapiens
  misc_feature: GZ8MTXP01AZAFG.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcgggcctcccacaaggtgtcctgtcacaagtacagctgcagcagtcaggtccaggactggtacgaacgccctcgccacgtacccctctccgctccacctgtcgccagtcggccgggacagtagtcgctagcgactagtgttcgcttggcgtacgtgggtcaggcacgtcccagtcgagtacggtctaggacggtggcgtaggggaagtactagttacttcaagttacgtaaccgaaacgtacgggttaagaaacttaacgtaaaattcgtacgactacgtattcgtagttaggacgtacgtacgaactacgaaactacgtaacgaaacgtaacactaagaacgtacgaaaccgtaaccttacgttccctaccgtaggactacggtccttaccgtccgttaacgtacggttaccggtacccgttacccgggaagggtaacccgttagggggttattaaaccgtttaaggtaacgtcggggtaaccggaacggttaccccggaaccccttaaaggtaacccg

SEQ ID NO: 429875 - DNA, 674 bp, Homo sapiens
  misc_feature: GZ8MTXP01ASPEN.19.71.G05.1.454.CMB.2.raw
  modified_base (362)..(362): a, c, t, g, unknown or other
  modified_base (493)..(493): a, c, t, g, unknown or other
  modified_base (541)..(541): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactggtgaacgccctcgcagaccctctcgctcacctgtcgccatccgtccggggacagagtcgctagcgactagtgttgcgttggctacgtgggtcaggcacgtccccagtcgagtgtctaggagtggacgtagggggaagactagttatttcatcgtaccaaacgtacgtgaaactactaaattnagcctaaacattctgttagacgtactccgaactagaactaataccgaaacgtacggaaccaacgtaacttaccggaaaagtaacccctagtttccccaccgtaggacctaaccggtctaccgggtaccttntaccggttacgaccccgttccccggaagggttaccggaccggggtttnttaaacgtttacgttacgggtaacgggtaaagggaccggtacccggccccgttaaagtaaccggaccgttacgttcccggtaaacccctcccgttcggttccttcggttacggggttcttaaccgtttaaggg

SEQ ID NO: 429876 - DNA, 623 bp, Homo sapiens
  misc_feature: GZ8MTXP01AT27Y.19.71.G05.1.454.CMB.2.raw
  modified_base (317)..(317): a, c, t, g, unknown or other
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgcctagtccgtccggggacaggacgtcgctagcgacaggttgttgcgttgcacgtgggtcaggcacgtcccagtcgagnggtcgtagaggtcggacgtggggaaacgtactattattcagtacgtaccaagtacgtaaggaaacttaacgtaaattacgtacgacctacctaagttccgtaggttacgaagtacgtacgactagaacaattacaaacgtagaaccacgaacgtacgaaacgtaacctagttccctccgtagacctacgtctacgtacccttcgtcggtaccgaccgttcccgggaggtaacggtacgggttacgttacttaacgttcgtagggtaacggtaaccggacccggttacccctaaggttaacaacccg

SEQ ID NO: 429877 - DNA, 602 bp, Homo sapiens
  misc_feature: GZ8MTXP01EWRQL.19.71.G05.1.454.CMB.2.raw
  modified_base (246)..(246): a, c, t, g, unknown or other
  modified_base (409)..(409): a, c, t, g, unknown or other
  modified_base (544)..(544): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttctcttctcctgccgtgctggcctccacaaggtgtcctgtcacaagtacagctgcagcagtcaggtccaggactggtgaacgccctgcacgaccctctcgctcactgtcgccagtcgccggganagagtcgctagcgacagtgtgcgttgctacgtggcaggctacgtccccagtccgagtacggtctaggagtggacgtaggggagtactattacttcagtacgtaacaacgtaggtagtaaactaactaatgtacgctactattcgtgtagacgtacgtacgtanacgaactaagtaacaaacgtacgaactaacgtaacgtaaccgaaacgtaaccgtacgttacccgtccgtacgaccgtacgtcctcgtaccttcgtcgttaccgtaccgttaccggaacggtaacgttacgggttnttaacgttaacgtacgtaacgggtacggaaccggaccgtaaccccgttaagtaacccg

SEQ ID NO: 429878 - DNA, 601 bp, Homo sapiens
  misc_feature: GZ8MTXP01D8XPZ.19.71.G05.1.454.CMB.2.raw
  modified_base (241)..(241): a, c, t, g, unknown or other
  modified_base (284)..(284): a, c, t, g, unknown or other
  modified_base (310)..(310): a, c, t, g, unknown or other
  modified_base (317)..(317): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgaggggacatcgtgatcgacccagtctccagacctcctggctgtgtctcgtgggcgagccgggcctacgatacgaactgacaagtcagcatatctttanacacgttaccaataagtataaaactactagcttggaccagcanagaccagacagcctctagctgccttntattcgnggactacgtaccgaacggtacgtcccggtaccacgtacgtgtcgaggtcgactgggtcgggtacgtagggactacgttcttacgctcgtacacgtagcgacgacgacgcgtcgacgacgtacgtagtaagtagtacgggtacggtacgttagtttattacgttacgttaactaacttaaattaattaattagttacgttcggtaacgtacggttacggtacgttaacggtaacgtaaggttagttagttataagtagaacgtacgtagttagtcgttcgtaacg

SEQ ID NO: 429879 - DNA, 771 bp, Homo sapiens
  misc_feature: GZ8MTXP01AJJXS.19.71.G05.1.454.CMB.2.raw
  modified_base (248)..(248): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatccgtccggggacagacgtcgctagcgacngtgttgcgttggctacgtgggtcacggcacgtccccagtccggaggtacggtcgtaggacggtgggcgtagggggaacgtactagttatttcgagttcgtaaccaaagtacggtagtaaacctaactaaagttatcgacctaaacctagttcgtggttacgagtacgtcgaactagaaactaactacgtaaacgtaacgaaccaacgtaacgtaaccggtaaacgtaaaccgtaccgtttacccttacccgtacggtaccgtaacgtccggttacgtacccgttaccgttacgggttaaccgtacccggtaacccgggtaacgggtaaacccgggttaccggggttaacgttaaacgtttaaccggtttaacggttaacggggtaaacgggttaaaccgggaacccgggttaaccccccggtaaagtaaccggttaaccgttaacgttacccgggtaacccctacccggttaacccggttcccggttcgggttacgggttccggttaacggtttaaaccgggg

SEQ ID NO: 429880 - DNA, 868 bp, Homo sapiens
  misc_feature: GZ8MTXP01B7JOH.19.71.G05.1.454.CMB.2.raw
  modified_base (257)..(257): a, c, t, g, unknown or other
  modified_base (285)..(285): a, c, t, g, unknown or other
  modified_base (362)..(362): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtcgcccgacggggacatcgtgatcgacccagtcctccagacctccgtggctgtgtctcgtgggcgaggccggccacgactacgaacgtcgactaacgtccagccaactacttctttaanactacgttaccaaataatacgaaaactntagcttacggaaccagctagacgaccgtaggaccacgtcccgtccgtaggctcgacctttacgttaacgtttaccgngggtacctacgtttccccggtaacccggggtacggttccccggggttaccccccaggtaccgttagtacccgtagggtacccgggctaacgggggttccggggtttcaaggggtacctagtttaaccttttaccccaccttaccgtaaccctaacggtactaccggaccgacccggtaccgtcggtacggtaccggacggtacggtaaggtaacggttacgggttacgggggtttacgtttaaagttttaacgttttaacgttaacgtttaaccgtaaacctttaaaagttttaacgttttaaacgtttacgttttaaacggtttacccggggtttcggggtaaaccccggggtttaacccggggttaaaccggggtaaacccggggttaaaacggggttaaacccggggtttaaagggttaccggttaaacgtttacgtaaaccggggtaaaccggttaaccgttcgggttccggggttaccgtaaccgttaacccggttaaccc

SEQ ID NO: 429881 - DNA, 686 bp, Homo sapiens
  misc_feature: GZ8MTXP01EE72S.19.71.G05.1.454.CMB.2.raw
  modified_base (203)..(203): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggccctcccacaaggtgtcctgtcacaagtacagctgcagcagtcaggtccaggactggtgaacgccctcgcagacccctntcgctcacctgtcgccatcgtccggggacagagtcgctagcgactagtgttgcttggctacgtgggtcaggcacgtcccatcgagagtctaggagtggcgtagggaagactagttactttcagtcgtaccaaacgacggtaggtaaactactaaaattacgtcgacctaaaccctattccgtagtttagaacgtacgtaccgaacttagaaactaagtacgaaacgtaagaacctaaacgtaacgtaaacgaaacgtaaccgtacgttaccctacccgtagacgtacgtacgttacgtaccttcgtacggtaccgtacccgtaccggtaacggtaaccggtacggttagttaacgtttaacgttacggtaacgggtacgggaaaccggtacccggttaacccgtaaagtaaccgttacgttacgttacccgtaacccgttaccgttccgttcggtcggttacggttaacgttaacgttaacgg

SEQ ID NO: 429882 - DNA, 724 bp, Homo sapiens
  misc_feature: GZ8MTXP01E0NY3.19.71.G05.1.454.CMB.2.raw
  modified_base (228)..(228): a, c, t, g, unknown or other
  modified_base (242)..(242): a, c, t, g, unknown or other
  modified_base (253)..(253): a, c, t, g, unknown or other
  modified_base (267)..(267): a, c, t, g, unknown or other
  modified_base (278)..(278): a, c, t, g, unknown or other
  modified_base (299)..(299): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgagccgggccacgactacgaactgacaagtcanccataattctttanactactacaanaatacaaactctancgtagacaganagacgacagactcgcctacgngctagtacttacctagttcgcggtacagtacccggtaaccggtccgtcccgggtacccctaggtacctagtccgaggtcggcgtaacggggtcgggttacgtacgggaacttcgttaccttcacccttacgtacccaccgtacgtccgacgtaccgtaccgtacggtacgtacggtacggtacgtaacggtaacggtacgttacggggttacggttacggtttaacgttttaacgtttacgtttaacgttaacgttaaacgttaaacgtttaaacgtttaagtttaaccggtttaccggttacggttaaccgggttaaccggttaacccggtaaccgggttaaaccgggtaaacggtaaacggttaacggttacgttacgtaacgtaacggtaacgtacgtacggttacgtaacgttcgtaaccg

SEQ ID NO: 429883 - DNA, 747 bp, Homo sapiens
  misc_feature: GZ8MTXP01AS4Q3.19.71.G05.1.454.CMB.2.raw
  modified_base (341)..(341): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctcctggctgtgtctcgtgggcgaggccgggccacgatacaactgactaagtccagccaactaattcttttaacactacgttaccaaactaataacgaaaactcttagcgttacggaccagacagacgtaccgaggacacgcctacgtaggctgctctatttacgnggacacgtcgtacccgggatccggggtacccctcgacgtatcgaggtcggacgaacgggtcgggtacgaggggacctagttactttaccaccttacccttacaaccgtactacggacaccgtaccggacccttaggcccgttaaggggacctaaacggggttaaaggtacggttacgggggttacgttaacgtttaagttttaacgtttaacgttaaccgttaaacttaaaactttaaagtttaaacgttttaaacgtttaaccgtttaaccgggtttacgggtaacgggtttaacccggggttaccgggtaaaccgggttaaacgggttaaaccggtaagggttacggttaacgttacggtaacgtaacggtaaccgtacgtcgggttacgtaacgttcgtaacg

SEQ ID NO: 429884 - DNA, 648 bp, Homo sapiens
  misc_feature: GZ8MTXP01ADT8B.19.71.G05.1.454.CMB.2.raw
  modified_base (237)..(237): a, c, t, g, unknown or other
  modified_base (254)..(254): a, c, t, g, unknown or other
  modified_base (328)..(328): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtgtcctgtcacaagtacagctgcagcagtcaggtccaggctggtcgaacgccctgcacgaccctctcgctcacctgtcnccagtccgtccgggganaggacgtcgactacgcgactaggtcgttgcgttggcgtacgtcggtcacggcacgtccccagtcgagtacggtntacggagtggcggtagggaaggtactagttacttcaaacgttcgtaaccgaaacgtaccggtaaggtaaactaaactaaagttacacgacctaaccgtagtttcgtaggttagaacggtacgtccggtaaactacggaaactaagtaaccgaaacgggttacaactaacgtacgtaaccggaaacgtaaccttacgttcctacccgtagccgtacgtcctacggtcctcgtcggttaccgtacccgttaccggaagggtaacccgttgggttacttaactcgttagtcgggacgaacggcccgtaaccgttaagtaaccg

SEQ ID NO: 429885 - DNA, 584 bp, Homo sapiens
  misc_feature: GZ8MTXP01E1FAX.19.71.G05.1.454.CMB.2.raw
  modified_base (160)..(160): a, c, t, g, unknown or other
  modified_base (204)..(204): a, c, t, g, unknown or other
  modified_base (222)..(222): a, c, t, g, unknown or other
  modified_base (387)..(387): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctccacaaggtntcctgtcacaagtacagctgcagcagtcaggtccaggactggtnaacgccctgcagaccctntcgctcacctgtcgccagtccgtccggggacaggtagtcgttagcgacagtgttgccttggctacgtgggtcaggccacgtccccagtcggagaggtctaggagtggacgtagggaacgactatagtttcatcgtacccaagtacggtagaaatacgtaaatttnacgtacacctatcgttaggttcgaagtacgtacgactagaaactaatacgaaaacgtagaacaacgaacgtaacgaaagtaaccctagttccctccgtgacacgtctacgaccctgtcgtacgttaccgtaccggaggtacgtacgggttattacttagtaactggtcggaaacgccggaccctaagttaacggaac

SEQ ID NO: 429886 - DNA, 601 bp, Homo sapiens
  misc_feature: GZ8MTXP01C91LI.19.71.G05.1.454.CMB.2.raw
  modified_base (163)..(163): a, c, t, g, unknown or other
  modified_base (311)..(311): a, c, t, g, unknown or other
  modified_base (369)..(369): a, c, t, g, unknown or other
  modified_base (378)..(378): a, c, t, g, unknown or other
tcagtactctcgtgcacgaccggtgctcgattttagtgtcgtcgcaagagagaggggggcagagtctgctgaattctggctgaccagggcagtcaccagagctccagacaatgtctgtctccttcctcttcttcctgcccgtgctgggccctcccacaaggtntcctgtcacaagtacagctgcagcagtcaggtccaggactggtgaagccctgcaagacccctctcgctcacctgtgcccatcgtccggggacagagcgctagcgaacagtcgttgcttggcacgtggcaggtcacgtccccatcgagnggtcagagtggctacgggaagacatattcaattgtcaaacagtagaaatacaaattcngctaccatntagttgaagagtcgaatgaacctaaatcaaacgagaactacaagtacgaaagaaccctaaggttccctaccctaggccaggtacgtacgtaacgtccttgttacgtaccgttaccccggtaaagggaacgttaacccggggttacgggttaacgttaactttaaacgttaacgggtttaacgggtaagggttaaccgggtaacccccgttaacccgtaaaacg

SEQ ID NO: 429887 - DNA, 834 bp, Homo sapiens
  misc_feature: GZ8MTXP01AW2X1.19.71.G05.1.454.CMB.2.raw
  modified_base (266)..(266): a, c, t, g, unknown or other
  modified_base (299)..(299): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccacgatacgaactcgactaacgtccacgccaacaattcttttaacactagttacccaaanaatacgaaaactcttagcttggaccagacaganaccaggacagcctctaggctacgctacgactttacgcgggtacaacttcccggtaacccggggaaacgttccccgggggtacccccccttaggaacccgttagtttacccgaagggttcgggaacccgggtcggggtacccggggtacggtaacggggtaactaacgttacgtttaccgaaccttcccgtaaccgaaccgtaacgtaccgaacggtacccgtaccggtaccgtacggtacggaacggtaacgtaacggtaacgtaacggttacgggggttacgggttaacgtttaacggttttaacgtttaacgtttaacgttaaaccgttaaaacgtttaaaactttaaacgtttaaacgtttaacgtttaaccgtttaaccgggttaaccgggttaacccgggtttaacccgggtaaacccgggttaaaaccgggtaaaccgggtaaacgggttaacgggttaacgttaaacgtaacggtaaacggtaaccggtaacggttacgggttaccggtaaccgttaaccggtaaccg

SEQ ID NO: 429888 - DNA, 600 bp, Homo sapiens
  misc_feature: GZ8MTXP01CN64Y.19.71.G05.1.454.CMB.2.raw
  modified_base (229)..(229): a, c, t, g, unknown or other
  modified_base (239)..(239): a, c, t, g, unknown or other
  modified_base (248)..(248): a, c, t, g, unknown or other
  modified_base (252)..(252): a, c, t, g, unknown or other
  modified_base (261)..(261): a, c, t, g, unknown or other
  modified_base (274)..(274): a, c, t, g, unknown or other
  modified_base (304)..(304): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgacaagtccagccanaatctttaanacatacaanatanaaactctanctagacagcaganacagacagcctcagctgctactatttacgnggactactaccgtacccgggacgtcccgggtacctacggaccgtagttcgaggtcggaccgagggcgggtactagggactagtacttcactcctacacatcacgcacgtcctgcgtcgactagaagtagtggtacgggtacgtttaagttttaatagttagttaactaaacttaaatttaatttagttaacttacgttacggtagggtaaccgttaccggaaccgtaaacgggacgtaaagggtcgttaagttgttacgaacggtaacgtaacgtggtcgttacctgaacctaacg

SEQ ID NO: 429889 - DNA, 652 bp, Homo sapiens
  misc_feature: GZ8MTXP01AW9F9.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgacccctctcgctcacctgtcgccatcgtccggggacagacgtcgctagcgacagtgttgcgttggctcgtgggtcaggccacgtccccagtcggaggtacggtcgtaggacggtggacgtagggggaaacgtactattactttacgagttacgtaccaaacgtacggtacggaaacttaacgtaaaatttacgtacgacctaaacctattcgtaggttagacgtacgtacgacgtagaacaatacgaacgtacgacaacgaataacggaaacgtaacctcgttaccctccgtagaccgtcgtccggtacgtaccgttcgtacgtacccggaccgtaccggaaggtaccgtaggttatacgttaacgtcggtaaggtaacgacgacccgttaccgtaagtaacgcgttccgttccgtaaccctccgttcgtcgtcggttcgtaacgttaacgtaagg

SEQ ID NO: 429890 - DNA, 692 bp, Homo sapiens
  misc_feature: GZ8MTXP01B9QM3.19.71.G05.1.454.CMB.2.raw
  modified_base (250)..(250): a, c, t, g, unknown or other
  modified_base (354)..(354): a, c, t, g, unknown or other
  modified_base (427)..(427): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctcctggctgtgtctcgtgggcgaggccggaccacatacaactgacaaacgtccagccataattcttttaanactacgttacccaaataataacgtaaaacttcttagcgttaggtacccagacaagaacgacccgaggaccagcccctccgtaggctgtcctactacgtttacgnggacacgttacccggtaacccggggacttccccgggggtaccccctacggaccgtagttccgaggttgggccngggtcgggtccgtagggacctaaggttctttaccacgttacctccgaaacctcgtaccgaggaccaacggtcctggaccgtaggacgttagaaaggtgtgggggtacggtactttagttttatacgttacgtaacctaattaattacgtttatacgtttaccggttcgtaacgggtaaccgtttccgggaaccgttaaagggtaacgtaagggttagttattacgtaacgaggtaaccgacgtgggttcgtaaccgttcgtaacc

SEQ ID NO: 429891 - DNA, 600 bp, Homo sapiens
  misc_feature: GZ8MTXP01AB770.19.71.G05.1.454.CMB.2.raw
  modified_base (242)..(242): a, c, t, g, unknown or other
  modified_base (277)..(277): a, c, t, g, unknown or other
  modified_base (320)..(320): a, c, t, g, unknown or other
  modified_base (368)..(368): a, c, t, g, unknown or other
  modified_base (376)..(376): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagacctcccgtggctgtgtctcgtgggcgagccggccacatcaactgacaagtccagccaactaattctttanacattaccaacaatagaaactctagcttaggaccngacagacgaccaggacacgcctcgaggctgctactatttacgnggacagttccgacccgggatcccggggtcccctgactatcgagtcgcnggcggtangggactagtacttcactcactacatcagcacgcctgccgtagctaggaagtgtcggggtggtactttagtttattattcgtaactaaattaatttatttatttaacgttacgttcgggtaacggtaaccggtttccggaacccggttaaagggtaacccgtaagggttcgaagttacgtaacgaacggtaacgtaaacgtgggttacgtaacgttcggtaaccc

SEQ ID NO: 429892 - DNA, 559 bp, Homo sapiens
  misc_feature: GZ8MTXP01E1MZY.19.71.G05.1.454.CMB.2.raw
  modified_base (223)..(223): a, c, t, g, unknown or other
  modified_base (330)..(330): a, c, t, g, unknown or other
  modified_base (333)..(333): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagacccctntcgctcacctgtgcccatctccggggacagagtcgctagcgacagtgttgcttggcacgtggtcaggcagtcccccatcgagaggtcagagtggctgggaaggcatnttnaatgccaacgacgtgaatacaaattatgaccacctatcgtgttggagtagtacgactagaacaattacgaacgagacacataccgaacgaacctacgttcctcccctgcaacgcctcggtaaccctctcggttacgtacccgttacccggtagggaaccgttacggggttagttacttaagtaccgttaagggtacggggaacggaccggtccccccaagtaacgg

SEQ ID NO: 429893 - DNA, 574 bp, Homo sapiens
  misc_feature: GZ8MTXP01ALTHT.19.71.G05.1.454.CMB.2.raw
  modified_base (224)..(224): a, c, t, g, unknown or other
  modified_base (483)..(483): a, c, t, g, unknown or other
  modified_base (523)..(523): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctntcgctcacctgtgccatcgtccggggacagacgtcgctagcgacagtgttgcttggcacgtggtcaggcacgtccccatccgagtacggtctagaggtggcgtggggaaaggcgtaatatttcaatagtcccaaatacggtagaaataccgaaaatttcacgtacacgtatctgttagagtagtacgactgaacaatacaacgtagacaacaataccgaaagacctagttccaccctagcctagtcctacggacccttntacgttcgaccgttacccggaacggtacgttacggggttnttacgtttaactacgttcggcgggtaaacgaccgtaacccccgttaagaag

SEQ ID NO: 429894 - DNA, 692 bp, Homo sapiens
  misc_feature: GZ8MTXP01ACO4W.19.71.G05.1.454.CMB.2.raw
  modified_base (231)..(231): a, c, t, g, unknown or other
  modified_base (242)..(242): a, c, t, g, unknown or other
  modified_base (255)..(255): a, c, t, g, unknown or other
  modified_base (316)..(316): a, c, t, g, unknown or other
tcagtactctcgtgcacgaccggtgctcgatttagtgtcgtcgcaagagagaggggggaggtacaacaggcaggcaggggcagcaagatggtgttgcagaccccaggtcttcatttctctgttgctctggatctctggtgcccaggggacatcgtgatgacccagtctccagacctccctggctgtgtctcgtgggcgagccgggccaccatcaactgcaagtccagccanaattcttttanactagttccaaanatagaaactctagcttaggtaccagcagacaccaggacagcctcaggctgctcatttacgnggactacgtccgtaccggtacgtccggtaccctacgacgtagtcgaggtcgcgtcggtcgggtacgtagggtactagttacttacgaccttcctacctaacctacgtacgacgtaccgtacgccgtacgaccgtaacgtacgtaagtaacgttagttacgggggtacggttacgtttaacgttttaacgtttagttaccgtaaacgttaaacttaaatttaacgttttaacgttaacgtttaccggtttacgggttaacgggttaaccgggtttaccgggaccggttaaacgggtaaccggttaaagggttacgttaaacgttacgtaacggtaacgtaacgttacggttacgggttacgtaaccgttcgaacccg

SEQ ID NO: 429895 - DNA, 798 bp, Homo sapiens
  misc_feature: GZ8MTXP01BKRI1.19.71.G05.1.454.CMB.2.raw
  modified_base (754)..(754): a, c, t, g, unknown or other
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgcccgtgctcgggccctcccacaaggtgtcctgtcacaagtacagctgcagcagtcaggtccaggactggtgaacgccccgtcgaccagtacccctctcgacctcgaccgtgtcgacctagtccgtaccggggacaggacgtcgcgtagcgactaggttgttggacgttggcgtaacggtcggggtacacggcctaacgttccccaagtcggaaggtacggttacgtaaggtaggtacgggacgttaacgggggaaaggtaaccttaagtttaattttacgaacgttaccggtaaacccttaaacggaccggttaaagggtaaactttaaaaccgtaaaaaagttttctaacggtaacctaacccgttaattccgttaggtttagggaacgtaagggttaccgtaacgttaacggaaactaaacttaaacgaaaccggttaaaacaaccgtaaacggtaaacggtaaacggtaaaacccgtaaacccgtttacgtttaccccgtaccgtacgtaccgtacgttacccgtaccgttaaccgttaccggttcggtaaccggttacccgggtaccgggaaacggtaacggtaacgggtttagttaaacgtttagtttaacggngggtaaccggtaaaccggtacccgacccgtaagttaacgtaacg

SEQ ID NO: 429896 - DNA, 608 bp, Homo sapiens
  misc_feature: GZ8MTXP01APW7E.19.71.G05.1.454.CMB.2.raw
  modified_base (240)..(240): a, c, t, g, unknown or other
  modified_base (253)..(253): a, c, t, g, unknown or other
  modified_base (320)..(320): a, c, t, g, unknown or other
tcagtactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgaactgcaagtccagaccacaatcttttaanacgagtaccaaanaatataaactactagtctagacagacagacgaccgagacagcctaccgtagctgctactagttacgnggctactaccgtaccggacgtccgggtcctacgaccgtatcgagtcggaacgacggtcgggtacgtacggggactagtactttacactctaccacatcagcagcgtacgacgtacgagtagaagagtgtgggtacgttagtttaattagttacaactaaactaaattaattaattaacttaacgttacgtacggtaacggtacgttaccggtaaacggaaacggtaacggtaaggttagttacgttacgaacgtaacgtaacgtacgtacgttacgtcgaacgtaacc

SEQ ID NO: 429897 - DNA, 570 bp, Homo sapiens
  misc_feature: GZ8MTXP01BBNM1.19.71.G05.1.454.CMB.2.raw
  modified_base (349)..(349): a, c, t, g, unknown or other
  modified_base (403)..(403): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatctccggggacagagtcgctagcgactagtgtgcttggcacgtggtcaggcacgtcccatcgagagtctaggagtggctagggaagactatacgtttcagttgacaaacgacgtagaaactacgtaaaattntcgacaactaattcgtgttagagtacgtacgtactagaacaatactaacggaanacaacagtaacgaacgtaactactacctaccgtagacgtacgtcgtacgtactcgtacgtacgaccgacgacggtacgtacggtatacttacgtagtgtacggacgtaccgaccgtaagaacacgttcgcgcctaccttcgtaccgttgttcggtcgttaacgtaag

SEQ ID NO: 429898 - DNA, 543 bp, Homo sapiens
  misc_feature: GZ8MTXP01DR99N.19.71.G05.1.454.CMB.2.raw
  modified_base (206)..(206): a, c, t, g, unknown or other
  modified_base (223)..(223): a, c, t, g, unknown or other
  modified_base (301)..(301): a, c, t, g, unknown or other
  modified_base (308)..(308): a, c, t, g, unknown or other
  modified_base (331)..(331): a, c, t, g, unknown or other
  modified_base (340)..(340): a, c, t, g, unknown or other
  modified_base (343)..(343): a, c, t, g, unknown or other
  modified_base (348)..(348): a, c, t, g, unknown or other
  modified_base (350)..(350): a, c, t, g, unknown or other
  modified_base (357)..(357): a, c, t, g, unknown or other
  modified_base (372)..(372): a, c, t, g, unknown or other
  modified_base (377)..(377): a, c, t, g, unknown or other
tcagtactctcgtgcacgaccggtgctcgatttagtgtcgtcgcaagagagaggggggcagagtctgctgaattctggctggaccagggcagtcaccagagctccagacaatgtctgtctccttcctcttcttcctgcccgtgctggggcctcccacaaggtgtcctgtcacaagtacagctgcagcagtcaggtcaggactggtnaagccctgcagaccctntcgctcacctgtgccatctcggggacagagtcgctagcgacagtgttgcttggcactgggcaggcagtccccatcganaggtcanagtgctggaggacatattcaatncacagaganaanaatananacacatntgtgtagagtacganagaanaactaacaacgtaagaacgaactaacacgaaacgaaacgtaacgttcctccgtacacgtacgactacgtacctaacgtcgttacgtaccgaccgaacggtaacgacgggttcgttacgttaacttacgttaacggtacggtaacggaccgtaacccgaacgtaacg

SEQ ID NO: 429899 - DNA, 656 bp, Homo sapiens
  misc_feature: GZ8MTXP01CPIR3.19.71.G05.1.454.CMB.2.raw
  modified_base (224)..(224): a, c, t, g, unknown or other
  modified_base (252)..(252): a, c, t, g, unknown or other
  modified_base (277)..(277): a, c, t, g, unknown or other
  modified_base (285)..(286): a, c, t, g, unknown or other
  modified_base (613)..(613): a, c, t, g, unknown or other
  modified_base (649)..(649): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatcgacccagtctccagacctccctggctgtgtctcgtgggcgaggcgggccaccatcaatgacaagtccanccaactatctttaacacttcaacaatanaaactactagcttggaccagcaagnaccagacnncctcagctagctactattacgtggacacgtaccgaaccgggatcccggggtccccacggaccgtattccgagttcgggctaacgggtcgggtagaggggtacagtacgtttacacttctaccgacactacgacgacgtagccctaaggacgtacggccgtaaggaacgagtttcgggggtaaggtacgtttagttttaattaacggtttacaaacccggttaaattaaacgttaactttaaatttaaacgttaaccgttttccggggttaaggtaaaccccgggtttcggaaacccggttaaacggggaaacgttagggttaaccgnttaaacgtaacgacgtaaacgtcgttagcgggtccngtaaccg

SEQ ID NO: 429900 - DNA, 221 bp, Homo sapiens
  misc_feature: GZ8MTXP01CVU14.19.71.G05.1.454.CMB.2.raw
  modified_base (219)..(221): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggctggcaaggcgcatagnnn

SEQ ID NO: 429901 - DNA, 707 bp, Homo sapiens
  misc_feature: GZ8MTXP01C8122.19.71.G05.1.454.CMB.2.raw
  modified_base (244)..(244): a, c, t, g, unknown or other
  modified_base (330)..(330): a, c, t, g, unknown or other
  modified_base (394)..(394): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctcctggctgtgtctcgtgggcgagccgggccacatcaactgacaagtccagccaactaattctttaanactagttaccaaacaatagaaaactctagcttaggaccagacagacgaccaggacagccctacgtaggactgcttactatttacgngggctacgtaccgtaacccggggactccccggggtccccccaggacctattccgaggtgggacngggcgggtctaggggactagtactttcactactacaccatcacgcagtccctgacgagcctagaaagtagtcggggtagggtacttaaggttttaatacgtttacgtaacctaaaacgttaaatttaattttaaacgttactttaaacccgttttaggggtaacccgggttaaaccgggttttacccggggaaacccggttaaaaccgggggtaacccggtaaaagggggttacgggttaaattaacgttaaccggaaaaccgggttaacggtaaaaccggttgggttacggggtaacccttcgggtaaaccc

SEQ ID NO: 429902 - DNA, 578 bp, Homo sapiens
  misc_feature: GZ8MTXP01BNC4U.19.71.G05.1.454.CMB.2.raw
  modified_base (268)..(268): a, c, t, g, unknown or other
  modified_base (420)..(420): a, c, t, g, unknown or other
  modified_base (438)..(438): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgccagaccctctcgctcacctgtcgccatcgtccggggacaggagtcgctagcgacngtgttgctggcatcggtcaggcagtccccatcggagacggtcgtagagtggacgtggggaaacgactattactttcataacgtaccaacgaacgtagggaaacttacaaaatatgacaccatcgtgttgagacgtcgaactgaacaacgtanaacgtacgaacaccgaanaaccgtaagaaccctaacgttcaccctcgcactctccgtaaaccttcaacgttgaccgttacccggagaaccgggaacgggttgttaccgttagtttaagtcgtaagggtaaaccggcgttacccccgtaagttcgaacg

SEQ ID NO: 429903 - DNA, 585 bp, Homo sapiens
  misc_feature: GZ8MTXP01B4S5M.19.71.G05.1.454.CMB.2.raw
  modified_base (229)..(229): a, c, t, g, unknown or other
  modified_base (239)..(239): a, c, t, g, unknown or other
  modified_base (250)..(250): a, c, t, g, unknown or other
  modified_base (253)..(253): a, c, t, g, unknown or other
  modified_base (364)..(364): a, c, t, g, unknown or other
  modified_base (550)..(550): a, c, t, g, unknown or other
tcagtactctcgtgcacgaccggtgctcgatttagtgtcgtcgcaagagagaggggggaggtacaacaggcaggcaggggcagcaagatggtgttgcagaccccaggtcttcatttctctgttgctctggatctctggtgccccaggggacatcgtgatgacccagtctccagactccctggctgtgtctctgggcgagcgggccacgatcaactgcaagtccagccanaatcttttanacagttccaanatnaaaactacttagctgtaccagcagagaccaggacagcctcctaggctgctcgatttacgtgggactatctaaccggggaatccggggtaccccctggaccgatccagtgcngcgggtctgggacagacttcactctcaccagtcagctaagcctgacagggctagaaagtgtaggtggtactaaggtttataaatttcgaacctaaataaagttatttaattacttaacgtttccgggtggtaaacgtttcggggacccttaaaggggacccgtaaaggttggattacgttaacganaaccgggtaaacttggttacggtaacttggtaacc

SEQ ID NO: 429904 - DNA, 677 bp, Homo sapiens
  misc_feature: GZ8MTXP01ECQE9.19.71.G05.1.454.CMB.2.raw
  modified_base (245)..(245): a, c, t, g, unknown or other
  modified_base (333)..(333): a, c, t, g, unknown or other
  modified_base (375)..(375): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgacaagtccagccactaattcttttaanacagttaccaaactaatagaaaactactagcttacggtaccagacaagacgaccaggacagcctaccgtaggctgctactatttacgnggctataccgtaaccgggatccccggggtccctaggaccgtnttcgaggtcgacaagggcgggtcgtgggactagtactttcactctacacctatcaagcacgccgtagccgaagcgtagaaagtgttacggggtaggtacttaagttttactagttacgtaaacctaaactaaattttatttaaactttaacgttaaccgtttcgggtaacggtaaccggtttaccggggaaacccgttaaaacggggtaacccgtaaaaaggggttcggttaaaattacgttaacccgaagggttaaaccggtaaacgttcggggttacggtaacccgttaacgtaaccccg

SEQ ID NO: 429905 - DNA, 506 bp, Homo sapiens
  misc_feature: GZ8MTXP02GS5Y2.19.71.G05.1.454.CMB.2.raw
  modified_base (207)..(207): a, c, t, g, unknown or other
  modified_base (227)..(227): a, c, t, g, unknown or other
  modified_base (239)..(239): a, c, t, g, unknown or other
  modified_base (251)..(251): a, c, t, g, unknown or other
  modified_base (256)..(256): a, c, t, g, unknown or other
tcagtactctcgtgcacgaccggtgctcgattagtgtcgtcgcaagagagagggaggtacaacaggcaggcagggcagcaagatggtgttgcagacccaggtcttcatttctctgttgctctggatctctggtgcccacggggacatcgtgatgacccagtctccagactccctggctgtgtctctggggcgaagcggggcctacgntacgacgtgacaaggtccancactatctttanacgattccaaanaatanaactactatactcgtacacgacagagacgacgacgacgacctcctacgcgtcgctctacttacgtacggtcgtactacgtaccggtaaccggtaccggtccccgtccgaccgtacgtactacgtcggcgcgcgggtcggtcggacgacgtacgtactactctcctaccactacacgacgacgccgtcgcgacgacgtacgagagtagtgtagtagttagttattagtactaactaataattaattattac

SEQ ID NO: 429906 - DNA, 545 bp, Homo sapiens
  misc_feature: GZ8MTXP02F1O5V.19.71.G05.1.454.CMB.2.raw
  modified_base (241)..(241): a, c, t, g, unknown or other
  modified_base (255)..(255): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggggctacggatacgactgactaaggtcagccaacattcttanacatacaacaatanaaactactatctgtacagcagagacagacacgcctcctacgctgctctactttacgtcggcactaccgtaccggtacgtccgggtccccgtcgaccgtacgtacgtagtcggcgcggcgggtcggtcggacgagtattactactctcaccactacacgacgacgcctcgacgacgacgtagaagagtgtggtacgtagtttagttattacgtactaactaattaattaattaattacgttacgttacggtacgttacggtaccggtaacggtaacgtaacggtacggtag

SEQ ID NO: 429907 - DNA, 594 bp, Homo sapiens
  misc_feature: GZ8MTXP02GPDBX.19.71.G05.1.454.CMB.2.raw
  modified_base (237)..(237): a, c, t, g, unknown or other
  modified_base (321)..(321): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatcttttaanactagttaccaacaatagaaaactactagcttagaccagacagacgaccaggacacgcctacctaggctgcctactatttacgngggacactaccgtaacccggggaagtcccggggtcctcggaccgtattcgaggtcggacagggccggggtctggggacagtacttcactctacaccatcagacacgcgtcgcgacgacgtagaagagtagtaggtacgtagtttagttagttagtactaaactaaattaattaatttaattacgttacgttacggtacggttacggtaccgtaacggtaacgtaacggtacgtacgtaatacgaagaacgaacgtacgtagtacgtacgacac

SEQ ID NO: 429908 - DNA, 553 bp, Homo sapiens
  misc_feature: GZ8MTXP02FXW80.19.71.G05.1.454.CMB.2.raw
  modified_base (231)..(231): a, c, t, g, unknown or other
  modified_base (307)..(307): a, c, t, g, unknown or other
  modified_base (357)..(357): a, c, t, g, unknown or other
tcagtactctcgtgcacgaccggtgctcgatttagtgtcgtcgcaagagagagggggtacaacaggcaggcagggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatctttanacagttccaacaatgaaaactacttagcttggtaccagcagagaccaggacagcctcctaggctgctcatttacgnggcatcgtaccggagtccgggtcctcgaccgatcgagtggcagcgggtcngggacagtattcactctcacatcagcacgcctgcgaggctagaagtagtggtggactagtttattagttagtactaaactaattattattatacgtttacggtacggtacgttcggaaccgtaaacggggaaccgtaaagggtacgtaaactacgtacgaagtaaacgtaacgtcggtacggacgtacgacgtacg

SEQ ID NO: 429909 - DNA, 625 bp, Homo sapiens
  misc_feature: GZ8MTXP02IM01R.19.71.G05.1.454.CMB.2.raw
  modified_base (228)..(228): a, c, t, g, unknown or other
  modified_base (236)..(236): a, c, t, g, unknown or other
  modified_base (245)..(245): a, c, t, g, unknown or other
  modified_base (250)..(250): a, c, t, g, unknown or other
  modified_base (267)..(267): a, c, t, g, unknown or other
  modified_base (269)..(269): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcctacgatacgactgactaagtccagccanatctttanacatccaanaatanaactactatctgtacananagacgacgacgacacgcctcgtacgcgtcgtctactacttacgtcggtactacgtaccgtaccggtaccggtccggtccgtaccgtaccgtacgtcgtacgtcggcgacggtcgggtcggtcggacgtacgtacttactactcctacctacactacacgacgacgtcgtcgacgacgacgtagaagtagtaggtcggtacgttagtttagtttacgttacgtactaaactaattaatttaattaatttacgttacgttacggttacggttacggtaccggtaacggtaacggtaacggtacgtaacgtaacgtacgtaacgtaacgtaacgtacgtacggtacgtacgtacgtacg

SEQ ID NO: 429910 - DNA, 603 bp, Homo sapiens
  misc_feature: GZ8MTXP02GOMNC.19.71.G05.1.454.CMB.2.raw
  modified_base (239)..(239): a, c, t, g, unknown or other
  modified_base (250)..(250): a, c, t, g, unknown or other
  modified_base (318)..(318): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatcttttaanacattaccaanaatagaaactactagcttagtaccagcagacgaccaggacagtcctcgtaggctgctactatttacgngggcactccgtaacccggggagtcccggggtcctacggaccgtattcgaggtcggacagggtccggggtctaggggactagtactttcactctccaccatcgagcacgcctcgcgacgacgtagaagtagtaggtggtacgttagtttatttattagtactaaactaaattaatttaattaattacgttacgttacggtacggttacggtaccggtaaacgggtaacggaacggtacggtacgtagtacgtaacgaacgtaacgtacggtaggtacgtacgacac

SEQ ID NO: 429911 - DNA, 531 bp, Homo sapiens
  misc_feature: GZ8MTXP02FR4L1.19.71.G05.1.454.CMB.2.raw
  modified_base (234)..(234): a, c, t, g, unknown or other
  modified_base (242)..(242): a, c, t, g, unknown or other
  modified_base (246)..(246): a, c, t, g, unknown or other
  modified_base (297)..(297): a, c, t, g, unknown or other
  modified_base (344)..(344): a, c, t, g, unknown or other
  modified_base (406)..(406): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcagcgggccacatcaactgcaagtccagccacaatctttanacatcaanatanaaactactagctgacagcagagacagacagcctctagctgctcatttacgnggcatccgtaccgggatccggggtcccctgaccgtatcgagtcggcnggcgggtcgtgggacagtatttccactctacaccatcagcacgcctgcgaggctagaaagtntggtaggacttagttttattagttcgtacaaactaattattaagttaatacgttcgtacggtacgttcggaccgaaagggtactaaggtacgatagtaacgacgacgacgtagtacgcgtacgcg

SEQ ID NO: 429912 - DNA, 548 bp, Homo sapiens
  misc_feature: GZ8MTXP02ILI5C.19.71.G05.1.454.CMB.2.raw
  modified_base (239)..(239): a, c, t, g, unknown or other
  modified_base (343)..(343): a, c, t, g, unknown or other
  modified_base (376)..(376): a, c, t, g, unknown or other
  modified_base (543)..(548): a, c, t, g, unknown or other
tcagtactctcgtgcacgaccggtgctcgatttagtgtcgtcgcaagagagagggggcacttctccctctaacactctccccagtctccagactccctggctgtgtctctgggcgagccgggccaccgatacgaactgacaagtccagccacaatcttttatacagttccaacaatgaaaactacttagcttggtaccagcagagaccaggacagcctcctaggctgctcattttacgnggcatccgtacccgggagtcccggggtccctgaccgattcagtggcaggcgggtctgggacagtatttccactctcaccatcgagcagcctgcaggctagaagntggtgacttagtttattatgtacaaataatttntttattattacgttcgtaggtacgttcggacgaaagggaccaaagggtgaatatacgagacgaacgtagtgcgtgacacactctcttcttctactcctcccgtcctctctacgacgacgacgtacgtacgtagacggcggcggtacggacgacggacgaacgagagnnnnnn

SEQ ID NO: 429913 - DNA, 512 bp, Homo sapiens
  misc_feature: GZ8MTXP02F4FT8.19.71.G05.1.454.CMB.2.raw
  modified_base (238)..(238): a, c, t, g, unknown or other
  modified_base (312)..(312): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctctaggctgctcatttacngggcatctaccgggatccccggggtcctgaccgattcagtggcagcgggtctgggacagatttcactctcaccatcagcagcctgcaggctagaagatgtggctagtttatattgtacaaactaatattattatacttcgtaggacgttcggaccaaagggacctaaaggtggataagtacaagacgaacgtgtggctag

SEQ ID NO: 429914 - DNA, 514 bp, Homo sapiens
  misc_feature: GZ8MTXP02HAJIW.19.71.G05.1.454.CMB.2.raw
  modified_base (237)..(237): a, c, t, g, unknown or other
  modified_base (359)..(359): a, c, t, g, unknown or other
  modified_base (413)..(413): a, c, t, g, unknown or other
  modified_base (416)..(416): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtccccctgaccgattcagtggcngcgggtctggggacagatttcactctcaccatcagcagccctgcaggctgaagntgnggctagtttatattgtacaactaattattattataacttcgtggtacgttcggaccaaagggaccaagggtgatatcgagacgaactgtacggctgac

SEQ ID NO: 429915 - DNA, 584 bp, Homo sapiens
  misc_feature: GZ8MTXP02JF0A9.19.71.G05.1.454.CMB.2.raw
  modified_base (234)..(234): a, c, t, g, unknown or other
  modified_base (243)..(243): a, c, t, g, unknown or other
  modified_base (247)..(247): a, c, t, g, unknown or other
  modified_base (301)..(301): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcagcgggcacgatacgactgacaagtccagccacaatcttttanacatacaanatanaaattactagcttgacagcagagacagacacgcctctagctgctctatttacgnggacatccgtaccggacgtccggggtcccctacgaccgtattcgacgtcggcgcggcgggtcgtcggacgagtattactactctacaccactacacgacgacgccgtcgacgacggacgtacgaagagtaggtaggtacgtagtttagtttattacgtactaactaattaattaattaattacttacgttacggttacggttacggtaccggtaaacggtaaacgtaacggtacggtagtacgtaacgtaacgaacgtaacgtacgtacggtacgtacgtacg

SEQ ID NO: 429916 - DNA, 540 bp, Homo sapiens
  misc_feature: GZ8MTXP02FV6H5.19.71.G05.1.454.CMB.2.raw
  modified_base (315)..(315): a, c, t, g, unknown or other
  modified_base (366)..(366): a, c, t, g, unknown or other
  modified_base (396)..(396): a, c, t, g, unknown or other
  modified_base (400)..(400): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgaactgacaagtccagccacaatctttatacagttccaacaatgaaaactacttagcttggtaccagcagagaccaggacagcctcctaggctgctcatttacgnggcacgtccgtaccggtacgtccggggtcccctgaccgtatcgagtcggcnggcgggtcgtgggactagtactttcactcncacntcagcacgctgcgagcgtagagagtgtgtagtagtttattattagtactaataattattattatacgttacgtacggtacgtacggtacgaacggaacgacgtacgtagtactaacgacgacgtacgtagtcgcgtcgcg

SEQ ID NO: 429917 - DNA, 606 bp, Homo sapiens
  misc_feature: GZ8MTXP02IHU1O.19.71.G05.1.454.CMB.2.raw
  modified_base (227)..(227): a, c, t, g, unknown or other
  modified_base (236)..(236): a, c, t, g, unknown or other
  modified_base (244)..(244): a, c, t, g, unknown or other
  modified_base (248)..(248): a, c, t, g, unknown or other
  modified_base (254)..(254): a, c, t, g, unknown or other
  modified_base (257)..(257): a, c, t, g, unknown or other
  modified_base (301)..(301): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcacgatacgactgcaagtccagccanatcttttanacatcaanatanaaactntanctgacagcagacgacagacagcctcagctgctactactttacgnggacagtaccgtaccgggtacgtcccggggtcccctacgaccgtattcgaggtcggacgcgggtcgggttcgtaggggactaggtactttccacttctacacctatacacgacgacgccgtcgcgacgacgtagagtagtgtggtacgttagtttatttagttacgtactaactaattaatttaatttaactttacgtttacgttacggttacggttaccggtaccggtaaacgggtaacggtaacgggtacggtaagtaacgtaacgtaacgtaacgtaacgtacggtacggtacgtacgtacg

SEQ ID NO: 429918 - DNA, 591 bp, Homo sapiens
  misc_feature: GZ8MTXP02GOOUV.19.71.G05.1.454.CMB.2.raw
  modified_base (237)..(237): a, c, t, g, unknown or other
  modified_base (319)..(319): a, c, t, g, unknown or other
  modified_base (374)..(374): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatcttttaanacagttccaacaatagaaaactacttagcttaggtaccagcagacgaccaggacacgcctccgtaggctgctctatttacgngggcatccgtacccgggaacgtcccggggtcccctgaccgtattcgaggtcggcnggcgggtcgtgggacagtatttcactctcaccatcacgcacgccgtcgcgacgacgtagaagagtaggtggtacgtagtttatttagttagttactaactaaattaattaattaattacgttacgttacggtacggttacggtaccggtaacggtaacggtaacggtacggtagtagtaacgtaacgaacgtaacgtaggtacggtacgtacgtacg

SEQ ID NO: 429919 - DNA, 237 bp, Homo sapiens
  misc_feature: GZ8MTXP02HE68W.19.71.G05.1.454.CMB.2.raw
  modified_base (217)..(237): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccaggggacatcgtgatgacccagtctccagactccctggctgtgtctctgggcgagcgggctggcaaggcgcatagnnnnnnnnnnnnnnnnnnnnn

SEQ ID NO: 429920 - DNA, 601 bp, Homo sapiens
  misc_feature: GZ8MTXP02J26HM.19.71.G05.1.454.CMB.2.raw
  modified_base (235)..(235): a, c, t, g, unknown or other
  modified_base (250)..(250): a, c, t, g, unknown or other
  modified_base (312)..(312): a, c, t, g, unknown or other
  modified_base (356)..(356): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgcccacggggacatcgtgatgacccagtctccagactccctggctgtgtctctgggcagcgggccacgatacgactgactaagccagccacaatcttttanacagttccaacatanaaactacttagcttgaccagcagacgaccaggacagccctcgtaggctgctactatttacgngggacactccgtaacccgggacgtcccggggtcctacgaccgtnttcgagtcgcagcggtcgtcggacgagtattactactctaccaccactacacgacgacgcgtcgacgacgtacgtacgaagtagtagtcggtacgtagtttattagttacgtactaactaaattaattaatttaattacgttacgttacggtacggttacggtaccggtaacggtaacggtaacggtacggtaacgtaacgtacgtaacgtaacgtaacgtacgtacggtacgtacgtacgtacg

SEQ ID NO: 429921 - DNA, 540 bp, Homo sapiens
  misc_feature: GZ8MTXP02F2J22.19.71.G05.1.454.CMB.2.raw
  modified_base (238)..(238): a, c, t, g, unknown or other
  modified_base (313)..(313): a, c, t, g, unknown or other
  modified_base (357)..(357): a, c, t, g, unknown or other
  modified_base (405)..(405): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctggggcgagcgggccacgatcgaactgcaagtccagccacaatctttanacagttccaacaatgaaaactacttagcttggtaccagcagagaccaggacagcctcctaggctgctcatttacngggcatctaccggaatccggggtcccctgaccgattcagtggcngcgggtctggggacagatttcactctcaccatcagcagcctgcagcgngagatgtgtgtagttattattagtactaactaataattattattacgttacgtacggtacgttacggtacgtaacggtaacgtaacggtacggtagtagtaacgtacgaacgtacgtagtacggtacgtacgtcg

SEQ ID NO: 429922 - DNA, 510 bp, Homo sapiens
  misc_feature: GZ8MTXP02FZ35H.19.71.G05.1.454.CMB.2.raw
  modified_base (312)..(312): a, c, t, g, unknown or other
  modified_base (357)..(357): a, c, t, g, unknown or other
  modified_base (411)..(411): a, c, t, g, unknown or other
  modified_base (417)..(417): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttatacagttccaacaatgaaaactacttagcttggtaccagcagagaccaggacagcctcctaggctgctcatttacngggcatctaccgggaatccggggtcccctgaccgattcagtggcngcgggtctgggacagatttcactctcaccatcagcagcctgcaggctgaaagtntggtgntagtttatatgtacaaataattattattatacgttgtaggtacgttcggacgaaagggactaaggtagatagcgaagacgtaactgcgctagc

SEQ ID NO: 429923 - DNA, 503 bp, Homo sapiens
  misc_feature: GZ8MTXP02F010I.19.71.G05.1.454.CMB.2.raw
  modified_base (236)..(236): a, c, t, g, unknown or other
  modified_base (310)..(310): a, c, t, g, unknown or other
  modified_base (354)..(354): a, c, t, g, unknown or other
  modified_base (431)..(431): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctctaggctgctcatttacngggcatctaccgggaatccggggtcccctgaccgattcagtgcngcgggtctgggacagatttcactctcaccatcagcagcctgcaggctgaaagatgtggctagtttatattgtcaaanaatatattatacttcgtagacgttggacctaaagggaccaaaggtgataagtcagacgaacagtgcgtgacg

SEQ ID NO: 429924 - DNA, 615 bp, Homo sapiens
  misc_feature: GZ8MTXP02IIHXT.19.71.G05.1.454.CMB.2.raw
  modified_base (238)..(238): a, c, t, g, unknown or other
  modified_base (247)..(247): a, c, t, g, unknown or other
  modified_base (252)..(252): a, c, t, g, unknown or other
  modified_base (271)..(271): a, c, t, g, unknown or other
  modified_base (283)..(283): a, c, t, g, unknown or other
  modified_base (285)..(285): a, c, t, g, unknown or other
  modified_base (287)..(287): a, c, t, g, unknown or other
  modified_base (293)..(294): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccacgatacgaactgactaagtccagcacaatctttanacatacaanaatanaaactactatctagtacanacagagacaganancnctagcnnctctattacgtggactactacgtaccggacgtaccggtccgtaccgacgtactacgagtgcgacgcggtcgtcggacgagtacttactactactaccaccactacgacgacgacgcgtacgacgacgacgtagaagtagtaggtaggtacgttagtttaagtttagttagtaactaaactaaattaatttaatttaacttaacgttacgttacggttacggttaccggtaccggtaaacggtaaaccggtaaacggtacggtaacgtaacgtaacgtaacgtaaacgtaaacgtacggtacggtacgtacgtacgtaaccg

SEQ ID NO: 429925 - DNA, 500 bp, Homo sapiens
  misc_feature: GZ8MTXP02F1YG8.19.71.G05.1.454.CMB.2.raw
  modified_base (246)..(246): a, c, t, g, unknown or other
  modified_base (255)..(255): a, c, t, g, unknown or other
  modified_base (259)..(259): a, c, t, g, unknown or other
  modified_base (268)..(268): a, c, t, g, unknown or other
tcagtactctcgtgcacgaccggtgctcgatttagtgtcgtcgcaagagagagggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggggcctacgactacggactcgactaagtccagccacaatctttanacagtcaanatanaactactanctagtacagacagagacagacacgctctacgctcgctctattacgtggacgtactacgtaccggtacggtaccccggtcccgtacgacgtactacgtacgtcggcgacggcggtcggtacggacgagtacttactactactaccaccactacacgacacgcgtcgacgacgacgtagaagtagtaggtaggtacgttaagtttaattagttacgttaactaaacggttaggt

SEQ ID NO: 429926 - DNA, 505 bp, Homo sapiens
  misc_feature: GZ8MTXP02GV708.19.71.G05.1.454.CMB.2.raw
  modified_base (237)..(237): a, c, t, g, unknown or other
  modified_base (358)..(358): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagagaccaggacagcctcctaggctgctcatttactgggcatctacccgggaatccggggtcccctgaccgattcagtgcngcgggtctggggacagatttcactctcaccatcagcagccctgcaggctagaaagatgtggctagtttatattgtacaactatattattatacttcgtagacgttcgaccaaagggaccaaggtgatatcgagacgactgcgctgac

SEQ ID NO: 429927 - DNA, 506 bp, Homo sapiens
  misc_feature: GZ8MTXP02IYVM4.19.71.G05.1.454.CMB.2.raw
  modified_base (237)..(237): a, c, t, g, unknown or other
  modified_base (312)..(312): a, c, t, g, unknown or other
  modified_base (358)..(358): a, c, t, g, unknown or other
  modified_base (413)..(413): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacngggcatctacccgggaatccggggtcccctgaccgattcagtggcnggcgggtctggggacagatttcactctcaccatcagcagcctgcaggctgaaagntgtggctagtttatatgtacaatatattattatacttcgtaggacttcggactaaagggacaaggtgatagtcgagacgaactgtagctgacc

SEQ ID NO: 429928 - DNA, 589 bp, Homo sapiens
  misc_feature: GZ8MTXP02GCXQH.19.71.G05.1.454.CMB.2.raw
  modified_base (239)..(239): a, c, t, g, unknown or other
  modified_base (249)..(249): a, c, t, g, unknown or other
  modified_base (253)..(253): a, c, t, g, unknown or other
  modified_base (311)..(311): a, c, t, g, unknown or other
  modified_base (376)..(376): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatcttttanacattccaanatanaaactactagcttgtaccagcagagaccaggacagcctctaggctgctctatttacgngggactacgtaccgtaacccggggtaacgtcccggggtccccctacgaccgtattcgagtcggcnggcgggtcgtgggacagtactttcactctacaccatcagcacgctcgcgacgacgtagaagagtgtgtagtagtttattattagtactaactaattaattaattaattacgttacgttacggtacggttacggtaccggtaaacggtaacggtaacggtacggtaagtaagtaacgtaacgtaacgtaacgtacggtacggtacgtacgtacg

SEQ ID NO: 429929 - DNA, 584 bp, Homo sapiens
  misc_feature: GZ8MTXP02G3URL.19.71.G05.1.454.CMB.2.raw
  modified_base (237)..(237): a, c, t, g, unknown or other
  modified_base (313)..(313): a, c, t, g, unknown or other
  modified_base (359)..(359): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacgnggcatccgtaccggagtccgggtcccctagacctatcgagtcggcnggcgggtctgggacagtacttcactctacacatcagcacgcctacgcgacgacgtagaagtagtagtggtacgtagtttatttattagttactaaactaaattaatttaatttaattacgttacgttacggtacggttaccggtaccggtaaacggtaaaccggtaacggtacggtaagtaagtaacgtaacgtaacgtaacgtacggtacggtacgtacgtacg

SEQ ID NO: 429930 - DNA, 613 bp, Homo sapiens
  misc_feature: GZ8MTXP02IJ7U0.19.71.G05.1.454.CMB.2.raw
  modified_base (222)..(222): a, c, t, g, unknown or other
  modified_base (231)..(231): a, c, t, g, unknown or other
  modified_base (242)..(242): a, c, t, g, unknown or other
  modified_base (306)..(306): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgcccacggggacatcgtgatgacccagtctccagactccctggctgtgtctctgggcgaggcggcacatcaactgcaagtccagccanaatctttanacagttccaanaatgaaactacttagcttggtaccagcagagaccaggacagcctcctaggctgctcatttacgnggcatcgtaccggacgtccgggtcctcgaccgtatcgagtggcgacggcggggtcagggactagtacttcacttctacacatcacgcacgtcctacgacgacgacgtacgagtagtaggtacggtacgttagtttagtttagttagttacgtaaactaaattaatttaatttaactttacgtttacggttacggttacggttaccggtaaccggtaaacgggtaaaccggtaaacgggtacggtaacgttaacgtaacgtaacggtaaacggtaacgttacggtacggtacggtacgtacgtaaccg

SEQ ID NO: 429931 - DNA, 499 bp, Homo sapiens
  misc_feature: GZ8MTXP02HGYCH.19.71.G05.1.454.CMB.2.raw
  modified_base (317)..(317): a, c, t, g, unknown or other
  modified_base (386)..(386): a, c, t, g, unknown or other
  modified_base (396)..(396): a, c, t, g, unknown or other
tcagtactctcgtgcacgaccggtgctcgatttagtgtcgtcgcaagagagagggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaagacatattcatgtccaanacgtggaatacaaattatgcaccatctgttgagtagtcgactgacaatacaacgtagacacatacgaanaaccagttcncctgcagctgacctctgtcgactccgaggacgacggtgtatagttactagtggaagacggaccccagtacgacatcgaacctactcgtctcgtggtcgactag

SEQ ID NO: 429932 - DNA, 522 bp, Homo sapiens
  misc_feature: GZ8MTXP02HMVAA.19.71.G05.1.454.CMB.2.raw
  modified_base (335)..(335): a, c, t, g, unknown or other
  modified_base (427)..(427): a, c, t, g, unknown or other
  modified_base (430)..(430): a, c, t, g, unknown or other
  modified_base (437)..(437): a, c, t, g, unknown or other
  modified_base (442)..(442): a, c, t, g, unknown or other
  modified_base (481)..(481): a, c, t, g, unknown or other
  modified_base (517)..(522): a, c, t, g, unknown or other
tcagtactctcgtgcacgaccggtgctcgatttagtgtcgtcgcaagagagagggggcacttctccctctaacactctcccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttacgtggcatccgtacccgggaagtcccggggtccctgaccgattcagtggcaggcgggtctgggacagtatttcactctcaccatcagcagcctgcaggctgaaagntggtggcctagtttattattgtacaaactatattattatacgttgtggtacttcggaccaaagggaccaaggtgatagtcagacgaattggngcngacactntcttntctacactcctccactatctagacacgtagtacgtacgnggacggcgggtactcggacgtacggcgaagagtagnnnnnn

SEQ ID NO: 429933 - DNA, 547 bp, Homo sapiens
  misc_feature: GZ8MTXP02I0G61.19.71.G05.1.454.CMB.2.raw
  modified_base (245)..(245): a, c, t, g, unknown or other
  modified_base (249)..(249): a, c, t, g, unknown or other
  modified_base (255)..(255): a, c, t, g, unknown or other
  modified_base (258)..(258): a, c, t, g, unknown or other
  modified_base (300)..(300): a, c, t, g, unknown or other
  modified_base (356)..(356): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctggggcagcgggccacgatcgaactgcaagtccagccacaatcttttaacatcaanatanaaactntanctgacagcagagacagacagcctctagctgctctatttacgnggctacgtaccgtacccgggaagtcccgggtcccctcgaccgtattcgagtcggcnggcggtctggacagtacttcactctcactatcagcacgcctcgcgagacgtagaagtagtggtacggtacgtagtttatttagttacgtactaactaattaattaattattacttcgttacgtacgtacgtacgtacgtaacggtacgtaacgtagtagtaagtacgacgacgacgtacgtacgtacgtcg

SEQ ID NO: 429934 - DNA, 500 bp, Homo sapiens
  misc_feature: GZ8MTXP02I5V9Z.19.71.G05.1.454.CMB.2.raw
  modified_base (236)..(236): a, c, t, g, unknown or other
  modified_base (308)..(308): a, c, t, g, unknown or other
  modified_base (355)..(355): a, c, t, g, unknown or other
  modified_base (361)..(361): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtccagccacaatcttttanacagttccaacaatgaaaactactagcttggtaccagcagagaccaggacagcctctaggctgctcattacngggcatctaccgggatccggggtcctgaccgatcagtgcagcgggtngggacngatttcactctcacatcagcagcctgcaggctgagatgtggctagtttattattagtacaataatattaattataacttcgtagacgttcggaccaaagggaccaaaggtcgatatacaagtacgaactgtagctgcac

SEQ ID NO: 429935 - DNA, 605 bp, Homo sapiens
  misc_feature: GZ8MTXP02I1QDW.19.71.G05.1.454.CMB.2.raw
  modified_base (227)..(227): a, c, t, g, unknown or other
  modified_base (236)..(236): a, c, t, g, unknown or other
  modified_base (244)..(244): a, c, t, g, unknown or other
  modified_base (248)..(248): a, c, t, g, unknown or other
  modified_base (257)..(257): a, c, t, g, unknown or other
  modified_base (303)..(303): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgacaagtccagccanaatctttanacatcaanatanaaactatanctagtacagacagagaccagacacgcctctagctgctctattacgngggactacgtccgtaaccggacgtcccgggtccacgaccgtatcgagtcggcgagcggtcgtcggacgagtacttctactctaccaccactacacgacacgacgtcgacgacgacgtagaagagtaggtaggtacgttaagtttagtttagttagttaactaaactaaattaatttaatttaacttacgtttacgttacggttacggttacggtaccggtaaacgggtaaacggtaaacggtacggtaacgtaacgtacgtaacggtaacgtaacgtacggtacggtacgtacgtacgtacg

SEQ ID NO: 429936 - DNA, 496 bp, Homo sapiens
  misc_feature: GZ8MTXP02HF2SP.19.71.G05.1.454.CMB.2.raw
  modified_base (235)..(236): a, c, t, g, unknown or other
  modified_base (240)..(240): a, c, t, g, unknown or other
  modified_base (242)..(243): a, c, t, g, unknown or other
  modified_base (249)..(250): a, c, t, g, unknown or other
  modified_base (256)..(257): a, c, t, g, unknown or other
  modified_base (259)..(259): a, c, t, g, unknown or other
  modified_base (261)..(261): a, c, t, g, unknown or other
  modified_base (268)..(269): a, c, t, g, unknown or other
  modified_base (271)..(271): a, c, t, g, unknown or other
  modified_base (273)..(276): a, c, t, g, unknown or other
  modified_base (278)..(279): a, c, t, g, unknown or other
  modified_base (281)..(281): a, c, t, g, unknown or other
  modified_base (284)..(285): a, c, t, g, unknown or other
  modified_base (302)..(302): a, c, t, g, unknown or other
  modified_base (307)..(307): a, c, t, g, unknown or other
  modified_base (309)..(309): a, c, t, g, unknown or other
  modified_base (311)..(311): a, c, t, g, unknown or other
  modified_base (313)..(313): a, c, t, g, unknown or other
  modified_base (315)..(315): a, c, t, g, unknown or other
  modified_base (322)..(322): a, c, t, g, unknown or other
  modified_base (329)..(329): a, c, t, g, unknown or other
  modified_base (342)..(342): a, c, t, g, unknown or other
  modified_base (345)..(345): a, c, t, g, unknown or other
  modified_base (347)..(347): a, c, t, g, unknown or other
  modified_base (349)..(349): a, c, t, g, unknown or other
tcagtactctcgtgcacgaccggtgctcgatttagtgtcgtcgcaagagagagggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcagcgggccaccatcaactgcaagtccagcacatctttanntcanannaatatnntgacannananacagacnncncnnnncnntntgnntctacgacgtcccgtcncgacntngngngngcgtcgngagagtntctctctcacacncancncnctcgcgagcgtagagtagtgtgtagtagttattattatactaactaattaattattattacgttacgttacgttacgttacggtaccgaacggtaacgtaacggtagtagtaagtacgtaacgacgtaacgtacgtacgtacgtacg

SEQ ID NO: 429937 - DNA, 594 bp, Homo sapiens
  misc_feature: GZ8MTXP02GMCBT.19.71.G05.1.454.CMB.2.raw
  modified_base (229)..(229): a, c, t, g, unknown or other
  modified_base (236)..(236): a, c, t, g, unknown or other
  modified_base (244)..(244): a, c, t, g, unknown or other
  modified_base (257)..(257): a, c, t, g, unknown or other
  modified_base (264)..(264): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgacaagtccagccanatcttanacatcaanatagaactactantgtacancagagacagacacgcctctacgctgctctacttacgtggcactacgtaccggtacgtccggtccccgtcgaccgtactcgtacgtcggcgcggcgggtcgtcggacgacgtacttactactctaccaccactacacgacgacgaccgtcgcgacgacgtagaagtagtaggtcggtacgtagtttatttagttacgtactaactaattaattaattaacttacgttacggttacggtacggttaccggtaccggtaaacgggtaacggtaacggtacggtaagtaacgtaacgtaacgtaacgtaacgtacggtacggtacgtacgtacg

SEQ ID NO: 429938 - DNA, 608 bp, Homo sapiens
  misc_feature: GZ8MTXP02IW2NF.19.71.G05.1.454.CMB.2.raw
  modified_base (243)..(243): a, c, t, g, unknown or other
  modified_base (252)..(252): a, c, t, g, unknown or other
  modified_base (257)..(257): a, c, t, g, unknown or other
  modified_base (311)..(311): a, c, t, g, unknown or other
tcagtactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagacctccctggctgtgtctctgggcgaggccgggccacgatcgaactgacaagtccagccacaattctttanacatacaanaatanaaactatagctagacagcagacgacagacacgcctcagctgctactatttacgnggactacgtaccgtaacccgggtacgtccccccggggtaccctacggaccgtacgttcgaggtcggccgacgggtcgggtacgtagggactagtactttccactcctaccacctatacagacacgcctcgacgacgacgtagaagagtagtagtagtagttattagttagtactaactaaattaattaattaacttaacgttacgttacggtacggttacggtaaccggtaaacggtaacgtaacggtaaggtaagtaacgtacgtaacgtaacgtaacgtacgtacggtacgtacg

SEQ ID NO: 429939 - DNA, 598 bp, Homo sapiens
  misc_feature: GZ8MTXP02F02KK.19.71.G05.1.454.CMB.2.raw
  modified_base (239)..(239): a, c, t, g, unknown or other
  modified_base (247)..(247): a, c, t, g, unknown or other
  modified_base (251)..(251): a, c, t, g, unknown or other
  modified_base (257)..(257): a, c, t, g, unknown or other
  modified_base (260)..(260): a, c, t, g, unknown or other
  modified_base (305)..(305): a, c, t, g, unknown or other
  modified_base (368)..(368): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatctttanacatcaanatanaaactntanctgacagcagacgacagacacgcctctaggctgctctatttacgnggactacgtaccgtacccgggaacgtcccggggtcccctacgacccgtattcgaggtcggcgngggcgggtcgtagggactagtactttcactctcacatcagcacgcctcgcgacgacgtagaagagtaggtaggtacgttagtttagtttagttagtactaaactaaattaattaatttaattacgttacggttacggtacggttaccggtaccggtaaacgggtaacggtaacggtacggtaagtacgtaacgtaacgtaacgtaacgtacggtacggtacgtacgtacg

SEQ ID NO: 429940 - DNA, 610 bp, Homo sapiens
  misc_feature: GZ8MTXP02FTF7W.19.71.G05.1.454.CMB.2.raw
  modified_base (238)..(238): a, c, t, g, unknown or other
  modified_base (250)..(250): a, c, t, g, unknown or other
  modified_base (314)..(314): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgaactgacaagtccagccacaatcttttaanacagttaccaanaatagaaactactagcttagtaccagcagacgaccagacagcctcgaggctgctctatttacgngggctacgtccgtacccgggagtcccggggtcctcggaccgtattcgaggtcggcgagggcggggtctgggacagtactttcactctacaccatcagcacgcctcgcgacgacgtagaagtagtagtaggtacgtagtttaatttattagtacgtaaactaaattaatttaatttaattacgtttacgttacggttacggttaccggtaccggtaaacgggtaaccggtaaacggtacggtaacgtaacgtacgtaacggtaacgtaacgtacggtacggtacgtacgacgtaccg

SEQ ID NO: 429941 - DNA, 514 bp, Homo sapiens
  misc_feature: GZ8MTXP02JL14R.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccctcgcagacccctctcgctcacctgtgccatctccggggacagagtcgctagcgacagtgttgcttggcactgggtcaggcagtccccatcgagaggtctagagtggctggggagacatatttcatgtccaaacacgttggaaatacgaaaatttatcgacacccaatctgttagagagtcgactgacaatcaaacgtagacacatacgaagaaccagttctaccctgcagctgacctctcgtacgactcccgaggaccacgggtgtataagttactagtaggaacgacggacccccataacg

SEQ ID NO: 429942 - DNA, 554 bp, Homo sapiens
  misc_feature: GZ8MTXP02J1ZMM.19.71.G05.1.454.CMB.2.raw
  modified_base (239)..(239): a, c, t, g, unknown or other
  modified_base (361)..(361): a, c, t, g, unknown or other
  modified_base (440)..(440): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatctttanacagttccaacaatgaaaactacttagcttggtaccagcagagaccaggacagcctcctaggctgctcatttactgggcatcctacccgggaatccggggtcccctgaccgattcagtggcngcgggtctggggacagatttcactctcacatcagcagcctgcaggctgaagatgtggctagtttattattgtactaaanaattattattattaaccttgtaggtacgttcgggaccgtaaaggggaccctaaagggtcgggtaaattagtaaccgaaggaccggtaaaacgtcggttagggaccttggacccg

SEQ ID NO: 429943 - DNA, 659 bp, Homo sapiens
  misc_feature: GZ8MTXP02HUZ9T.19.71.G05.1.454.CMB.2.raw
  modified_base (241)..(241): a, c, t, g, unknown or other
  modified_base (252)..(252): a, c, t, g, unknown or other
  modified_base (256)..(256): a, c, t, g, unknown or other
  modified_base (262)..(262): a, c, t, g, unknown or other
  modified_base (313)..(313): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacgatacgaactgacaagtccagccacaatcttttanacagtaccaanatanaaactntagctgacagcagacgaccaggacacgcctcgaggctgctactatttacgnggactagtaccgtacccgggagtcccggggtcccctaggacccgtattccgaggtcggcgtcggggtccgggttacgacggggactaggtactttccaaccttcctacctaaccctataccgacgaccgacgtcccgtaggaccgtagggactaggaaacgtagttgggtacggtacgttaagttttattagttacgtaactaaaacttaatttaatttaagtttaagttacgtttacggttacgggttaaccggtttaccgggaaccgtaaacggggtaaaccgtaagggtacgtaattaacgaacgtaacggtaacgtaacgtacggtacggtacgtacgtacg

SEQ ID NO: 429944 - DNA, 497 bp, Homo sapiens
  misc_feature: GZ8MTXP02IE084.19.71.G05.1.454.CMB.2.raw
  modified_base (230)..(230): a, c, t, g, unknown or other
  modified_base (239)..(239): a, c, t, g, unknown or other
  modified_base (250)..(250): a, c, t, g, unknown or other
  modified_base (280)..(280): a, c, t, g, unknown or other
  modified_base (312)..(312): a, c, t, g, unknown or other
  modified_base (378)..(378): a, c, t, g, unknown or other
  modified_base (405)..(405): a, c, t, g, unknown or other
  modified_base (481)..(481): a, c, t, g, unknown or other
  modified_base (496)..(496): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactctctggctgtgtctctggggcgagcgggccacgatacgaactgcaagtccagccanaatctttanacagttccaanaatgaaaactcttagcttggaccagcaganaccaggacagcctcctaggctgctcatttacnggcatccgtaccggatccccgggtccctgaccattcagtgcagcgggtctgggacagatttcactncacatcagcagcctgcagctgaaagtntgttgatagttttatattgtacaataattattattatacttgtgacgttgaccaagggtaccaggtgataatcganacgagtacgtcgcgng

SEQ ID NO: 429945 - DNA, 515 bp, Homo sapiens
  misc_feature: GZ8MTXP02G9KPP.19.71.G05.1.454.CMB.2.raw
  modified_base (238)..(238): a, c, t, g, unknown or other
  modified_base (313)..(313): a, c, t, g, unknown or other
  modified_base (356)..(356): a, c, t, g, unknown or other
  modified_base (408)..(408): a, c, t, g, unknown or other
  modified_base (412)..(412): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacnggcatctacccgggaatccggggcccctgaccgattcagtgcngcgggtctgggacagatttcactctcaccatcagcagcctgcagctgaaagntagnggtctagtttatatgacaatatattattatacttcgtaggtacgttcggaccaaagggacctaaaggtcggaattagtcgaagtaacgacgtgtggctagacc

SEQ ID NO: 429946 - DNA, 631 bp, Homo sapiens
  misc_feature: GZ8MTXP02JZNZW.19.71.G05.1.454.CMB.2.raw
  modified_base (237)..(237): a, c, t, g, unknown or other
  modified_base (248)..(248): a, c, t, g, unknown or other
  modified_base (314)..(314): a, c, t, g, unknown or other
  modified_base (428)..(428): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatcttttaanacattaccaanaatagaaactctagcttagaccagcagacgaccaggacacgcctcgaggctgctactactttacgnggctacgtccgtaaccggggtacgtcccggggtacccctagaccgtacttcgaggtcggcgagggccggggttacgtacggggacaaggttactttccacgttcctaccaaccntacgacggccacgccgtcgacgacggacgtacgaagtagtaggtaggtacgttagtttagtttagttacgtactaaactaaattaatttaatttaacttacgttacgttacggttacggttaccggtaccggtaacggtaacggtaacggtacggtaagtacgtaacgtaacgtaacgtacgtaggtacggtacgtacgtacg

SEQ ID NO: 429947 - DNA, 505 bp, Homo sapiens
  misc_feature: GZ8MTXP02JOJ63.19.71.G05.1.454.CMB.2.raw
  modified_base (228)..(228): a, c, t, g, unknown or other
  modified_base (237)..(237): a, c, t, g, unknown or other
  modified_base (248)..(248): a, c, t, g, unknown or other
  modified_base (311)..(311): a, c, t, g, unknown or other
  modified_base (360)..(360): a, c, t, g, unknown or other
  modified_base (430)..(430): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgacaagtccagccanaatctttanacagttccaanaatgaaaactactagcttggtaccagcagagaccaggacagcctcctaggctgctcatttacngggcatctacccgggatccggggtcctgaccgattcagtgcagcgggtntgggacagatttcactctcaccatcagcagcctgcaggctagaagatgtggctagtttatattgtacaanatattatatacttgtggtacgttcggccgagggaccaaggtcggacttagagaagacgaactggaggtctgcaac

SEQ ID NO: 429948 - DNA, 466 bp, Homo sapiens
  misc_feature: GZ8MTXP02G2CRY.19.71.G05.1.454.CMB.2.raw
  modified_base (204)..(204): a, c, t, g, unknown or other
  modified_base (211)..(211): a, c, t, g, unknown or other
  modified_base (223)..(223): a, c, t, g, unknown or other
  modified_base (230)..(231): a, c, t, g, unknown or other
  modified_base (237)..(237): a, c, t, g, unknown or other
  modified_base (239)..(239): a, c, t, g, unknown or other
  modified_base (241)..(241): a, c, t, g, unknown or other
  modified_base (249)..(249): a, c, t, g, unknown or other
  modified_base (255)..(255): a, c, t, g, unknown or other
  modified_base (257)..(257): a, c, t, g, unknown or other
  modified_base (259)..(259): a, c, t, g, unknown or other
  modified_base (267)..(267): a, c, t, g, unknown or other
  modified_base (269)..(269): a, c, t, g, unknown or other
  modified_base (271)..(271): a, c, t, g, unknown or other
  modified_base (276)..(276): a, c, t, g, unknown or other
  modified_base (278)..(278): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcacgntacgacnactaagcagcanatcttannatcaanananaactatantgacanananagacaganancncagcncnctctatacgtgcactacgtaccgacgtccggtccgtccgacgtactcagtgcgacgcggtcgtggacgagtatactactctacacactacacgacacgacgtcgacgacgacgtagaagtagtagtaggtacgttagtttattagttacgtaacgtaaactaaattaattaattaacgttaacgttac

SEQ ID NO: 429949 - DNA, 531 bp, Homo sapiens
  misc_feature: GZ8MTXP02HQ8YX.19.71.G05.1.454.CMB.2.raw
  modified_base (238)..(238): a, c, t, g, unknown or other
  modified_base (360)..(360): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtccccctgaccgattcagtggcngcgggtctgggaccagatttcactctcaccatcagcagcctgcaggctgaagatgtgctagtttatattgtcaataatattattatacttcgtggtacgtttcggacctaaaggggacctaagggtcggtaatataaccgaaggacgtaaacgtgttacggacttggaccg

SEQ ID NO: 429950 - DNA, 575 bp, Homo sapiens
  misc_feature: GZ8MTXP02HPBBW.19.71.G05.1.454.CMB.2.raw
  modified_base (229)..(229): a, c, t, g, unknown or other
  modified_base (238)..(238): a, c, t, g, unknown or other
  modified_base (246)..(246): a, c, t, g, unknown or other
  modified_base (250)..(250): a, c, t, g, unknown or other
  modified_base (259)..(259): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagccgggccacgatcaactgcaagtccagccanaatctttanacatcaanatanaaactatanctgacagcagagacagacacgcctccgtaggctcgctactatttacgtggctacgtaccgtacccgggacgtcccggggtcccctacgaccgtacttcgagtcggcgcggtcgggtcgtacgggactagtactttcactctacaccatcagcacgcctgcgacggactagaagtagtgtaggtagttagtttattattagtaactaaactaattattaattacttacgttcgttacggtacggttacggaacgtaacgggtaaccgtaaggtacgtaatagtaacgaagtaacgtacgtgtacgtacgtacgtacg

SEQ ID NO: 429951 - DNA, 523 bp, Homo sapiens
  misc_feature: GZ8MTXP02JYU0F.19.71.G05.1.454.CMB.2.raw
  modified_base (238)..(238): a, c, t, g, unknown or other
  modified_base (314)..(314): a, c, t, g, unknown or other
  modified_base (359)..(359): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacctagcttggtaccagcagagaccaggacagcttcctaggctgctcatttacnggcatcgtacccgggatccggggtcccctgaccgattcagtggcnggcgggtctgggacagtatttcactctcaccatcagcagcctgcaggctagaaagatgtggctagtttattattgtacaataatattattatacttcgtaggtacgttacggaccaaatcggaaccgaaggtggaataagtacgagtacgaactggtagctacg

SEQ ID NO: 429952 - DNA, 548 bp, Homo sapiens
  misc_feature: GZ8MTXP02IN433.19.71.G05.1.454.CMB.2.raw
  modified_base (239)..(239): a, c, t, g, unknown or other
  modified_base (317)..(317): a, c, t, g, unknown or other
  modified_base (414)..(414): a, c, t, g, unknown or other
  modified_base (425)..(425): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgacaagtccagccacaatcttttanacagttccaacaatagaaaactacttagcttaggtaccagcagagaccaggacagcctcctaggctgctcatttacgngggcatccgtaacccgggaatccggggtccctgacccgattcagtggcagcggggtctgggacagtctttcactctcaccatcagcagctgcgagcngaagatgtggngtagtttatttattagtactaactaattaattaattaattacttacgtggtacgtcggtaccgaacggaaccgaacggtaggtacgtatacgaacgaacgaacgtacgtgacgtcgacaaccg

SEQ ID NO: 429953 - DNA, 603 bp, Homo sapiens
  misc_feature: GZ8MTXP02GXTZR.19.71.G05.1.454.CMB.2.raw
  modified_base (245)..(245): a, c, t, g, unknown or other
  modified_base (260)..(260): a, c, t, g, unknown or other
  modified_base (331)..(331): a, c, t, g, unknown or other
  modified_base (373)..(373): a, c, t, g, unknown or other
  modified_base (413)..(414): a, c, t, g, unknown or other
  modified_base (418)..(418): a, c, t, g, unknown or other
  modified_base (424)..(424): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctcctggctgtgtctcgtggacgcggccggccgacagtccaactgacaacgtcagaccactaattctttaanactacgttaccaaanaatagaaaactctagtcttacggaccagcagacgaccaggacacgcctaccgaggctgctctaatttcggnggctacgtaccgtaccggacgtccggtcccacgactactcgnggtcgacgcggtcggtcgaggactagtactcactcacacnncacncacgcncgacgacgacgagagtagtgtgtagttagtttattagttacgtaactaataattaatttaattaacgttacgttacggttacggttacggttacggtaaccggtaacggtaacggtaacggtaacggtaacgtaacgtaacgtaacgtaacgtaacgtacggtacggtacgtacgtacg

SEQ ID NO: 429954 - DNA, 531 bp, Homo sapiens
  misc_feature: GZ8MTXP02GFFQV.19.71.G05.1.454.CMB.2.raw
  modified_base (226)..(226): a, c, t, g, unknown or other
  modified_base (234)..(234): a, c, t, g, unknown or other
  modified_base (243)..(243): a, c, t, g, unknown or other
  modified_base (247)..(247): a, c, t, g, unknown or other
  modified_base (257)..(257): a, c, t, g, unknown or other
  modified_base (264)..(264): a, c, t, g, unknown or other
  modified_base (277)..(277): a, c, t, g, unknown or other
  modified_base (279)..(279): a, c, t, g, unknown or other
  modified_base (285)..(285): a, c, t, g, unknown or other
  modified_base (329)..(329): a, c, t, g, unknown or other
  modified_base (333)..(333): a, c, t, g, unknown or other
  modified_base (363)..(363): a, c, t, g, unknown or other
  modified_base (367)..(367): a, c, t, g, unknown or other
  modified_base (373)..(373): a, c, t, g, unknown or other
tcagtactctcgtgcacgaccggtgctcgatttagtgtcgtcgcaagagagagggggacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgactaagtccagccanatctttanactatcaanatanaactactatntgtacancagagacagacancncagctnctctatactgcatcgtaccgacgtccggtcgcgacgtactcagngcgngcggtcgtggagagtatctactctcacacncacncacgcncgcgagacgagagagtgtgtacgtagttattagttagtactaactaattaattaattacttacgttacgttacggtacggtacggtacgtaaacggtaacggtaacggtacgtacgtagtacgaacgtaacgtaacgtacgtacgacgtacgactacg

SEQ ID NO: 429955 - DNA, 499 bp, Homo sapiens
  misc_feature: GZ8MTXP02IU95J.19.71.G05.1.454.CMB.2.raw
  modified_base (364)..(364): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcccctcgcagacccctctcgctcacctgtgccatctccggggacagagtcgctagcgacagtgtgcttggcacgtgggtcaggcagtccccatcgagaggtctagagtggctggggaagcatatttcattgtccaacacgtggaaatacaaaattntgacacatctgttgagagtcgactgaacaatcaaacgtagacacatacgaagaaccagttcctccctgcagctgacctctgtcgactccgaggacgacggtctataagtacgtgtacggagacggacccagtacg

SEQ ID NO: 429956 - DNA, 516 bp, Homo sapiens
  misc_feature: GZ8MTXP02GO4VY.19.71.G05.1.454.CMB.2.raw
  modified_base (236)..(236): a, c, t, g, unknown or other
  modified_base (357)..(357): a, c, t, g, unknown or other
  modified_base (412)..(412): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaaacaatgaaaactacttagcttggtaccagcagagaccaggacagcctctaggctgctcatttactgggcatctacccgggaatccggggtcccctgaccgattcagtggcnggcgggtctggggacagatttcactctcaccatcagcagcctgcaggctgaaagntgtggctagtttatatgtacaataatattattatacttcgtaggtacgtttcggacctaaaggggaccaaaggttcggattagcgagacgaactgtggctgacc

SEQ ID NO: 429957 - DNA, 531 bp, Homo sapiens
  misc_feature: GZ8MTXP02I8RIC.19.71.G05.1.454.CMB.2.raw
  modified_base (238)..(238): a, c, t, g, unknown or other
  modified_base (362)..(362): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatagaaaactactagcttggtaccagcagagaccaggacagcctcctaggctgctcatttactgggcatccgtacccgggaatccggggtcccctgaccgattcagtggcnggcgggtctggggacagtatttcactctcaccatcagcagcctgcaggctagaaagatggtggctagtttattattgtacaataatattattatacttcgtacggtacgttcggaccgtaaagggacctaagggtacggtaataatcgaagacgaactgtaggctgacc

SEQ ID NO: 429958 - DNA, 489 bp, Homo sapiens
  misc_feature: GZ8MTXP02IJ1N2.19.71.G05.1.454.CMB.2.raw
  modified_base (337)..(337): a, c, t, g, unknown or other
  modified_base (356)..(356): a, c, t, g, unknown or other
  modified_base (464)..(464): a, c, t, g, unknown or other
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatctccggggacagagtcgctagcgacagtgttgcttggcactgggtcaggcagtccccatcgagaggtcagagtggctgggaagacatatttcatgtccanacgtggaaatacaaattangtacaccatctgtgagagtcgactgacaatcaacgtagacacatcgaagaaccagttccaccctgcagctgactctgtcgactccgagacacgggtctatattaacgngtacggagacggtacccagtacgac

SEQ ID NO: 429959 - DNA, 616 bp, Homo sapiens
  misc_feature: GZ8MTXP02JU5N8.19.71.G05.1.454.CMB.2.raw
  modified_base (229)..(229): a, c, t, g, unknown or other
  modified_base (236)..(236): a, c, t, g, unknown or other
  modified_base (245)..(245): a, c, t, g, unknown or other
  modified_base (249)..(249): a, c, t, g, unknown or other
  modified_base (267)..(267): a, c, t, g, unknown or other
  modified_base (286)..(286): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactcctggctgtgtctcgtgggcgagcgggctacgactacgactcgactaagcagcanatcttanacatacaanatanaaactctagctcgtacanacagacgacgacgacgacnctcgtacgcgtcgtctactacttacgtcggtacgacgtacgtaccggtacggtaccggtaccccgtacgaccgtacgtacgtacgtcggcgcggtcggtcggtacggacgtacgtacgttctactactactacactacgacgacgacgtccgacgcgacgacgtacgtagtagtagtacgtagttagttagttagttacgtaacgtaactaattaatttattacttacgttacgttacggtacggttacggtacggtaacggtaacggtaacggtacggtaacgtaacgtaacgtaacgtaacgtacgtacggtacggtacgtacgtacg

SEQ ID NO: 429960 - DNA, 586 bp, Homo sapiens
  misc_feature: GZ8MTXP02GD9J6.19.71.G05.1.454.CMB.2.raw
  modified_base (241)..(241): a, c, t, g, unknown or other
  modified_base (258)..(258): a, c, t, g, unknown or other
  modified_base (315)..(315): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggcctacgatacgactgacaagtcagccacaatctttaanactacgtacaataatanaaactatagctagacagcagacgacagacacgtcctcgtagctgctactatttacgnggtactacgtaccgtaccggtacgtccggtcccctagaccgtatcgaggtcggacgcggtcgggtcgtagggactagtacttcactcctaccaacctatacgacgacgacgcgtacgacgacgacgagagtagtgtacgtagttagttattatactactaataattattattatacgttacgtacggtacggtacggtacggtaacggtaacggtaacgtacggtaagtacgtaacgaacgtaacgtacgtacgtacggtacgtacgtacg

SEQ ID NO: 429961 - DNA, 605 bp, Homo sapiens
  misc_feature: GZ8MTXP02H3X75.19.71.G05.1.454.CMB.2.raw
  modified_base (242)..(242): a, c, t, g, unknown or other
  modified_base (252)..(252): a, c, t, g, unknown or other
  modified_base (307)..(307): a, c, t, g, unknown or other
  modified_base (361)..(361): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccacgatacgaactgacaagtccagccacaatcttttaanacataccaanatagaaactatagctgacagacagagacagacacgcctcagctgctctatttcgnggcactaccgtaccgggacgtcccggggtcccctacgaccgtatcgagtcggcnggcgggtctaggacagtacttcactcacaccatacagcacgcctgacgacggctaggaagtagttggtacggtacttaagtttattagttagtaactaaacttaattaatttaatttaacttacgtttacggttacggttaaccggtttaccgggaaaccggtaaacggggtaaccgtaaaggggtacgtaaattaacgtaacgaaacggtaaccgtaaacggttggtaccggacgtacgtacg

SEQ ID NO: 429962 - DNA, 578 bp, Homo sapiens
  misc_feature: GZ8MTXP02HRNDM.19.71.G05.1.454.CMB.2.raw
  modified_base (237)..(237): a, c, t, g, unknown or other
  modified_base (245)..(245): a, c, t, g, unknown or other
  modified_base (249)..(249): a, c, t, g, unknown or other
  modified_base (255)..(255): a, c, t, g, unknown or other
  modified_base (258)..(258): a, c, t, g, unknown or other
  modified_base (265)..(265): a, c, t, g, unknown or other
  modified_base (270)..(270): a, c, t, g, unknown or other
  modified_base (301)..(301): a, c, t, g, unknown or other
tcagtactctcgtgcacgaccggtgctcgatttagtgtcgtcgcaagagagaggggaggtacaacaggcaggcaggggcagcaagatggtgttgcagacccaggtcttcatttctctgttgctctggatctctggtgcccacggggacatcgtgatgacccagtctccagactccctggctgtgtctctggggcgagcgggccaccatcaactgcaagtccagccacaatcttttanacatcaanatanaaactntanctgacancaganacaggacagcctctagctgctctatttacgnggcatccgtacccgggagtcccggggtcccctagaccgtattcgaggtcggcgacgggtcgggttacgtggggacctagtactttcacctctaccaacctagtacagacgacgccgtcgcgacgacgtagaagtagtgtggtagtagtttattattagtactaactaattaattaattaattacgttacgttacggtacgttacggtacgtaacggtaacgtaacggtacggtaagtagtaacgtacgaacgtacgtacgtacggtacgtacgtacg

SEQ ID NO: 429963 - DNA, 634 bp, Homo sapiens
  misc_feature: GZ8MTXP02IUQB3.19.71.G05.1.454.CMB.2.raw
  modified_base (236)..(236): a, c, t, g, unknown or other
  modified_base (244)..(244): a, c, t, g, unknown or other
  modified_base (246)..(246): a, c, t, g, unknown or other
  modified_base (254)..(254): a, c, t, g, unknown or other
  modified_base (257)..(257): a, c, t, g, unknown or other
  modified_base (269)..(269): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgcaagtcagccacaatctttanacatcaananagaaactntanctgacagcaganacagacacgcctcgagctgctctatttacgtggacacgtaccgtaacccggggaacgtcccggggtcccctacgaccgtattcgaggtcggacgcgggtccgggttcgtcggggacctagtactttaccacttcctaccaacctactacgacgaccgacgtccgtcggacgacggacgtacgtaacgtagtaggtacggtacgttagtttaagtttaagttacgttacgtaaactaaattaatttaattaacgttacgttacgttacggttacggttaccggtaccggtaaacgggtaaacggtaacggtacggtaagtaacgtaacgtaacgtaacgtaacgtacggtacggtacgtacgtacg

SEQ ID NO: 429964 - DNA, 503 bp, Homo sapiens
  misc_feature: GZ8MTXP02JUQZB.19.71.G05.1.454.CMB.2.raw
  modified_base (345)..(345): a, c, t, g, unknown or other
  modified_base (467)..(467): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcacgtgggtcaggcagtccccatcgagaggtctagagtggctggggaagacatattcatgtccaaanacgtgaaatacaaattatgacaccatctgttgagagtcgactgaacaatcaaacgtagacacatacgaagaaccagttctccctgccagctgacctctgtgacctccggaggacgacgggtntataagttacgtgtaggaacgacggaccccagtacg

SEQ ID NO: 429965 - DNA, 560 bp, Homo sapiens
  misc_feature: GZ8MTXP02HSGA5.19.71.G05.1.454.CMB.2.raw
  modified_base (239)..(239): a, c, t, g, unknown or other
  modified_base (312)..(312): a, c, t, g, unknown or other
  modified_base (363)..(363): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccacaatcttttanacagttccaacaatagaaaactactagctggtaccagcagagaccaggacagcctctaggctgctcatttacngggcatcctacccgggaatcccggggtcccctgacccgattccagtcggcnggcgggtctggggacagtatttacactctacaccatcagcagccctgctaggcagaaagatggtaggtctaaggttttatagttagtaccaaataattaatttaattattaacttcggtaggtaccgtttacggaccctaaaggggaaccctaggggtacgtagtaataacgagacgtaacgtgtaggcttagaacc

SEQ ID NO: 429966 - DNA, 499 bp, Homo sapiens
  misc_feature: GZ8MTXP02F3KYK.19.71.G05.1.454.CMB.2.raw
  modified_base (320)..(320): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaagacatatttcatgtaccaanacgtgaatacaaattatgcacatctgttgagagtcgactgacaatacaacgtagacacatacgaaagaaccagttctaccctgcagctgacctctagtgacctccgaggacgacggtgtatatactgtaggaagacggccccaatacgacatcgccacctcgtctcgtggtcgtctaag

SEQ ID NO: 429967 - DNA, 553 bp, Homo sapiens
  misc_feature: GZ8MTXP02IQH4T.19.71.G05.1.454.CMB.2.raw
  modified_base (235)..(235): a, c, t, g, unknown or other
  modified_base (243)..(243): a, c, t, g, unknown or other
  modified_base (247)..(247): a, c, t, g, unknown or other
  modified_base (256)..(256): a, c, t, g, unknown or other
  modified_base (268)..(268): a, c, t, g, unknown or other
  modified_base (297)..(297): a, c, t, g, unknown or other
  modified_base (353)..(353): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccaggggacatcgtgatgacccagtctccagactccctggctgtgtctctgggcagcgggccaccatcaactgcaagtccagccacaatcttttanacatcaanatanaaactatanctgacagcaganacagacagcctcagctgctctatttacgnggacactccgtaacccgggaagtcccggggtccccacgaccgtattcgagtcggcngggcgggtcgtagggactagtactttcactctacaccatacagacacgcctcgcgacgacgtagaagtagtgtgtacgtagtttattattagtactaaactaaattaattaattaattacttacgttacggtacgttacggtacgaacggaacgaacgtagtagtataacgacgaacgtacgtagtacgtacgtacgacg

SEQ ID NO: 429968 - DNA, 560 bp, Homo sapiens
  misc_feature: GZ8MTXP02JOBOG.19.71.G05.1.454.CMB.2.raw
  modified_base (234)..(234): a, c, t, g, unknown or other
  modified_base (359)..(359): a, c, t, g, unknown or other
  modified_base (366)..(366): a, c, t, g, unknown or other
  modified_base (411)..(411): a, c, t, g, unknown or other
  modified_base (414)..(414): a, c, t, g, unknown or other
  modified_base (431)..(431): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatgaaaactacttagcttggtaccagcagagaccaggacagcctcctaggctgctcatttactgggcatccgtacccgggatccggggtccccctgaccgattcagtcggcngcgggtntggggacagtatttcactctcaccatcagcagcctgcagctgaantgnggctagtttatatgtanaactaatattattatacgttcgtaggtacgtttcggacccgtaaaaggggtacccctaaaggggttacggtaactttaaacgtaacggtaaacggtaaccggtaacggtggtacggtactacggtaccg

SEQ ID NO: 429969 - DNA, 541 bp, Homo sapiens
  misc_feature: GZ8MTXP02G9LYA.19.71.G05.1.454.CMB.2.raw
  modified_base (232)..(232): a, c, t, g, unknown or other
  modified_base (276)..(276): a, c, t, g, unknown or other
  modified_base (307)..(307): a, c, t, g, unknown or other
  modified_base (335)..(335): a, c, t, g, unknown or other
  modified_base (358)..(358): a, c, t, g, unknown or other
tcagtactctcgtgcacgaccggtgctcgatttagtgtcgtcgcaagagagagggggacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatagaaaactcttaagcttaggaccagcaganaccaggacagcctctaggctgctcatttacngggcatcctaccgggatcccggggtccngaccgattcagtgccagcgggtntgggacagtacttcactctcacatcagcacgcctgcaggctagagatcgtgactagtttattagtctacaataattattattatacgtttcgaggtacttacggactaaacgggtaccaaagggtcgtaaacgttagacgaacggtaacgtaaccgttcggttaggcctaggtactaaacccg

SEQ ID NO: 429970 - DNA, 516 bp, Homo sapiens
  misc_feature: GZ8MTXP02JRULW.19.71.G05.1.454.CMB.2.raw
  modified_base (238)..(238): a, c, t, g, unknown or other
  modified_base (368)..(368): a, c, t, g, unknown or other
  modified_base (437)..(437): a, c, t, g, unknown or other
  modified_base (493)..(493): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtaccccctgaccgattcagtggcagcgggtntggggacagatttcactctcaccatcagcagcctgcaggctgaagatgtggacagtttatatgtacaanaatattattatacttcgtaggacgttcggaccaaagggaccaaaggtcggaattanaacgagacgactgacgctacgac

SEQ ID NO: 429971 - DNA, 489 bp, Homo sapiens
  misc_feature: GZ8MTXP02HJUP2.19.71.G05.1.454.CMB.2.raw
  modified_base (344)..(344): a, c, t, g, unknown or other
  modified_base (375)..(375): a, c, t, g, unknown or other
  modified_base (414)..(414): a, c, t, g, unknown or other
  modified_base (425)..(425): a, c, t, g, unknown or other
  modified_base (428)..(428): a, c, t, g, unknown or other
  modified_base (430)..(430): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaagacatatttcattgtccaaanacgtgaaatacaaattatgcaccatctgttnagagtcgatgaacaatcaaacgtagacacaatcgaaaanaacatctctcncancncactctgtgactccgacgacgacggtagtataagtactagtagagacgacccgactacg

SEQ ID NO: 429972 - DNA, 564 bp, Homo sapiens
  misc_feature: GZ8MTXP02GR3FO.19.71.G05.1.454.CMB.2.raw
  modified_base (463)..(463): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccagtccgtccggggacagacgtcgctagcgacagtgttgcttggcacgtgggtcaggccacgtccccagtcgagaggtctaggagtggacgtaggggaaggactattatttacattcgtccaaacacggtaggaaataacaaattatcgacacctatctagttagagtagtcgactagaacaatacaaacgtagaacacaagtacgaaacgaacctacgttaccnccctagacagctacgaccttctcgtagaccgtacccgaaggaccgtaacgggtattaacgtaagttacgtaggtacggaacgaccggaccccaagtaaccg

SEQ ID NO: 429973 - DNA, 505 bp, Homo sapiens
  misc_feature: GZ8MTXP02JK9HQ.19.71.G05.1.454.CMB.2.raw
  modified_base (472)..(472): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtgccatctccggggacagagtcgctagcgacagtgttgcttggcactgggtcaggcagtcccccatcgagaggtctagagtggctgggaagacatatttcatgtccaacacgtggaaatacaaaatttatgacaccaatctgttgagagtcgactgacaatcaaacgtagacacatacgaagaaccaagttctccctgccagctgacctctagtgactcccgaggacaacggggttntataagtacgtagtacggacgacgacccatacg

SEQ ID NO: 429974 - DNA, 547 bp, Homo sapiens
  misc_feature: GZ8MTXP02IUNZP.19.71.G05.1.454.CMB.2.raw
  modified_base (240)..(240): a, c, t, g, unknown or other
  modified_base (250)..(250): a, c, t, g, unknown or other
  modified_base (319)..(319): a, c, t, g, unknown or other
  modified_base (366)..(366): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctggggcgagcgggccaccatcgaactgcaagtccagccacaatcttttaanacagtccaanaatagaaaactacttagcttggaccagcagagaccaggacacgcctccgtaggctgctactatttacgnggcatccgtacccgggatcccggggtcccctgaccgtatcagtggcnggcgggtctgggactagtatttcactctcaccatcagcacgcctgcgaggctagaaagatggtacgtactagtttattagttgtacaaactattaattattaatacttcggtacggtacgttcggacgaaagggaccaaggtacgaatagaacgacgaacgtacgtagtacgtcgtacgcg

SEQ ID NO: 429975 - DNA, 743 bp, Homo sapiens
  misc_feature: GZ8MTXP02JTUK1.19.71.G05.1.454.CMB.2.raw
  modified_base (447)..(447): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgcctcactgtcgcctactccggtaccggggacaggacgtcgcgtacgcgactaggttcgtcgtcgttggactacggttcgggtacaggccaccgtccccagtaccggaggtacggtacgtaggacggtacggcggtaacggggaaacggtacctaagtttactttacgaacgttaccgtaccgaaacgtaacggttaagtaaaactaaccgttaaaatttnacgacctaacctagttcgttaggttagaacggttacgtaccgtaacgttacgaaaacgtaacttaaccgtaaaacgggtctaaaaccaaccgtaaacggttaaaccggaaaaccggttaaaacccttaccggttttaccccttcccggtaggactaacgtccggttaaacctacccgttcggttacggttacccggtaacccggtaccgggaaacggtacgggttaccggggtttaataagttaaccgtttacgaggggtaacggaaccgggtaccccacccgtaaagtaacccgg

SEQ ID NO: 429976 - DNA, 590 bp, Homo sapiens
  misc_feature: GZ8MTXP02HUA7A.19.71.G05.1.454.CMB.2.raw
  modified_base (228)..(228): a, c, t, g, unknown or other
  modified_base (236)..(236): a, c, t, g, unknown or other
  modified_base (243)..(243): a, c, t, g, unknown or other
  modified_base (245)..(245): a, c, t, g, unknown or other
  modified_base (247)..(247): a, c, t, g, unknown or other
  modified_base (252)..(252): a, c, t, g, unknown or other
  modified_base (255)..(255): a, c, t, g, unknown or other
  modified_base (262)..(262): a, c, t, g, unknown or other
  modified_base (290)..(290): a, c, t, g, unknown or other
  modified_base (298)..(298): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgacaagtccagccanatctttanacatcanananaactntanctgacancagacgacagacacgcctcgagctgctntattacgnggcatacgtaccggtacgtccgggtcctacgaccgtatcgaggtcggcgagggcgggttcgacgggactagttacttccacttcctaccactactacacgacgacgccgtcgacgacgacgtagaagtagtaggtacggtacgttaagtttagtttagttagtactaactaattaattaatttaacgttacgtttacgttacggttacggttacggtacggtaacggtaacggtaacggtacgtacgtacgtacgtaacgtacgtacgtacgtacgtacgtacgtacgtacg

SEQ ID NO: 429977 - DNA, 543 bp, Homo sapiens
  misc_feature: GZ8MTXP02JUSC4.19.71.G05.1.454.CMB.2.raw
  modified_base (237)..(237): a, c, t, g, unknown or other
  modified_base (359)..(359): a, c, t, g, unknown or other
  modified_base (367)..(367): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaaacaatagaaaactactagcttggtaccagcagagaccaggacagcctctaggctgctcatttactgggcatccgtacccgggaatccggggtcccctgaccgattcagtgcnggcgggtntgggacagtatttcactctcacatcagcagcctgcaggctagaagagtggtggctagtttatagttagtactaaataattattattatacgttcgtcggtacgttcggaccgtaaaggggacctaagggtacggtaatacgtaaccgaaggaacgtaaccgtggacctcgacaacc

SEQ ID NO: 429978 - DNA, 582 bp, Homo sapiens
  misc_feature: GZ8MTXP02JCT4D.19.71.G05.1.454.CMB.2.raw
  modified_base (242)..(242): a, c, t, g, unknown or other
  modified_base (376)..(376): a, c, t, g, unknown or other
  modified_base (419)..(419): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgaggcgggccacgatcgaactgacaagtccagccacaattctttanacagttccaacaatgaaaactctagcttggacagcagagaccaggacagcctctaggctgctcatttacgtggctactccgtacccgggaatccggggtcccctgaccgtattcgagtggccagggtccgggtntaggggactagtactttcacctctcacccagtccagcacgccncgcgacgacgtagagtagtgtgtacgtagtttattattagtactaactaattaattattattacgttacgttacggtacggttacggtaccggtaaacggtaacggtaacggtacggtagtacgtaacgtacgtaacgtacgtacggtacggtcgtacgtacg

SEQ ID NO: 429979 - DNA, 515 bp, Homo sapiens
  misc_feature: GZ8MTXP02HBYWJ.19.71.G05.1.454.CMB.2.raw
  modified_base (341)..(341): a, c, t, g, unknown or other
  modified_base (450)..(450): a, c, t, g, unknown or other
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtaccaacacggtggaactacaaattangcaccatctgttgagtagtcgactgaacaatcaaacgtagaacacatacgaaagaacctagttctaccctgacagctgacctctgtcgacctccgaggaccgacgggtntaatatacgtggtaggaagaccggacccagtacgacatcgccactcgtctcgtggtcgacttaag

SEQ ID NO: 429980 - DNA, 509 bp, Homo sapiens
  misc_feature: GZ8MTXP02IHRK3.19.71.G05.1.454.CMB.2.raw
  modified_base (234)..(234): a, c, t, g, unknown or other
  modified_base (245)..(245): a, c, t, g, unknown or other
  modified_base (306)..(306): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacatctttanacagttccaanaatgaaaactactagcttggtaccagcagagaccaggacagcctctaggctgctcattacngggcatctacccgggaatccggggtcctgaccgattcagtggcagcggggtctggggacagtattcactctcacatcagcagcctgcaggctagagatgtggctagtttattattagtacaactaatattattatacttcgtgtacgttcggacgaaacggtaccaaggtcgaatatacaagacgaactgtagctagactacg

SEQ ID NO: 429981 - DNA, 544 bp, Homo sapiens
  misc_feature: GZ8MTXP02HSY2X.19.71.G05.1.454.CMB.2.raw
  modified_base (225)..(225): a, c, t, g, unknown or other
  modified_base (235)..(235): a, c, t, g, unknown or other
  modified_base (246)..(246): a, c, t, g, unknown or other
  modified_base (307)..(307): a, c, t, g, unknown or other
  modified_base (340)..(340): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccanaattctttanacagttccaanaatagaaaactctagcttgaccagcagagaccaggacagcctctaggctgctcatttacgnggcatccgaccggagtccgggtcctcgaccgtntcgaggtcgcgagggcgggtcagggacagtacttcactcacacatcacgcacgtcctgcgaggcgtagaagtagtggtaggtacgttaagtttattagttagtaactaaataattatttaattatacgttcggtacgtacgtacggacgaaacggtacgtaaggtgactagacgaagtaacgtaacgtcgacgtctacgacacg

SEQ ID NO: 429982 - DNA, 511 bp, Homo sapiens
  misc_feature: GZ8MTXP02GKJFX.19.71.G05.1.454.CMB.2.raw
  modified_base (433)..(433): a, c, t, g, unknown or other
  modified_base (474)..(474): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgtgcttggcacgtgggtcaggcacgtccccatcgagaggtctagagtggcgtgggaagacatatttcattgtccaaacacgtaggaaatacaaaattatagacaccatctagttgagagtcgactgaacaatcaaacgtagaacacatacgaaagaaccagttcnccgtgcagctgacctctcgtgacctcccgaggacacgggtntataagttacgtagtacggaacgacggccccataacg

SEQ ID NO: 429983 - DNA, 507 bp, Homo sapiens
  misc_feature: GZ8MTXP02I6RTJ.19.71.G05.1.454.CMB.2.raw
  modified_base (234)..(234): a, c, t, g, unknown or other
  modified_base (245)..(245): a, c, t, g, unknown or other
  modified_base (338)..(338): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcgaactgcaagtccagccacatctttanacagttccaanaatgaaactacttagcttggtaccagcagagaccaggacagcctctaggctgctcattactgggcatcgtaccggatccggggtcctgaccgnttcagtgcagcgggtctgggacagatttcactctcaccatcagcagcctgcagctagagatgtgctagttatattgacaatatattattatacttcgtaggtacgttcggacctaaagggacctaaggttcggaactagtacgaagtacgaactgaggtctggactacg

SEQ ID NO: 429984 - DNA, 487 bp, Homo sapiens
  misc_feature: GZ8MTXP02H8JIY.19.71.G05.1.454.CMB.2.raw
  modified_base (230)..(230): a, c, t, g, unknown or other
  modified_base (237)..(237): a, c, t, g, unknown or other
  modified_base (240)..(240): a, c, t, g, unknown or other
  modified_base (244)..(244): a, c, t, g, unknown or other
  modified_base (246)..(247): a, c, t, g, unknown or other
  modified_base (255)..(255): a, c, t, g, unknown or other
  modified_base (262)..(263): a, c, t, g, unknown or other
  modified_base (265)..(265): a, c, t, g, unknown or other
  modified_base (267)..(267): a, c, t, g, unknown or other
  modified_base (276)..(276): a, c, t, g, unknown or other
  modified_base (278)..(278): a, c, t, g, unknown or other
  modified_base (280)..(280): a, c, t, g, unknown or other
  modified_base (282)..(283): a, c, t, g, unknown or other
  modified_base (286)..(286): a, c, t, g, unknown or other
  modified_base (288)..(288): a, c, t, g, unknown or other
  modified_base (290)..(290): a, c, t, g, unknown or other
  modified_base (292)..(293): a, c, t, g, unknown or other
  modified_base (306)..(306): a, c, t, g, unknown or other
  modified_base (310)..(310): a, c, t, g, unknown or other
  modified_base (313)..(313): a, c, t, g, unknown or other
  modified_base (315)..(315): a, c, t, g, unknown or other
  modified_base (317)..(317): a, c, t, g, unknown or other
  modified_base (319)..(319): a, c, t, g, unknown or other
  modified_base (329)..(329): a, c, t, g, unknown or other
  modified_base (331)..(331): a, c, t, g, unknown or other
  modified_base (335)..(335): a, c, t, g, unknown or other
  modified_base (337)..(337): a, c, t, g, unknown or other
  modified_base (341)..(341): a, c, t, g, unknown or other
  modified_base (344)..(344): a, c, t, g, unknown or other
  modified_base (346)..(347): a, c, t, g, unknown or other
  modified_base (349)..(349): a, c, t, g, unknown or other
  modified_base (351)..(351): a, c, t, g, unknown or other
  modified_base (353)..(353): a, c, t, g, unknown or other
  modified_base (358)..(358): a, c, t, g, unknown or other
tcagtactctcgtgcacgaccggtgctcgatttagtgtcgtcgcaagagagagggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcctacgatacgactgacaagtcagcanatcttanacntcanannaactatantgtacannananacagacacncncngnnctntntngnntcacgacgccgcncgcntcngngngngcgtcgtgananatcncnctcncancnncncncncgcgngcagagagtgtgtagtagttattatatactaactaattattattattacgttacgtacgtacgttacgtacgtaacggtacgtacggtagtagtaacgtacgtacgtacgtacgtacgtacgtacgtcg

SEQ ID NO: 429985 - DNA, 506 bp, Homo sapiens
  misc_feature: GZ8MTXP02GTOE4.19.71.G05.1.454.CMB.2.raw
  modified_base (237)..(237): a, c, t, g, unknown or other
  modified_base (360)..(360): a, c, t, g, unknown or other
  modified_base (393)..(393): a, c, t, g, unknown or other
  modified_base (413)..(413): a, c, t, g, unknown or other
  modified_base (419)..(419): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctctaggctgctcatttactgggcatcctacccggggaatccggggtccccctgaccgattcagtggcnggcgggtctggggacagtatttcactctcaccntcagcagcctgcagctgaantgtggntagtttatattgtacaataatattatatacttgtagtacgttcgacctaaggacaaggtgaatagtcgaagacgactgtcgactgac

SEQ ID NO: 429986 - DNA, 504 bp, Homo sapiens
  misc_feature: GZ8MTXP02GBBXI.19.71.G05.1.454.CMB.2.raw
  modified_base (360)..(360): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctgggaagacatatttcatcgtccaacacgtgaatacaaattntgcaccatctgttagagagtcgactgaacaatcaaacgtagaacacatacgaaagaaccagttcctccctagcagctcgacctctcgtcgactcccgaggaccgacggtgtataagttacagtacggacgacggacccataacg

SEQ ID NO: 429987 - DNA, 499 bp, Homo sapiens
  misc_feature: GZ8MTXP02GR6DI.19.71.G05.1.454.CMB.2.raw
  modified_base (227)..(227): a, c, t, g, unknown or other
  modified_base (237)..(237): a, c, t, g, unknown or other
  modified_base (313)..(313): a, c, t, g, unknown or other
  modified_base (353)..(353): a, c, t, g, unknown or other
  modified_base (405)..(405): a, c, t, g, unknown or other
  modified_base (474)..(474): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatcttttanacagttccaaacaatgaaaactacttagcttggtaccagcagagaccaggacagcctcctaggctgctcatttacnggcatctaccggaatccggggcccctgaccgatcagtgcngcgggtctgggacagatttcactctcacatcagcagcctgcaggctgaaagntgtgatagtttatatgtacaataatattattatactgtagtcgtacgacgaaggacgtaaggtcgatanaacgagaacgtacgtgtcgctacgc

SEQ ID NO: 429988 - DNA, 526 bp, Homo sapiens
  misc_feature: GZ8MTXP02IUG33.19.71.G05.1.454.CMB.2.raw
  modified_base (234)..(234): a, c, t, g, unknown or other
  modified_base (352)..(352): a, c, t, g, unknown or other
  modified_base (429)..(429): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgcgccaccatcaactgcaagtccagccacaatctttanacagttccaacaatgaaaactacttagcttggtaccagcagagaccaggacagcctcctaggctgctcatttactgggcatctacccggaatccggggtcccctgaccgatcagtgcngcgggtctgggacagatttcactctcaccatcagcagcctgcaggctgaagatgtggctagtttatattgtacaaanaattaattattatacttcgttaggacgtttacggccaaaaggggacctaaaggtacggtataatcgagtaaccggaaactggtacggtctacggacc

SEQ ID NO: 429989 - DNA, 693 bp, Homo sapiens
  misc_feature: GZ8MTXP02JGOVP.19.71.G05.1.454.CMB.2.raw
  modified_base (238)..(238): a, c, t, g, unknown or other
  modified_base (247)..(247): a, c, t, g, unknown or other
  modified_base (251)..(251): a, c, t, g, unknown or other
  modified_base (256)..(256): a, c, t, g, unknown or other
  modified_base (259)..(259): a, c, t, g, unknown or other
  modified_base (271)..(271): a, c, t, g, unknown or other
  modified_base (279)..(279): a, c, t, g, unknown or other
  modified_base (299)..(299): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccacgatacgaactgacaagtccagccacaatctttanacatacaanatanaaatntanctgacagcaganacagacanctcgagctgctctattacgnggactacgtccgtaccggacgtcccgggtacccctacgaccgtattacgaggtcggcgtacgggtcgggttacgtacgggactagttactttaccgaccttacctaccaaccctacgtaccgaacgtaccgtacgtcccgtacgtacgtacgggtacgtaacggtaaacggtacggttacggttacgggttacgtttaacggttttaacgtttaacgtttacgttaacgtaaacttaaacgtttaaagtttaatttaacgtttaacgtttacggttacgggttaccgggtttaccgggtaaccgggtaaacgggtaaaccggtaacgggttaacggtaacgttaacgtaacgtaacggtaacggtaacggtacggttacggtacgtacgtaccg

SEQ ID NO: 429990 - DNA, 509 bp, Homo sapiens
  misc_feature: GZ8MTXP02HIDIP.19.71.G05.1.454.CMB.2.raw
  modified_base (237)..(237): a, c, t, g, unknown or other
  modified_base (313)..(313): a, c, t, g, unknown or other
  modified_base (361)..(361): a, c, t, g, unknown or other
  modified_base (420)..(420): a, c, t, g, unknown or other
  modified_base (423)..(423): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatagaaaactacttagcttggtaccagcagagaccaggacagcctcctaggctgctcatttacnggcatccgtacccgggatccggggtcccctgaccgtattcaggtggcnggcggggtctggggacagtactttcactctcacccatcagcagcctagcagctgaaagntgngctagtttatatgtacaatatattattatactcgtaggacgttcggactaaggacagtcgatagtcgagacgtactgtcggctgac

SEQ ID NO: 429991 - DNA, 604 bp, Homo sapiens
  misc_feature: GZ8MTXP02HI09S.19.71.G05.1.454.CMB.2.raw
  modified_base (227)..(227): a, c, t, g, unknown or other
  modified_base (245)..(245): a, c, t, g, unknown or other
  modified_base (249)..(249): a, c, t, g, unknown or other
  modified_base (258)..(258): a, c, t, g, unknown or other
  modified_base (295)..(295): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgcccacggggacatcgtgatgacccagtctccagactcctggctgtgtctcgtgggcgaggcgggccacgatcgaactgacaagtccagccanaatctttatacatcaaanatanaactactantagtacagacagacgacagacacgctactacgcgtcnctactattacgtgactactacgtaccggtacggtccggtccgtaccgacgtacgtcgtagtcggcgacggcggtcgtacggacgtagtacttactactactactaccactacacgacgacgacgtcgacgacgacgtacgtaagtagtagtaggtacgttagtttatttagttagtactaaactaattaattaattaacttacgttacgttacggttacggttacggtaccggtaacggtaacggtaacggtacggtacgtacgtacgtaacgtaacgtaacgtacggtacggtacgtacgtacgtacg

SEQ ID NO: 429992 - DNA, 569 bp, Homo sapiens
  misc_feature: GZ8MTXP02HTXWX.19.71.G05.1.454.CMB.2.raw
  modified_base (237)..(237): a, c, t, g, unknown or other
  modified_base (246)..(246): a, c, t, g, unknown or other
  modified_base (248)..(248): a, c, t, g, unknown or other
  modified_base (250)..(250): a, c, t, g, unknown or other
  modified_base (259)..(259): a, c, t, g, unknown or other
  modified_base (266)..(267): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttaanacatacaanananaaactatanctgacannagagacagacacgcctacgagctgctactattacgtgcactaccgtaccggtacgtaccggtaccccgtacgtaccgtacgtactagtcgcgcggcggtcgtaggacgtagtactactactactacacactacacgacacgacctacgacgacgacgtagaagagtagtagtagttagttattattagtactaataataattaattaattacttacgtacggtacggttacggtacgtaacggtaacgtaacggtacgtaagtataacgtaacgaacgtaacgtagtacggtacgtacgacg

SEQ ID NO: 429993 - DNA, 507 bp, Homo sapiens
  misc_feature: GZ8MTXP02JKLS2.19.71.G05.1.454.CMB.2.raw
  modified_base (229)..(229): a, c, t, g, unknown or other
  modified_base (238)..(238): a, c, t, g, unknown or other
  modified_base (249)..(249): a, c, t, g, unknown or other
  modified_base (310)..(310): a, c, t, g, unknown or other
  modified_base (364)..(364): a, c, t, g, unknown or other
  modified_base (452)..(452): a, c, t, g, unknown or other
tcagtactctcgtgcacgaccggtgctcgatttagtgtcgtcgcaagagagagggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatctttanacagttccaanatgaaaactactagcttggtaccagcagagaccaggacagcctctaggctgctcatttacnggcatctacccgggaatcccccggggtcctgaccgattcagtggcagcgggtcnggggacagatttcactctcacatcagcagcctgcaggctagaagatggtggctagtttatattgtacaataatattatatactttcgngtacgttcgaccgaagggtaccaaggtgataagcgaagacgaactgtacggctcg

SEQ ID NO: 429994 - DNA, 523 bp, Homo sapiens
  misc_feature: GZ8MTXP02J067S.19.71.G05.1.454.CMB.2.raw
  modified_base (240)..(240): a, c, t, g, unknown or other
  modified_base (316)..(316): a, c, t, g, unknown or other
tcagtactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttcccaacaatgaaaactacttagcttggtaccagcagagaccaggacagcctcctaggctgctcatttacnggcatcgtacccgggaatcccccggggtccctgaccgattcagtgcagcggggtctggggacagtattcactctcacatcagcagcctgcagctagaagatggtggctagtttattatgtacaactaatattattatacttcgtaggtacgttcggaccgaagggtaccaaggtaggataagactaagacgaactggtcggactcgg

SEQ ID NO: 429995 - DNA, 564 bp, Homo sapiens
  misc_feature: GZ8MTXP02IIPAH.19.71.G05.1.454.CMB.2.raw
  modified_base (243)..(243): a, c, t, g, unknown or other
  modified_base (385)..(385): a, c, t, g, unknown or other
  modified_base (425)..(425): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctccctggctgtgtctctggggcgagcgggccacgatacgaacgtgacaagtccagccacaatcttttanacagttccaacaatgaaaactctagcttggtaccagcagagaccaggacagcctcctaggctgctcatttactggcatctacccggggaatccggggtccccctgaccgattcagtcggcagggcggtactggggaccagtntttacacgtctcaccatcagcagcctgcaggactgaaagntgtggctaggtttatagttgtacaataattattattatacgttcgtaggtacgttaccggactaaacggggaccttaacggggtaggtaacttaagtaacgtaaggaacgtaaaacgttggttcggacttacggacccg

SEQ ID NO: 429996 - DNA, 564 bp, Homo sapiens
  misc_feature: GZ8MTXP02HWWR1.19.71.G05.1.454.CMB.2.raw
  modified_base (242)..(242): a, c, t, g, unknown or other
  modified_base (321)..(321): a, c, t, g, unknown or other
  modified_base (365)..(365): a, c, t, g, unknown or other
  modified_base (377)..(377): a, c, t, g, unknown or other
  modified_base (433)..(433): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccacgatcaactgacaagtccagccactaatcttttanacagttaccaaacaatagaaactactagcttggaaccagcagacgaccaggacagcctcgaggctgctactatttacgnggcagtaccgtacccggggagtcccggggtccccctagaccgtnttcgagtcggcngcgggtctagggactagtactttcactctacacatcagcagcctgcagctagaagntgtgtctagtttattagtgtaacaaataattattaattattaaccgttgtacggtacgtttccggaacgtaaacgggactaaagggtgaactagtaacgaaggtaccgtaaacgtgtacggtctacgaccg

SEQ ID NO: 429997 - DNA, 519 bp, Homo sapiens
  misc_feature: GZ8MTXP02F8HKY.19.71.G05.1.454.CMB.2.raw
  modified_base (236)..(236): a, c, t, g, unknown or other
  modified_base (311)..(311): a, c, t, g, unknown or other
  modified_base (358)..(358): a, c, t, g, unknown or other
  modified_base (374)..(374): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatctttanacagttccaacaatgaaaactacttagcttggtaccagcagagaccaggacagcctcctaggctgctcatttacngggcatctacccgggaatccggggtccccctgaccgattcagtggcnggcgggtctggggacngtatttcactctcaccatcagcagcctgcaggctagaagatgtggctaggtttatattgtacaaataattaattattatacttcgagtacgttcgacctaagggaccaagggtgaatataacgagaacgaacgtgtcggctgacc

SEQ ID NO: 429998 - DNA, 597 bp, Homo sapiens
  misc_feature: GZ8MTXP02F54DI.19.71.G05.1.454.CMB.2.raw
  modified_base (235)..(235): a, c, t, g, unknown or other
  modified_base (245)..(245): a, c, t, g, unknown or other
  modified_base (250)..(250): a, c, t, g, unknown or other
  modified_base (311)..(311): a, c, t, g, unknown or other
tcagtactctcgtgcacgaccggtgctcgatttagtgtcgtcgcaagagagagggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtccagccacaatctttaanacataccaanaatanaaactactagctagtaccagcagacgaccaggacacgcctcgtaggctgctactattacgnggcatccgtaccgggagtcccggggtcctcgaccgtatcgagtggcgaggcgggtcgtagggacagtactttcactctacacatcacgcacgcctcgcgacgacgtagaagagtgtggtacgttagtttatttagtttagttactaaactaaattaatttaatttaattaacgtttacgttacggtaccggttacggtaccggtaaacgggtaaaccggtaaacgggtacggtaacgtaagtacgtaacgtaacgtaacgtacggtacggtacgtacgacgtaccg

SEQ ID NO: 429999 - DNA, 621 bp, Homo sapiens
  misc_feature: GZ8MTXP02GTO6E.19.71.G05.1.454.CMB.2.raw
  modified_base (241)..(241): a, c, t, g, unknown or other
  modified_base (250)..(250): a, c, t, g, unknown or other
  modified_base (254)..(254): a, c, t, g, unknown or other
  modified_base (264)..(264): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctggggcgagcgggccacgatacgaactgacaaggtccagccacaatctttanacatacaanatanaaactactanctagacagcagacgacagacacgcctcgaggctgctctatttacgtggactacgtaccgtaacccggggtacgtcccggggtaccccctacggacccgtagttcgaggtcggacgcggggtccggggtacgtaggggactagtactttaccacttctacctaaccctatacgacgacgacgccgtcgacgacgacgtagaagtagtaggtaggtacgttagtttagtttattacgttactaactaattaatttattattacgttacgttacggtacggttacggtacggtaacggtaacggtaacggtacggtagtacgtaacgtacgtaacgtacgtagtacggtacgtacgtacg

SEQ ID NO: 430000 - DNA, 523 bp, Homo sapiens
  misc_feature: GZ8MTXP02HMKL3.19.71.G05.1.454.CMB.2.raw
  modified_base (330)..(330): a, c, t, g, unknown or other
  modified_base (472)..(472): a, c, t, g, unknown or other
  modified_base (479)..(479): a, c, t, g, unknown or other
  modified_base (484)..(484): a, c, t, g, unknown or other
  modified_base (515)..(515): a, c, t, g, unknown or other
  modified_base (518)..(523): a, c, t, g, unknown or other
tcagtactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgacccgattcagtggcagcgggtctgggacagatttcactctcaccatcagcagcctgcaggctgaagntgtggcctagttttattattgtacaaactaattatttaattatactttcgtgggtacgtttcggacccaaagggggacctaaaggggtgaatatcaagaccgaatggtgactgacacctatcttgtcttcattccgttcccnctattcngaccngagtgtactggacggcggctgcgagcgcganagnnnnnn

SEQ ID NO: 430001 - DNA, 533 bp, Homo sapiens
  misc_feature: GZ8MTXP02IYEH3.19.71.G05.1.454.CMB.2.raw
  modified_base (237)..(237): a, c, t, g, unknown or other
  modified_base (312)..(312): a, c, t, g, unknown or other
  modified_base (355)..(355): a, c, t, g, unknown or other
  modified_base (369)..(369): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacnggcatctaccggaatccggggtcccctgaccgattcagtggcngcgggtctgggacngatttcactctcaccatcagcagcctgcaggctgaaagatgtggctagtttatatgtcaaatatattattatacttcgtaggtacgtttcggaccgtaaagggtaccaaaggtcggaattaagtaaccgaaggtaacgaaaacgtgtagggccttaggaacccg

SEQ ID NO: 430002 - DNA, 530 bp, Homo sapiens
  misc_feature: GZ8MTXP02JT29F.19.71.G05.1.454.CMB.2.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtcgccatcgtccggggacagagtcgctagcgacagtgttgcttggcacgtgggtcaggcagtccccatcgagaggtctaggagtggcgtaggggaaggactatatttcattcgtccaaacacgtggaaatacaaattatgacacctatctgttgagagtcgactagaacaatacaaacgtagaacacatacgaaagaacctagttcctaccctgcagtctacgacctctcgtcgactcgtacggacggacgtacgggtagtaatagttacgtggtacggacgtacggacccctaag

SEQ ID NO: 430003 - DNA, 638 bp, Homo sapiens
  misc_feature: GZ8MTXP02H74HJ.19.71.G05.1.454.CMB.2.raw
  modified_base (203)..(203): a, c, t, g, unknown or other
  modified_base (226)..(226): a, c, t, g, unknown or other
  modified_base (236)..(236): a, c, t, g, unknown or other
  modified_base (247)..(247): a, c, t, g, unknown or other
  modified_base (312)..(312): a, c, t, g, unknown or other
tcagtactctcgtgcacgaccggtgctcgatttagtgtcgtcgcaagagagaggggtacaacaggcaggcaggggcagcaagatggtgttgcagacccaggtcttcatttctctgttgctctggatctctggtgcccacggggacatcgtgatgacccagtctccagactccctggctgtgtctctggggcagcgggccacgntacgaactgacaagtccagccanaatcttttanacagttccaanaatagaaactactagcttagacaagcagagaccaggacagcctacgtaggctgctctatttacgngggactatccgtaacccgggacgtcccggggtcctcgaccgtattcgaggtcggacgacgggtccggggtctaggggaactagtactttcactcctaccaccatcacgacgacgaccgtcgacgacggacgtagaagtagtaggtacggtacgttagtttagtttacgttacgttacgtaaactaaattaatttaatttaattacgttacgttacggttacggttaccggtaccggtaaacgggtaaaccggtaaacggtacggtaacgttaacgtacgtaacggtaacggtaaacgtacggtacggtacgtacgtaccgtaaccg

SEQ ID NO: 430004 - DNA, 535 bp, Homo sapiens
  misc_feature: GZ8MTXP02HAC96.19.71.G05.1.454.CMB.2.raw
  modified_base (339)..(339): a, c, t, g, unknown or other
tcagtactctcgtgcacgaccggtgctcgatttagtgtcgtcgcaagagagagggggaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatctccggggacagagtcgctagcgacagtgttgcttggcactgggtcaggcagtccccatcgagaggtctaggagtggctgggaaggtacagtatttcatggtaccaacacgtgaatacaaattntgcaccatctgttgagtagtcgactgaaccaatacaaacgtagacaacaatacgaaagaaccagttacctacctgacagctgacctctgtacgaccgtccgagacgacggtagtatattactaggtaggaagacggacccctaagtacgacaacgtcgaacccgaccttacgtcctacgtcggttacgctttaacg

SEQ ID NO: 430005 - DNA, 521 bp, Homo sapiens
  misc_feature: GZ8MTXP02GUB4I.19.71.G05.1.454.CMB.2.raw
  modified_base (237)..(237): a, c, t, g, unknown or other
  modified_base (312)..(312): a, c, t, g, unknown or other
  modified_base (359)..(359): a, c, t, g, unknown or other
  modified_base (415)..(415): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacngggcatctacccgggaatccggggtccccctgaccgattcagtggcnggcgggtctgggacagatttcactctcacccatcagcagcctgcaggctagaaagntgtggctaggtttattagttgtacaactaatattattatacttcgtagtacgttcggacctaaagggacctaaggtcgattagcgagacgaactgtacggctgacc

SEQ ID NO: 430006 - DNA, 576 bp, Homo sapiens
  misc_feature: GZ8MTXP02GTZE5.19.71.G05.1.454.CMB.2.raw
  modified_base (237)..(237): a, c, t, g, unknown or other
  modified_base (245)..(245): a, c, t, g, unknown or other
  modified_base (247)..(247): a, c, t, g, unknown or other
  modified_base (249)..(249): a, c, t, g, unknown or other
  modified_base (254)..(254): a, c, t, g, unknown or other
  modified_base (257)..(257): a, c, t, g, unknown or other
  modified_base (268)..(268): a, c, t, g, unknown or other
  modified_base (297)..(297): a, c, t, g, unknown or other
  modified_base (357)..(357): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcagcgggccaccgatcgaactgcaagtccagccacaatctttanacatcaanananaactntantgacagcaganacagacagcctcagctgctctatttacgnggctactccgtaacccgggtacgtcccggggtcccctagaccgtattcgaggtcggacgngggtcgggtcgtgggacagtactttcactctcaccatcagcacgcctcgcgacgacgtagaagagtagtggtacgtagtttagtttattagtactaactaaattaattaatttaattacgttacgttacggtacggttacggtaccggtaaacggtaacggtaacggtacggtaagtagtaacgtaacgaacgtaacgtacgtacggtacgtacgtacg

SEQ ID NO: 430007 - DNA, 602 bp, Homo sapiens
  misc_feature: GZ8MTXP02F76RM.19.71.G05.1.454.CMB.2.raw
  modified_base (226)..(226): a, c, t, g, unknown or other
  modified_base (235)..(235): a, c, t, g, unknown or other
  modified_base (244)..(244): a, c, t, g, unknown or other
  modified_base (248)..(248): a, c, t, g, unknown or other
  modified_base (257)..(257): a, c, t, g, unknown or other
  modified_base (300)..(300): a, c, t, g, unknown or other
tcagtactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgacaagtccagccanaatctttanacatacaanatanaaactatanctgacagcagagacagacacgcctcgagctgctctatttacgnggactacgtaccgtaccgggaacgtcccggggtcccctacgaccgtatcgaggtcggacgcgggcgggtcgtagggactagtactttccactcctaccaaccgtatacgacgacgacgccgtcgacgacgacgtagaagtagtgtaggtacgttagtttagttagttacgtactaaactaaattaatttaattacttacgttacggttacggtacggttacggtaccggtaaacggtaacgtaacggtacggtaagtaacgtaacgtaacgtaacgtacgtacggtacggtacgtacgtacg

SEQ ID NO: 430008 - DNA, 648 bp, Homo sapiens
  misc_feature: GZ8MTXP02GFA6O.19.71.G05.1.454.CMB.2.raw
  modified_base (236)..(236): a, c, t, g, unknown or other
  modified_base (308)..(308): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacatctttanacagttccaacaatgaaactctagcttggaccagcagagaccaggacagcctcctaggctgctcatttacgnggctacgtaccgtaccgggacgtcccggggtcccctggacctattcgaggtcggacgacgggtcgggtacgtagggactagtactttaccgacttcctaccaaccgtactacgacgccgacgtcccgtagaccgtacgggtacgtaggaaagtacgttgggtacggtactttaagttttaatttacgttacgtaactaaacttaaatttaatttaatttaacgttacgtttacggttacgggttaccggtttaccgggaaaccggtaaacggggtaaccgtaagggttacggtaactacgtaacgaaacgtaacgtacgttggtacggtacgtacgaccg

SEQ ID NO: 430009 - DNA, 655 bp, Homo sapiens
  misc_feature: GZ8MTXP02HXCDE.19.71.G05.1.454.CMB.2.raw
  modified_base (239)..(239): a, c, t, g, unknown or other
  modified_base (249)..(249): a, c, t, g, unknown or other
  modified_base (254)..(254): a, c, t, g, unknown or other
  modified_base (308)..(308): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttaanacataccaanaatanaaactatagctagacagacagacacagacacgcctcagctgctactatttacgnggacacgtaccgtaaccgggaacgtcccggggtcccctagaccgtattcgaggtcggacgacgggtcgggtacgtacggggaactaagtactttaccaacttcctaccaaacctactaccgaacgccgtacgtcccgtacgacgacggtacgtaacggaaagtaagtaggttacggtacgttaagtttaagtttaagtttacgttaactaaactaaattaaatttaatttaacttaacgttacgttacggttacggttaccggtaaccgtaaacggtaaacggtaaacggtaacggtaacgtaacgtaacgtaacgtaacgtaacgtacgtacggtacgtacgtacg

SEQ ID NO: 430010 - DNA, 552 bp, Homo sapiens
  misc_feature: GZ8MTXP02FY8AK.19.71.G05.1.454.CMB.2.raw
  modified_base (237)..(237): a, c, t, g, unknown or other
  modified_base (312)..(312): a, c, t, g, unknown or other
  modified_base (355)..(355): a, c, t, g, unknown or other
  modified_base (413)..(413): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctcctaggctgctcatttacnggcatctaccgggaatccggggcccctgaccgattcagtggcnggcgggtctggggacagatttcactctcaccatcagcagcctgcaggctgaagatggnggactagtttattattgtacaaactaattattattaatacgttcgtaggtaccgtttcgggacctaaaagggggtacctaaaggggtaggtaattaagaaccgaacgtaacggaaaacttggtacgggaccttggaccc

SEQ ID NO: 430011 - DNA, 570 bp, Homo sapiens
  misc_feature: GZ8MTXP02JY926.19.71.G05.1.454.CMB.2.raw
  modified_base (237)..(237): a, c, t, g, unknown or other
  modified_base (245)..(245): a, c, t, g, unknown or other
  modified_base (249)..(249): a, c, t, g, unknown or other
  modified_base (258)..(258): a, c, t, g, unknown or other
  modified_base (303)..(303): a, c, t, g, unknown or other
  modified_base (364)..(364): a, c, t, g, unknown or other
  modified_base (428)..(428): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacatcaanatanaaactctanctgacagcagacgacagacagcctcgtaggctgctctatttacgnggcacgtaccgtaacccggggacgtcccggggtcccctacgaccgtattcgaggtcggcgngggtcgggtcgtcgggactagtactttcactctacaccatcagcacgcctgacgagctagaagngtggtggtacttagtttattagttacgtactaaactaattattattacttacgttcggtacggtacggttacggaccgtaaagggaccgtaagggtacgtaatacgtaacgaaggtaacgtacgtggtacggtacgtacgac

SEQ ID NO: 430012 - DNA, 616 bp, Homo sapiens
  misc_feature: GZ8MTXP02JE0MG.19.71.G05.1.454.CMB.2.raw
  modified_base (347)..(347): a, c, t, g, unknown or other
  modified_base (368)..(368): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccatcgagaggtctagagtggctggggaagacatatttcatgtccaaanacgtaggaaatacaaatttangacacatctgttagagagtcgactagaactaatacaaacgtagaaccaacaatacgaaacgaaaccgtacgtttacctaccccgttagaccgtaacggccttacggtaacccttcgttacggttaccggtaaccccgttacccgggaacgggtaaccggtaaccggggtttagttaaacgttaacgtttaaaccggttagggttaacggggaaaacggacccggggtaaccccccgtaattaaaccgg

SEQ ID NO: 430013 - DNA, 534 bp, Homo sapiens
  misc_feature: GZ8MTXP02IRC97.19.71.G05.1.454.CMB.2.raw
  modified_base (223)..(223): a, c, t, g, unknown or other
  modified_base (497)..(497): a, c, t, g, unknown or other
  modified_base (510)..(510): a, c, t, g, unknown or other
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctntcgctcacctgtgccatcgtccggggacagagtcgctagcgacagtgttgcttggcactgggtcaggcagtccccatcgagagtctagagtggctgggaagacatatttcattgtccaaacgacgtggaaatacaaaatttatagacaaccatctgttggagtagtcgaactgaacaatacaaacgtagacaactaatacgaaagtaacccaagttcctacccctagacaacgtctacgacctcgtagtcgacctacccggaggacgacgggtntaagtaattacgngtaggaagacggacccctagaacg

SEQ ID NO: 430014 - DNA, 627 bp, Homo sapiens
  misc_feature: GZ8MTXP02GF3PB.19.71.G05.1.454.CMB.2.raw
  modified_base (239)..(239): a, c, t, g, unknown or other
  modified_base (250)..(250): a, c, t, g, unknown or other
  modified_base (255)..(255): a, c, t, g, unknown or other
tcagtactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcagcgggccaccgatacgaactgacaagtccagccacaatcttttaanacattaccaanaatanaaactctagctgacagcagacgacagacacgcctacgtaggctcgctactactttacgtgggacctacgtacccgtaacccggggtaacgtccccggggtacctaccggaccgtattcgacggtcggaccgacgggtccggggtctacggggaactacgtactttcacttctaccaccatacacgcacgtcctcgcgacggcgtagaagtagtgtacggtacgttagtttattagttacgtactaactaaattaattaattattacgttacgttacggtacggttacggtaccggtaacggtaacggtaacggtacggtaacgtaacgtacgtaacgtaacgtaacgtacggtacggtacgtacgacgtacg

SEQ ID NO: 430015 - DNA, 568 bp, Homo sapiens
  misc_feature: GZ8MTXP02JF0R9.19.71.G05.1.454.CMB.2.raw
  modified_base (234)..(234): a, c, t, g, unknown or other
  modified_base (242)..(242): a, c, t, g, unknown or other
  modified_base (246)..(246): a, c, t, g, unknown or other
  modified_base (252)..(252): a, c, t, g, unknown or other
  modified_base (298)..(298): a, c, t, g, unknown or other
  modified_base (349)..(349): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggcaccatcaactgcaagtccagccacaatctttanacatcaanatanaaactntagcttagacagcagagacagacagcctcagctgctctatttacgnggcatccgtaccgggacgtccggggtcccctgaccgtattcgaggtcgcgngggtcgggtcgtgggacagtactttcactctacaccatcacgacacgcgtcgcgacgacgtagaagagtagtaggtacgtagtttagtttagttacgtactaaactaattaattaattaattacgttacgttacggtacggttacggtaccgtaaacggtaacggtaacggtacggtagtacgtaacgacgaacgtaacgtagtacggtacgtacgacg

SEQ ID NO: 430016 - DNA, 617 bp, Homo sapiens
  misc_feature: GZ8MTXP02GEPS7.19.71.G05.1.454.CMB.2.raw
  modified_base (244)..(244): a, c, t, g, unknown or other
  modified_base (252)..(252): a, c, t, g, unknown or other
  modified_base (256)..(256): a, c, t, g, unknown or other
  modified_base (274)..(274): a, c, t, g, unknown or other
tcagtactctcgtgcacgaccggtgctcgatttagtgtcgtcgcaagagagagggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacggactacgactgactaaggtccagcacaatctttaanacatcaanatanaactactatctcgtacanacagacgacagacacgacctaccgtacgctcgctactacttacgtacggacgtacgtaccgtaccggtacgtaccccgggtccgtacgacgtacgtacgtacgtcggcgacggcggtcgtacggacgacgtacttactactctacacactacgacgacgacgacgtacgacgacgacgtagaagtagtacgtacgtacgtagtttattagttacgtactaactaaattaattaattaacgttaacgttacgttacggttacggttaccggtacggtaacggtaacgtaacggtaacggtaacgtaacgtacgtaacgtaacgtaacgtacgtacgtacgtacg

SEQ ID NO: 430017 - DNA, 617 bp, Homo sapiens
  misc_feature: GZ8MTXP02G0F5J.19.71.G05.1.454.CMB.2.raw
  modified_base (241)..(241): a, c, t, g, unknown or other
  modified_base (256)..(256): a, c, t, g, unknown or other
  modified_base (335)..(335): a, c, t, g, unknown or other
  modified_base (400)..(400): a, c, t, g, unknown or other
  modified_base (441)..(441): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactcctggctgtgtctctgggcgaggcgggccacgatcgaactgacaagtccagccacaatcttttaanactacgttaccaaanaatacgaaaacttacttagtcttacggtaccagacaagacgaccgaaggacacgcctccgaggctgctactatttacgnggactacgtaccgtaacccggggaacgtcccggggtccccctaggaccgtattcgaggtcggcgngggtcgggtcgtagggactagtactttcactctacaaccanacagcacgcctgacgaggactagaagtgtaggtgtacgttagtttacttagtacgtaactaaattaaattaatttaattaatacgttacggtacggtacgttacggaaccgtaaagggaaaccgtaaggtacgtaatacgtaacgaacgaacgtaacgtggtacgacgtacgtacg

SEQ ID NO: 430018 - DNA, 588 bp, Homo sapiens
  misc_feature: GZ8MTXP02IJ8T7.19.71.G05.1.454.CMB.2.raw
  modified_base (237)..(237): a, c, t, g, unknown or other
  modified_base (245)..(245): a, c, t, g, unknown or other
  modified_base (247)..(247): a, c, t, g, unknown or other
  modified_base (249)..(249): a, c, t, g, unknown or other
  modified_base (258)..(258): a, c, t, g, unknown or other
  modified_base (269)..(269): a, c, t, g, unknown or other
  modified_base (300)..(300): a, c, t, g, unknown or other
  modified_base (356)..(356): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgcaagtccagccacatctttanacatcaanananaaactatantgacagcaganacagacagcctcgtagctgctctatttacgnggcactccgtacccgggaagtcccggggtcccctacgaccgtattcgagtcggcgnggtccgggtcgtacgggacagtactttcactcctacacctatacacgaccacgccgtcgacgacgacgtagaagagtaggtacggtacgtagtttagttagttacgtactaactaattaattattaattacgttacgttacggtacggttacggtaccggtaaacggtaacgtaacggtacggtagtaacgtaacgtaacgtaacgtaacgtacgtacggtacgtacgtacg

SEQ ID NO: 430019 - DNA, 542 bp, Homo sapiens
  misc_feature: GZ8MTXP02G40PL.19.71.G05.1.454.CMB.2.raw
  modified_base (238)..(238): a, c, t, g, unknown or other
  modified_base (311)..(311): a, c, t, g, unknown or other
  modified_base (362)..(362): a, c, t, g, unknown or other
  modified_base (373)..(373): a, c, t, g, unknown or other
  modified_base (423)..(423): a, c, t, g, unknown or other
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanacagttccaacaatgaaaactcttagcttggtaccagcagagaccaggacagcctctaggctgctcatttacnggcatccgtacccgggaatccggggtccccctgaccgtattcaggtggacngggccgggtcnggggacagtactttcactctcaccatcagcagccctgcgaggctgaaagntggtaggctagtttatattacgtacaaataattattattatacttcgtaggtacgttcggacctaagggactaagggtcgaattaagaacgaacgtaacgtacgtggtacgtctacgac

SEQ ID NO: 430020 - DNA, 550 bp, Homo sapiens
  misc_feature: GZ8MTXP02HXY91.19.71.G05.1.454.CMB.2.raw
  modified_base (238)..(238): a, c, t, g, unknown or other
  modified_base (315)..(315): a, c, t, g, unknown or other
  modified_base (360)..(360): a, c, t, g, unknown or other
  modified_base (415)..(415): a, c, t, g, unknown or other
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagagaccaggacagcctcctaggctgctcatttacgnggcatccgtacccggaatccggggtcccctgacctattcagtgcnggcgggtatgggacagtatttcactctcaccatcagcagcctgcagctagaaagntgtggctagtttatattgtacaaataatatttattatacgttcgtaggtacgtttcggaccgtaaaggggtacctaaagggtcggtaaattaacgaacgtaacggtaacgtacgtacggtcggtacgtacgaccg

SEQ ID NO: 430021 - DNA, 641 bp, Homo sapiens
  misc_feature: GZ8MTXP02GZWAS.19.71.G05.1.454.CMB.2.raw
  modified_base (245)..(245): a, c, t, g, unknown or other
  modified_base (334)..(334): a, c, t, g, unknown or other
tcagtactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgaggccgggccaccgatacgaactgacaagtccagccaacaattcttttaanactacgttaccaaactaatacgaaaactacttagtcttacggaccagacaagacgacaggacacgcctacgtagctgctactattacgngggactacgtaccgtaaccggtacgtcccgggtcctacggaccgtagttcgaggtcggaccgagggtccggggttcgtaggggtaacctagtactttaccaccttcctaccaacctatacgaacgccaacgtcctacgacgaggtactaggaagtagttggtagtacgttaagttttattagttataactaaaattaatttaatttaatttactacgttcgtacggtacgttacggaacgtaaacgggtacgtaaggtacgtactaacgacgtaaggaacgtaacgtggtacgtactacgacctacg

SEQ ID NO: 430022 - DNA, 535 bp, Homo sapiens
  misc_feature: GZ8MTXP02G5A5U.19.71.G05.1.454.CMB.2.raw
tcagtactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcagtccccatcgagaggtctagagtggctgggaagacatatttcatcgtaccaaacgacggtaggaaactacaaatttatcgacaccatctgttgagtagtcgactgaacaatacaaacgtagacaactatactaaacgaacctagttcctccctagcagcctcgtacctctcgtacgaccgtcccgaggacgtacgggtagtatattacgtagtacggaagacggaccccagtacgacatcgcctactcgtctctggtcgacttacg
